United States Patent 8,614,309 (DOUBLE-STRANDED RNA DIRECTED TO CASP2 AND METHODS OF USE THEREOF) - sequence listing, part 3

SEQ ID NO: 58989 - RNA, 23 nt, Artificial Sequence
  RNA Oligomer
gccuuaucugugaccagcugugu

SEQ ID NO: 58990 - RNA, 23 nt, Artificial Sequence
  RNA Oligomer
ccuuaucugugaccagcuguguu

SEQ ID NO: 58991 - RNA, 23 nt, Artificial Sequence
  RNA Oligomer
cuuaucugugaccagcuguguuc

SEQ ID NO: 58992 - RNA, 23 nt, Artificial Sequence
  RNA Oligomer
uuaucugugaccagcuguguuca

SEQ ID NO: 58993 - RNA, 23 nt, Artificial Sequence
  RNA Oligomer
caccaaccugguguccaaaaguc

SEQ ID NO: 58994 - RNA, 23 nt, Artificial Sequence
  RNA Oligomer
accaaccugguguccaaaagucu

SEQ ID NO: 58995 - RNA, 23 nt, Artificial Sequence
  RNA Oligomer
ccaaccugguguccaaaagucug

SEQ ID NO: 58996 - RNA, 23 nt, Artificial Sequence
  RNA Oligomer
caaccugguguccaaaagucugg

SEQ ID NO: 58997 - RNA, 23 nt, Artificial Sequence
  RNA Oligomer
aaccugguguccaaaagucuggu

SEQ ID NO: 58998 - RNA, 23 nt, Artificial Sequence
  RNA Oligomer
aagaaucuccggguuguuuuccc

SEQ ID NO: 58999 - RNA, 23 nt, Artificial Sequence
  RNA Oligomer
agaaucuccggguuguuuuccca

SEQ ID NO: 59000 - RNA, 23 nt, Artificial Sequence
  RNA Oligomer
gaaucuccggguuguuuucccac

SEQ ID NO: 59001 - RNA, 23 nt, Artificial Sequence
  RNA Oligomer
aaucuccggguuguuuucccacu

SEQ ID NO: 59002 - RNA, 23 nt, Artificial Sequence
  RNA Oligomer
aucuccggguuguuuucccacuc

SEQ ID NO: 59003 - RNA, 23 nt, Artificial Sequence
  RNA Oligomer
gaguuaacagaguugaccaacgu

SEQ ID NO: 59004 - RNA, 23 nt, Artificial Sequence
  RNA Oligomer
aguuaacagaguugaccaacguc

SEQ ID NO: 59005 - RNA, 23 nt, Artificial Sequence
  RNA Oligomer
guuaacagaguugaccaacgucu

SEQ ID NO: 59006 - RNA, 23 nt, Artificial Sequence
  RNA Oligomer
uuaacagaguugaccaacgucug

SEQ ID NO: 59007 - RNA, 23 nt, Artificial Sequence
  RNA Oligomer
uaacagaguugaccaacgucuga

SEQ ID NO: 59008 - RNA, 23 nt, Artificial Sequence
  RNA Oligomer
guauuuaauuuugcuguacuagc

SEQ ID NO: 59009 - RNA, 23 nt, Artificial Sequence
  RNA Oligomer
uuugcuguacuagcgacacccac

SEQ ID NO: 59010 - RNA, 23 nt, Artificial Sequence
  RNA Oligomer
uugcuguacuagcgacacccaca

SEQ ID NO: 59011 - RNA, 23 nt, Artificial Sequence
  RNA Oligomer
uagcacugaguucugucgggaca

SEQ ID NO: 59012 - RNA, 23 nt, Artificial Sequence
  RNA Oligomer
acaauggcaugauuaguggaguu

SEQ ID NO: 59013 - RNA, 23 nt, Artificial Sequence
  RNA Oligomer
caauggcaugauuaguggaguuc

SEQ ID NO: 59014 - RNA, 23 nt, Artificial Sequence
  RNA Oligomer
aauggcaugauuaguggaguuca

SEQ ID NO: 59015 - RNA, 23 nt, Artificial Sequence
  RNA Oligomer
aaguuacuagcaauggccuuauc

SEQ ID NO: 59016 - RNA, 23 nt, Artificial Sequence
  RNA Oligomer
aguuacuagcaauggccuuaucu

SEQ ID NO: 59017 - RNA, 23 nt, Artificial Sequence
  RNA Oligomer
guuacuagcaauggccuuaucug

SEQ ID NO: 59018 - RNA, 23 nt, Artificial Sequence
  RNA Oligomer
uaucugugaccagcuguguucau

SEQ ID NO: 59019 - RNA, 23 nt, Artificial Sequence
  RNA Oligomer
accugguguccaaaagucugguc

SEQ ID NO: 59020 - RNA, 23 nt, Artificial Sequence
  RNA Oligomer
ccugguguccaaaagucugguca

SEQ ID NO: 59021 - RNA, 23 nt, Artificial Sequence
  RNA Oligomer
cugguguccaaaagucuggucac

SEQ ID NO: 59022 - RNA, 23 nt, Artificial Sequence
  RNA Oligomer
auuaauucggugauggaaacugc

SEQ ID NO: 59023 - RNA, 23 nt, Artificial Sequence
  RNA Oligomer
uuaauucggugauggaaacugcu

SEQ ID NO: 59024 - RNA, 23 nt, Artificial Sequence
  RNA Oligomer
uaauucggugauggaaacugcua

SEQ ID NO: 59025 - RNA, 23 nt, Artificial Sequence
  RNA Oligomer
aauucggugauggaaacugcuau

SEQ ID NO: 59026 - RNA, 23 nt, Artificial Sequence
  RNA Oligomer
auucggugauggaaacugcuauu

SEQ ID NO: 59027 - RNA, 23 nt, Artificial Sequence
  RNA Oligomer
ucuuccaaagauucuucauggug

SEQ ID NO: 59028 - RNA, 23 nt, Artificial Sequence
  RNA Oligomer
gaggaaaagggcauucuccgugg

SEQ ID NO: 59029 - RNA, 23 nt, Artificial Sequence
  RNA Oligomer
aggaaaagggcauucuccguggc

SEQ ID NO: 59030 - RNA, 23 nt, Artificial Sequence
  RNA Oligomer
ggaaaagggcauucuccguggca

SEQ ID NO: 59031 - RNA, 23 nt, Artificial Sequence
  RNA Oligomer
gaaaagggcauucuccguggcag

SEQ ID NO: 59032 - RNA, 23 nt, Artificial Sequence
  RNA Oligomer
aaaagggcauucuccguggcagu

SEQ ID NO: 59033 - RNA, 23 nt, Artificial Sequence
  RNA Oligomer
cuccguggcaguaaaaggcguga

SEQ ID NO: 59034 - RNA, 23 nt, Artificial Sequence
  RNA Oligomer
uccguggcaguaaaaggcgugau

SEQ ID NO: 59035 - RNA, 23 nt, Artificial Sequence
  RNA Oligomer
ccguggcaguaaaaggcgugaua

SEQ ID NO: 59036 - RNA, 23 nt, Artificial Sequence
  RNA Oligomer
cguggcaguaaaaggcgugauac

SEQ ID NO: 59037 - RNA, 23 nt, Artificial Sequence
  RNA Oligomer
guggcaguaaaaggcgugauacc

SEQ ID NO: 59038 - RNA, 23 nt, Artificial Sequence
  RNA Oligomer
uggacuuaaggcguuuccgcugu

SEQ ID NO: 59039 - RNA, 23 nt, Artificial Sequence
  RNA Oligomer
ggacuuaaggcguuuccgcuguu

SEQ ID NO: 59040 - RNA, 23 nt, Artificial Sequence
  RNA Oligomer
gacuuaaggcguuuccgcuguuu

SEQ ID NO: 59041 - RNA, 23 nt, Artificial Sequence
  RNA Oligomer
acuuaaggcguuuccgcuguuug

SEQ ID NO: 59042 - RNA, 23 nt, Artificial Sequence
  RNA Oligomer
cuuaaggcguuuccgcuguuugu

SEQ ID NO: 59043 - RNA, 23 nt, Artificial Sequence
  RNA Oligomer
uucucuuuuguggagaggaugcc

SEQ ID NO: 59044 - RNA, 23 nt, Artificial Sequence
  RNA Oligomer
uguuucuccuccaagugggccac

SEQ ID NO: 59045 - RNA, 23 nt, Artificial Sequence
  RNA Oligomer
uggggugcgcaaguuauucuccc

SEQ ID NO: 59046 - RNA, 23 nt, Artificial Sequence
  RNA Oligomer
ggggugcgcaaguuauucucccu

SEQ ID NO: 59047 - RNA, 23 nt, Artificial Sequence
  RNA Oligomer
gggugcgcaaguuauucucccug

SEQ ID NO: 59048 - RNA, 23 nt, Artificial Sequence
  RNA Oligomer
ggugcgcaaguuauucucccugc

SEQ ID NO: 59049 - RNA, 23 nt, Artificial Sequence
  RNA Oligomer
gugcgcaaguuauucucccugca

SEQ ID NO: 59050 - RNA, 23 nt, Artificial Sequence
  RNA Oligomer
gaagaaucuccggguuguuuucc

SEQ ID NO: 59051 - RNA, 23 nt, Artificial Sequence
  RNA Oligomer
guuucugguaguucuuccaaaga

SEQ ID NO: 59052 - RNA, 23 nt, Artificial Sequence
  RNA Oligomer
ccacaaccauguccugauaguuc

SEQ ID NO: 59053 - RNA, 23 nt, Artificial Sequence
  RNA Oligomer
cacaaccauguccugauaguucu

SEQ ID NO: 59054 - RNA, 23 nt, Artificial Sequence
  RNA Oligomer
acaaccauguccugauaguucuu

SEQ ID NO: 59055 - RNA, 23 nt, Artificial Sequence
  RNA Oligomer
caaccauguccugauaguucuuu

SEQ ID NO: 59056 - RNA, 23 nt, Artificial Sequence
  RNA Oligomer
gcguccacauggaaaaacucugg

SEQ ID NO: 59057 - RNA, 23 nt, Artificial Sequence
  RNA Oligomer
agaguuaacagaguugaccaacg

SEQ ID NO: 59058 - RNA, 23 nt, Artificial Sequence
  RNA Oligomer
guuuguguuuggcuugacguuuu

SEQ ID NO: 59059 - RNA, 23 nt, Artificial Sequence
  RNA Oligomer
uuuguguuuggcuugacguuuuu

SEQ ID NO: 59060 - RNA, 23 nt, Artificial Sequence
  RNA Oligomer
uggccaaaaguuacuagcaaugg

SEQ ID NO: 59061 - RNA, 23 nt, Artificial Sequence
  RNA Oligomer
uucaucuuggugcaaagaccugc

SEQ ID NO: 59062 - RNA, 23 nt, Artificial Sequence
  RNA Oligomer
ucaucuuggugcaaagaccugcu

SEQ ID NO: 59063 - RNA, 23 nt, Artificial Sequence
  RNA Oligomer
caucuuggugcaaagaccugcuu

SEQ ID NO: 59064 - RNA, 23 nt, Artificial Sequence
  RNA Oligomer
aucuuggugcaaagaccugcuua

SEQ ID NO: 59065 - RNA, 23 nt, Artificial Sequence
  RNA Oligomer
ucuuggugcaaagaccugcuuau

SEQ ID NO: 59066 - RNA, 23 nt, Artificial Sequence
  RNA Oligomer
uuucgaguuggcuguugcagguu

SEQ ID NO: 59067 - RNA, 23 nt, Artificial Sequence
  RNA Oligomer
uucgaguuggcuguugcagguuu

SEQ ID NO: 59068 - RNA, 23 nt, Artificial Sequence
  RNA Oligomer
uauuaauucggugauggaaacug

SEQ ID NO: 59069 - RNA, 23 nt, Artificial Sequence
  RNA Oligomer
cuugcaucuguucucggaaaacc

SEQ ID NO: 59070 - RNA, 23 nt, Artificial Sequence
  RNA Oligomer
uugcaucuguucucggaaaaccu

SEQ ID NO: 59071 - RNA, 23 nt, Artificial Sequence
  RNA Oligomer
ugcaucuguucucggaaaaccug

SEQ ID NO: 59072 - RNA, 23 nt, Artificial Sequence
  RNA Oligomer
gcaucuguucucggaaaaccuga

SEQ ID NO: 59073 - RNA, 23 nt, Artificial Sequence
  RNA Oligomer
caucuguucucggaaaaccugaa

SEQ ID NO: 59074 - RNA, 23 nt, Artificial Sequence
  RNA Oligomer
aucuguucucggaaaaccugaag

SEQ ID NO: 59075 - RNA, 23 nt, Artificial Sequence
  RNA Oligomer
ucucggaaaaccugaagcucugc

SEQ ID NO: 59076 - RNA, 23 nt, Artificial Sequence
  RNA Oligomer
cugcugaggugauaaacuccucc

SEQ ID NO: 59077 - RNA, 23 nt, Artificial Sequence
  RNA Oligomer
ugcugaggugauaaacuccuccg

SEQ ID NO: 59078 - RNA, 23 nt, Artificial Sequence
  RNA Oligomer
gcugaggugauaaacuccuccgu

SEQ ID NO: 59079 - RNA, 23 nt, Artificial Sequence
  RNA Oligomer
cugaggugauaaacuccuccgug

SEQ ID NO: 59080 - RNA, 23 nt, Artificial Sequence
  RNA Oligomer
ugcgauacaggucuagcauguag

SEQ ID NO: 59081 - RNA, 23 nt, Artificial Sequence
  RNA Oligomer
gcgauacaggucuagcauguagg

SEQ ID NO: 59082 - RNA, 23 nt, Artificial Sequence
  RNA Oligomer
aguccgucuaagaagcacgcggg

SEQ ID NO: 59083 - RNA, 23 nt, Artificial Sequence
  RNA Oligomer
guugaccaacgucugaacaaugg

SEQ ID NO: 59084 - RNA, 23 nt, Artificial Sequence
  RNA Oligomer
uugaccaacgucugaacaauggc

SEQ ID NO: 59085 - RNA, 23 nt, Artificial Sequence
  RNA Oligomer
ugaccaacgucugaacaauggca

SEQ ID NO: 59086 - RNA, 23 nt, Artificial Sequence
  RNA Oligomer
gaccaacgucugaacaauggcau

SEQ ID NO: 59087 - RNA, 23 nt, Artificial Sequence
  RNA Oligomer
accaacgucugaacaauggcaug

SEQ ID NO: 59088 - RNA, 23 nt, Artificial Sequence
  RNA Oligomer
ccaacgucugaacaauggcauga

SEQ ID NO: 59089 - RNA, 23 nt, Artificial Sequence
  RNA Oligomer
caacgucugaacaauggcaugau

SEQ ID NO: 59090 - RNA, 23 nt, Artificial Sequence
  RNA Oligomer
aacgucugaacaauggcaugauu

SEQ ID NO: 59091 - RNA, 23 nt, Artificial Sequence
  RNA Oligomer
cguacaaagggugucucuuacag

SEQ ID NO: 59092 - RNA, 23 nt, Artificial Sequence
  RNA Oligomer
guacaaagggugucucuuacagc

SEQ ID NO: 59093 - RNA, 23 nt, Artificial Sequence
  RNA Oligomer
uacaaagggugucucuuacagcu

SEQ ID NO: 59094 - RNA, 23 nt, Artificial Sequence
  RNA Oligomer
acaaagggugucucuuacagcug

SEQ ID NO: 59095 - RNA, 23 nt, Artificial Sequence
  RNA Oligomer
caaagggugucucuuacagcugg

SEQ ID NO: 59096 - RNA, 23 nt, Artificial Sequence
  RNA Oligomer
cucuuacagcuggacuuaaggcg

SEQ ID NO: 59097 - RNA, 23 nt, Artificial Sequence
  RNA Oligomer
ucuuacagcuggacuuaaggcgu

SEQ ID NO: 59098 - RNA, 23 nt, Artificial Sequence
  RNA Oligomer
cuuacagcuggacuuaaggcguu

SEQ ID NO: 59099 - RNA, 23 nt, Artificial Sequence
  RNA Oligomer
uuacagcuggacuuaaggcguuu

SEQ ID NO: 59100 - RNA, 23 nt, Artificial Sequence
  RNA Oligomer
uacagcuggacuuaaggcguuuc

SEQ ID NO: 59101 - RNA, 23 nt, Artificial Sequence
  RNA Oligomer
gaccgaauguccguuccuuuucu

SEQ ID NO: 59102 - RNA, 23 nt, Artificial Sequence
  RNA Oligomer
ucucuuggagacaccuuguuucu

SEQ ID NO: 59103 - RNA, 23 nt, Artificial Sequence
  RNA Oligomer
cucuuggagacaccuuguuucuc

SEQ ID NO: 59104 - RNA, 23 nt, Artificial Sequence
  RNA Oligomer
ucuuggagacaccuuguuucucc

SEQ ID NO: 59105 - RNA, 23 nt, Artificial Sequence
  RNA Oligomer
cuuggagacaccuuguuucuccu

SEQ ID NO: 59106 - RNA, 23 nt, Artificial Sequence
  RNA Oligomer
uuggagacaccuuguuucuccuc

SEQ ID NO: 59107 - RNA, 23 nt, Artificial Sequence
  RNA Oligomer
cacgaauccaugguuggcguguc

SEQ ID NO: 59108 - RNA, 23 nt, Artificial Sequence
  RNA Oligomer
acgaauccaugguuggcgugucc

SEQ ID NO: 59109 - RNA, 23 nt, Artificial Sequence
  RNA Oligomer
cgaauccaugguuggcguguccc

SEQ ID NO: 59110 - RNA, 23 nt, Artificial Sequence
  RNA Oligomer
gaauccaugguuggcgugucccu

SEQ ID NO: 59111 - RNA, 23 nt, Artificial Sequence
  RNA Oligomer
aauccaugguuggcgugucccug

SEQ ID NO: 59112 - RNA, 23 nt, Artificial Sequence
  RNA Oligomer
ucugauucaccaaccuggugucc

SEQ ID NO: 59113 - RNA, 23 nt, Artificial Sequence
  RNA Oligomer
cugauucaccaaccuggugucca

SEQ ID NO: 59114 - RNA, 23 nt, Artificial Sequence
  RNA Oligomer
ugauucaccaaccugguguccaa

SEQ ID NO: 59115 - RNA, 23 nt, Artificial Sequence
  RNA Oligomer
gauucaccaaccugguguccaaa

SEQ ID NO: 59116 - RNA, 23 nt, Artificial Sequence
  RNA Oligomer
ugauggaaacugcuauuguuucc

SEQ ID NO: 59117 - RNA, 23 nt, Artificial Sequence
  RNA Oligomer
gauggaaacugcuauuguuuccu

SEQ ID NO: 59118 - RNA, 23 nt, Artificial Sequence
  RNA Oligomer
aaaaccugaagcucugcugaggu

SEQ ID NO: 59119 - RNA, 23 nt, Artificial Sequence
  RNA Oligomer
aaaccugaagcucugcugaggug

SEQ ID NO: 59120 - RNA, 23 nt, Artificial Sequence
  RNA Oligomer
gguacagcaucgagauagcacug

SEQ ID NO: 59121 - RNA, 23 nt, Artificial Sequence
  RNA Oligomer
guacagcaucgagauagcacuga

SEQ ID NO: 59122 - RNA, 23 nt, Artificial Sequence
  RNA Oligomer
uacagcaucgagauagcacugag

SEQ ID NO: 59123 - RNA, 23 nt, Artificial Sequence
  RNA Oligomer
uagaguuaacagaguugaccaac

SEQ ID NO: 59124 - RNA, 23 nt, Artificial Sequence
  RNA Oligomer
aacagaguugaccaacgucugaa

SEQ ID NO: 59125 - RNA, 23 nt, Artificial Sequence
  RNA Oligomer
aaaacucuggucaaaggaccugg

SEQ ID NO: 59126 - RNA, 23 nt, Artificial Sequence
  RNA Oligomer
aaacucuggucaaaggaccuggc

SEQ ID NO: 59127 - RNA, 23 nt, Artificial Sequence
  RNA Oligomer
uuuguggagaggaugcccuuuuc

SEQ ID NO: 59128 - RNA, 23 nt, Artificial Sequence
  RNA Oligomer
auggccuuaucugugaccagcug

SEQ ID NO: 59129 - RNA, 23 nt, Artificial Sequence
  RNA Oligomer
cuaacaugucucuuggagacacc

SEQ ID NO: 59130 - RNA, 23 nt, Artificial Sequence
  RNA Oligomer
uaacaugucucuuggagacaccu

SEQ ID NO: 59131 - RNA, 23 nt, Artificial Sequence
  RNA Oligomer
aacaugucucuuggagacaccuu

SEQ ID NO: 59132 - RNA, 23 nt, Artificial Sequence
  RNA Oligomer
acaugucucuuggagacaccuug

SEQ ID NO: 59133 - RNA, 23 nt, Artificial Sequence
  RNA Oligomer
caugucucuuggagacaccuugu

SEQ ID NO: 59134 - RNA, 23 nt, Artificial Sequence
  RNA Oligomer
gucucuuggagacaccuuguuuc

SEQ ID NO: 59135 - RNA, 23 nt, Artificial Sequence
  RNA Oligomer
ucucuuuucacgcugggaacagc

SEQ ID NO: 59136 - RNA, 23 nt, Artificial Sequence
  RNA Oligomer
cucuuuucacgcugggaacagcg

SEQ ID NO: 59137 - RNA, 23 nt, Artificial Sequence
  RNA Oligomer
ucuuuucacgcugggaacagcgu

SEQ ID NO: 59138 - RNA, 23 nt, Artificial Sequence
  RNA Oligomer
cuuuucacgcugggaacagcguc

SEQ ID NO: 59139 - RNA, 23 nt, Artificial Sequence
  RNA Oligomer
uuuucacgcugggaacagcgucu

SEQ ID NO: 59140 - RNA, 23 nt, Artificial Sequence
  RNA Oligomer
ccgcaacucgaacucgcucagga

SEQ ID NO: 59141 - RNA, 23 nt, Artificial Sequence
  RNA Oligomer
cgcaacucgaacucgcucaggac

SEQ ID NO: 59142 - RNA, 23 nt, Artificial Sequence
  RNA Oligomer
gcaacucgaacucgcucaggacc

SEQ ID NO: 59143 - RNA, 23 nt, Artificial Sequence
  RNA Oligomer
caacucgaacucgcucaggaccu

SEQ ID NO: 59144 - RNA, 23 nt, Artificial Sequence
  RNA Oligomer
aacucgaacucgcucaggaccuc

SEQ ID NO: 59145 - RNA, 23 nt, Artificial Sequence
  RNA Oligomer
aacucuggucaaaggaccuggcg

SEQ ID NO: 59146 - RNA, 23 nt, Artificial Sequence
  RNA Oligomer
acucuggucaaaggaccuggcgc

SEQ ID NO: 59147 - RNA, 23 nt, Artificial Sequence
  RNA Oligomer
aaguccacguacaaagggugucu

SEQ ID NO: 59148 - RNA, 23 nt, Artificial Sequence
  RNA Oligomer
aguccacguacaaagggugucuc

SEQ ID NO: 59149 - RNA, 23 nt, Artificial Sequence
  RNA Oligomer
guccacguacaaagggugucucu

SEQ ID NO: 59150 - RNA, 23 nt, Artificial Sequence
  RNA Oligomer
uccacguacaaagggugucucuu

SEQ ID NO: 59151 - RNA, 23 nt, Artificial Sequence
  RNA Oligomer
uccuaacaugucucuuggagaca

SEQ ID NO: 59152 - RNA, 23 nt, Artificial Sequence
  RNA Oligomer
ccuaacaugucucuuggagacac

SEQ ID NO: 59153 - RNA, 23 nt, Artificial Sequence
  RNA Oligomer
ccacuuccaccacgaauccaugg

SEQ ID NO: 59154 - RNA, 23 nt, Artificial Sequence
  RNA Oligomer
cacuuccaccacgaauccauggu

SEQ ID NO: 59155 - RNA, 23 nt, Artificial Sequence
  RNA Oligomer
acuuccaccacgaauccaugguu

SEQ ID NO: 59156 - RNA, 23 nt, Artificial Sequence
  RNA Oligomer
cuuccaccacgaauccaugguug

SEQ ID NO: 59157 - RNA, 23 nt, Artificial Sequence
  RNA Oligomer
uuccaccacgaauccaugguugg

SEQ ID NO: 59158 - RNA, 23 nt, Artificial Sequence
  RNA Oligomer
gcucugcugaggugauaaacucc

SEQ ID NO: 59159 - RNA, 23 nt, Artificial Sequence
  RNA Oligomer
cucugcugaggugauaaacuccu

SEQ ID NO: 59160 - RNA, 23 nt, Artificial Sequence
  RNA Oligomer
ucugcugaggugauaaacuccuc

SEQ ID NO: 59161 - RNA, 23 nt, Artificial Sequence
  RNA Oligomer
aagauucuucaugguggaagcug

SEQ ID NO: 59162 - RNA, 23 nt, Artificial Sequence
  RNA Oligomer
agauucuucaugguggaagcugc

SEQ ID NO: 59163 - RNA, 23 nt, Artificial Sequence
  RNA Oligomer
gauucuucaugguggaagcugcg

SEQ ID NO: 59164 - RNA, 23 nt, Artificial Sequence
  RNA Oligomer
auucuucaugguggaagcugcgc

SEQ ID NO: 59165 - RNA, 23 nt, Artificial Sequence
  RNA Oligomer
uucuucaugguggaagcugcgca

SEQ ID NO: 59166 - RNA, 23 nt, Artificial Sequence
  RNA Oligomer
cuguuucaggccgaacaugcuga

SEQ ID NO: 59167 - RNA, 23 nt, Artificial Sequence
  RNA Oligomer
uguuucaggccgaacaugcugag

SEQ ID NO: 59168 - RNA, 23 nt, Artificial Sequence
  RNA Oligomer
guuucaggccgaacaugcugagc

SEQ ID NO: 59169 - RNA, 23 nt, Artificial Sequence
  RNA Oligomer
uuucaggccgaacaugcugagca

SEQ ID NO: 59170 - RNA, 23 nt, Artificial Sequence
  RNA Oligomer
uucaggccgaacaugcugagcag

SEQ ID NO: 59171 - RNA, 23 nt, Artificial Sequence
  RNA Oligomer
agcguccacauggaaaaacucug

SEQ ID NO: 59172 - RNA, 23 nt, Artificial Sequence
  RNA Oligomer
aaagggugucucuuacagcugga

SEQ ID NO: 59173 - RNA, 23 nt, Artificial Sequence
  RNA Oligomer
aagggugucucuuacagcuggac

SEQ ID NO: 59174 - RNA, 23 nt, Artificial Sequence
  RNA Oligomer
ugguguccaaaagucuggucacg

SEQ ID NO: 59175 - RNA, 23 nt, Artificial Sequence
  RNA Oligomer
gguguccaaaagucuggucacgg

SEQ ID NO: 59176 - RNA, 23 nt, Artificial Sequence
  RNA Oligomer
guguccaaaagucuggucacggg

SEQ ID NO: 59177 - RNA, 23 nt, Artificial Sequence
  RNA Oligomer
ucuugcaucuguucucggaaaac

SEQ ID NO: 59178 - RNA, 23 nt, Artificial Sequence
  RNA Oligomer
agcucugcugaggugauaaacuc

SEQ ID NO: 59179 - RNA, 23 nt, Artificial Sequence
  RNA Oligomer
ucuccggguuguuuucccacucg

SEQ ID NO: 59180 - RNA, 23 nt, Artificial Sequence
  RNA Oligomer
ugcgcaaguuauucucccugcaa

SEQ ID NO: 59181 - RNA, 23 nt, Artificial Sequence
  RNA Oligomer
ucuucaugguggaagcugcgcac

SEQ ID NO: 59182 - RNA, 23 nt, Artificial Sequence
  RNA Oligomer
ucucuguuucaggccgaacaugc

SEQ ID NO: 59183 - RNA, 23 nt, Artificial Sequence
  RNA Oligomer
cucuguuucaggccgaacaugcu

SEQ ID NO: 59184 - RNA, 23 nt, Artificial Sequence
  RNA Oligomer
ucuguuucaggccgaacaugcug

SEQ ID NO: 59185 - RNA, 23 nt, Artificial Sequence
  RNA Oligomer
acagcaucgagauagcacugagu

SEQ ID NO: 59186 - RNA, 23 nt, Artificial Sequence
  RNA Oligomer
cagcaucgagauagcacugaguu

SEQ ID NO: 59187 - RNA, 23 nt, Artificial Sequence
  RNA Oligomer
agcaucgagauagcacugaguuc

SEQ ID NO: 59188 - RNA, 23 nt, Artificial Sequence
  RNA Oligomer
aucugugaccagcuguguucauc

SEQ ID NO: 59189 - RNA, 23 nt, Artificial Sequence
  RNA Oligomer
ucugugaccagcuguguucaucu

SEQ ID NO: 59190 - RNA, 23 nt, Artificial Sequence
  RNA Oligomer
guguucaucuuggugcaaagacc

SEQ ID NO: 59191 - RNA, 23 nt, Artificial Sequence
  RNA Oligomer
uguucaucuuggugcaaagaccu

SEQ ID NO: 59192 - RNA, 23 nt, Artificial Sequence
  RNA Oligomer
guucaucuuggugcaaagaccug

SEQ ID NO: 59193 - RNA, 23 nt, Artificial Sequence
  RNA Oligomer
augucucuuggagacaccuuguu

SEQ ID NO: 59194 - RNA, 23 nt, Artificial Sequence
  RNA Oligomer
ugucucuuggagacaccuuguuu

SEQ ID NO: 59195 - RNA, 23 nt, Artificial Sequence
  RNA Oligomer
uccaccacgaauccaugguuggc

SEQ ID NO: 59196 - RNA, 23 nt, Artificial Sequence
  RNA Oligomer
ccaccacgaauccaugguuggcg

SEQ ID NO: 59197 - RNA, 23 nt, Artificial Sequence
  RNA Oligomer
caccacgaauccaugguuggcgu

SEQ ID NO: 59198 - RNA, 23 nt, Artificial Sequence
  RNA Oligomer
uguccaaaagucuggucacgggg

SEQ ID NO: 59199 - RNA, 23 nt, Artificial Sequence
  RNA Oligomer
guccaaaagucuggucacgggga

SEQ ID NO: 59200 - RNA, 23 nt, Artificial Sequence
  RNA Oligomer
uccaaaagucuggucacggggaa

SEQ ID NO: 59201 - RNA, 23 nt, Artificial Sequence
  RNA Oligomer
uucggugauggaaacugcuauug

SEQ ID NO: 59202 - RNA, 23 nt, Artificial Sequence
  RNA Oligomer
ucggugauggaaacugcuauugu

SEQ ID NO: 59203 - RNA, 23 nt, Artificial Sequence
  RNA Oligomer
cggugauggaaacugcuauuguu

SEQ ID NO: 59204 - RNA, 23 nt, Artificial Sequence
  RNA Oligomer
ggugauggaaacugcuauuguuu

SEQ ID NO: 59205 - RNA, 23 nt, Artificial Sequence
  RNA Oligomer
gugauggaaacugcuauuguuuc

SEQ ID NO: 59206 - RNA, 23 nt, Artificial Sequence
  RNA Oligomer
acagaguugaccaacgucugaac

SEQ ID NO: 59207 - RNA, 23 nt, Artificial Sequence
  RNA Oligomer
agaggaaaagggcauucuccgug

SEQ ID NO: 59208 - RNA, 23 nt, Artificial Sequence
  RNA Oligomer
ucucuuacagcuggacuuaaggc

SEQ ID NO: 59209 - RNA, 23 nt, Artificial Sequence
  RNA Oligomer
cuuggugcaaagaccugcuuauc

SEQ ID NO: 59210 - RNA, 23 nt, Artificial Sequence
  RNA Oligomer
uuggugcaaagaccugcuuaucc

SEQ ID NO: 59211 - RNA, 23 nt, Artificial Sequence
  RNA Oligomer
uggugcaaagaccugcuuauccu

SEQ ID NO: 59212 - RNA, 23 nt, Artificial Sequence
  RNA Oligomer
ggugcaaagaccugcuuauccua

SEQ ID NO: 59213 - RNA, 23 nt, Artificial Sequence
  RNA Oligomer
gugcaaagaccugcuuauccuaa

SEQ ID NO: 59214 - RNA, 23 nt, Artificial Sequence
  RNA Oligomer
accacgaauccaugguuggcgug

SEQ ID NO: 59215 - RNA, 23 nt, Artificial Sequence
  RNA Oligomer
cgggggugacaucaaaacuuucc

SEQ ID NO: 59216 - RNA, 23 nt, Artificial Sequence
  RNA Oligomer
auucaccaaccugguguccaaaa

SEQ ID NO: 59217 - RNA, 23 nt, Artificial Sequence
  RNA Oligomer
ugauaaacuccuccguggggaua

SEQ ID NO: 59218 - RNA, 23 nt, Artificial Sequence
  RNA Oligomer
ccacgaauccaugguuggcgugu

SEQ ID NO: 59219 - RNA, 23 nt, Artificial Sequence
  RNA Oligomer
aagcagcaacgcuagaagacagc

SEQ ID NO: 59220 - RNA, 23 nt, Artificial Sequence
  RNA Oligomer
agcagcaacgcuagaagacagcg

SEQ ID NO: 59221 - RNA, 23 nt, Artificial Sequence
  RNA Oligomer
gcagcaacgcuagaagacagcgg

SEQ ID NO: 59222 - RNA, 23 nt, Artificial Sequence
  RNA Oligomer
cagcaacgcuagaagacagcggg

SEQ ID NO: 59223 - RNA, 23 nt, Artificial Sequence
  RNA Oligomer
agcaacgcuagaagacagcgggu

SEQ ID NO: 59224 - RNA, 23 nt, Artificial Sequence
  RNA Oligomer
gaaagagcguccacauggaaaaa

SEQ ID NO: 59225 - RNA, 23 nt, Artificial Sequence
  RNA Oligomer
cacguacaaagggugucucuuac

SEQ ID NO: 59226 - RNA, 23 nt, Artificial Sequence
  RNA Oligomer
acguacaaagggugucucuuaca

SEQ ID NO: 59227 - RNA, 23 nt, Artificial Sequence
  RNA Oligomer
agcuguguucaucuuggugcaaa

SEQ ID NO: 59228 - RNA, 23 nt, Artificial Sequence
  RNA Oligomer
gcuguguucaucuuggugcaaag

SEQ ID NO: 59229 - RNA, 23 nt, Artificial Sequence
  RNA Oligomer
uuguuuccuaaagcaucuugcau

SEQ ID NO: 59230 - RNA, 23 nt, Artificial Sequence
  RNA Oligomer
uguuuccuaaagcaucuugcauc

SEQ ID NO: 59231 - RNA, 23 nt, Artificial Sequence
  RNA Oligomer
guuuccuaaagcaucuugcaucu

SEQ ID NO: 59232 - RNA, 23 nt, Artificial Sequence
  RNA Oligomer
aagaagaaucuccggguuguuuu

SEQ ID NO: 59233 - RNA, 23 nt, Artificial Sequence
  RNA Oligomer
ggagaggaugcccuuuuccauca

SEQ ID NO: 59234 - RNA, 23 nt, Artificial Sequence
  RNA Oligomer
gagaggaugcccuuuuccaucau

SEQ ID NO: 59235 - RNA, 23 nt, Artificial Sequence
  RNA Oligomer
agaggaugcccuuuuccaucaug

SEQ ID NO: 59236 - RNA, 23 nt, Artificial Sequence
  RNA Oligomer
accauggucgaccuuuaggagac

SEQ ID NO: 59237 - RNA, 23 nt, Artificial Sequence
  RNA Oligomer
ccauggucgaccuuuaggagacc

SEQ ID NO: 59238 - RNA, 23 nt, Artificial Sequence
  RNA Oligomer
cauggucgaccuuuaggagaccg

SEQ ID NO: 59239 - RNA, 23 nt, Artificial Sequence
  RNA Oligomer
auggucgaccuuuaggagaccgc

SEQ ID NO: 59240 - RNA, 23 nt, Artificial Sequence
  RNA Oligomer
uggucgaccuuuaggagaccgca

SEQ ID NO: 59241 - RNA, 23 nt, Artificial Sequence
  RNA Oligomer
gugaccagcuguguucaucuugg

SEQ ID NO: 59242 - RNA, 23 nt, Artificial Sequence
  RNA Oligomer
uuguggagaggaugcccuuuucc

SEQ ID NO: 59243 - RNA, 23 nt, Artificial Sequence
  RNA Oligomer
uguggagaggaugcccuuuucca

SEQ ID NO: 59244 - RNA, 23 nt, Artificial Sequence
  RNA Oligomer
guggagaggaugcccuuuuccau

SEQ ID NO: 59245 - RNA, 23 nt, Artificial Sequence
  RNA Oligomer
uggagaggaugcccuuuuccauc

SEQ ID NO: 59246 - RNA, 23 nt, Artificial Sequence
  RNA Oligomer
cuguguucaucuuggugcaaaga

SEQ ID NO: 59247 - RNA, 23 nt, Artificial Sequence
  RNA Oligomer
uguguucaucuuggugcaaagac

SEQ ID NO: 59248 - RNA, 23 nt, Artificial Sequence
  RNA Oligomer
uuuccuaaagcaucuugcaucug

SEQ ID NO: 59249 - RNA, 23 nt, Artificial Sequence
  RNA Oligomer
auucucccugcaaguucaagaag

SEQ ID NO: 59250 - RNA, 23 nt, Artificial Sequence
  RNA Oligomer
uucucccugcaaguucaagaagu

SEQ ID NO: 59251 - RNA, 23 nt, Artificial Sequence
  RNA Oligomer
acuuucccaccugcuugcauucu

SEQ ID NO: 59252 - RNA, 23 nt, Artificial Sequence
  RNA Oligomer
uuucccaccugcuugcauucuga

SEQ ID NO: 59253 - RNA, 23 nt, Artificial Sequence
  RNA Oligomer
aacccuccacaaccauguccuga

SEQ ID NO: 59254 - RNA, 23 nt, Artificial Sequence
  RNA Oligomer
cugauaguucuuuaauacaaccu

SEQ ID NO: 59255 - RNA, 23 nt, Artificial Sequence
  RNA Oligomer
uucgaguuggcuguugcagguuu

SEQ ID NO: 59256 - RNA, 23 nt, Artificial Sequence
  RNA Oligomer
guacagcaucgagauagcacuga

SEQ ID NO: 59257 - RNA, 23 nt, Artificial Sequence
  RNA Oligomer
cauucuccguggcaguaaaaggc

SEQ ID NO: 59258 - RNA, 23 nt, Artificial Sequence
  RNA Oligomer
aaagagcguccacauggaaaaac

SEQ ID NO: 59259 - RNA, 23 nt, Artificial Sequence
  RNA Oligomer
uuuccuaaagcaucuugcaucug

SEQ ID NO: 59260 - RNA, 23 nt, Artificial Sequence
  RNA Oligomer
aucuuggugcaaagaccugcuua

SEQ ID NO: 59261 - RNA, 23 nt, Artificial Sequence
  RNA Oligomer
cuugcaucuguucucggaaaacc

SEQ ID NO: 59262 - RNA, 23 nt, Artificial Sequence
  RNA Oligomer
uuguguuuggcuugacguuuuuc

SEQ ID NO: 59263 - RNA, 23 nt, Artificial Sequence
  RNA Oligomer
uuggagacaccuuguuucuccuc

SEQ ID NO: 59264 - RNA, 23 nt, Artificial Sequence
  RNA Oligomer
uuggugcaaagaccugcuuaucc

SEQ ID NO: 59265 - RNA, 23 nt, Artificial Sequence
  RNA Oligomer
caaagggugucucuuacagcugg

SEQ ID NO: 59266 - RNA, 23 nt, Artificial Sequence
  RNA Oligomer
aaacucuggucaaaggaccuggc

SEQ ID NO: 59267 - RNA, 23 nt, Artificial Sequence
  RNA Oligomer
uuccaccacgaauccaugguugg

SEQ ID NO: 59268 - RNA, 23 nt, Artificial Sequence
  RNA Oligomer
aagcucugcugaggugauaaacu

SEQ ID NO: 59269 - RNA, 23 nt, Artificial Sequence
  RNA Oligomer
uugaccaacgucugaacaauggc

SEQ ID NO: 59270 - RNA, 23 nt, Artificial Sequence
  RNA Oligomer
uucuccguggcaguaaaaggcgu

SEQ ID NO: 59271 - RNA, 23 nt, Artificial Sequence
  RNA Oligomer
uaaggcguuuccgcuguuugugu

SEQ ID NO: 59272 - RNA, 23 nt, Artificial Sequence
  RNA Oligomer
ugcugaggugauaaacuccuccg

SEQ ID NO: 59273 - RNA, 23 nt, Artificial Sequence
  RNA Oligomer
uuucugguaguucuuccaaagau

SEQ ID NO: 59274 - RNA, 23 nt, Artificial Sequence
  RNA Oligomer
auucuucaugguggaagcugcgc

SEQ ID NO: 59275 - RNA, 23 nt, Artificial Sequence
  RNA Oligomer
uaacaugucucuuggagacaccu

SEQ ID NO: 59276 - RNA, 23 nt, Artificial Sequence
  RNA Oligomer
uucggugauggaaacugcuauug

SEQ ID NO: 59277 - RNA, 23 nt, Artificial Sequence
  RNA Oligomer
ugcaucuguucucggaaaaccug

SEQ ID NO: 59278 - RNA, 23 nt, Artificial Sequence
  RNA Oligomer
uuucaggccgaacaugcugagca

SEQ ID NO: 59279 - RNA, 23 nt, Artificial Sequence
  RNA Oligomer
aaaacucuggucaaaggaccugg

SEQ ID NO: 59280 - RNA, 23 nt, Artificial Sequence
  RNA Oligomer
ucucggaaaaccugaagcucugc

SEQ ID NO: 59281 - RNA, 23 nt, Artificial Sequence
  RNA Oligomer
cugcugaggugauaaacuccucc

SEQ ID NO: 59282 - RNA, 23 nt, Artificial Sequence
  RNA Oligomer
ucugguaguucuuccaaagauuc

SEQ ID NO: 59283 - RNA, 23 nt, Artificial Sequence
  RNA Oligomer
ucucuguuucaggccgaacaugc

SEQ ID NO: 59284 - RNA, 23 nt, Artificial Sequence
  RNA Oligomer
uacagcuggacuuaaggcguuuc

SEQ ID NO: 59285 - RNA, 23 nt, Artificial Sequence
  RNA Oligomer
uuaaggcguuuccgcuguuugug

SEQ ID NO: 59286 - RNA, 23 nt, Artificial Sequence
  RNA Oligomer
uuguggagaggaugcccuuuucc

SEQ ID NO: 59287 - RNA, 23 nt, Artificial Sequence
  RNA Oligomer
ucuuggagacaccuuguuucucc

SEQ ID NO: 59288 - RNA, 23 nt, Artificial Sequence
  RNA Oligomer
cuuccaccacgaauccaugguug

SEQ ID NO: 59289 - RNA, 23 nt, Artificial Sequence
  RNA Oligomer
cugaggugauaaacuccuccgug

SEQ ID NO: 59290 - RNA, 23 nt, Artificial Sequence
  RNA Oligomer
uuuucacgcugggaacagcgucu

SEQ ID NO: 59291 - RNA, 23 nt, Artificial Sequence
  RNA Oligomer
aagauucuucaugguggaagcug

SEQ ID NO: 59292 - RNA, 23 nt, Artificial Sequence
  RNA Oligomer
uacagcaucgagauagcacugag

SEQ ID NO: 59293 - RNA, 23 nt, Artificial Sequence
  RNA Oligomer
aagggugucucuuacagcuggac

SEQ ID NO: 59294 - RNA, 23 nt, Artificial Sequence
  RNA Oligomer
uggccaaaaguuacuagcaaugg

SEQ ID NO: 59295 - RNA, 23 nt, Artificial Sequence
  RNA Oligomer
uucaucuuggugcaaagaccugc

SEQ ID NO: 59296 - RNA, 23 nt, Artificial Sequence
  RNA Oligomer
aacaugucucuuggagacaccuu

SEQ ID NO: 59297 - RNA, 23 nt, Artificial Sequence
  RNA Oligomer
cucuuggagacaccuuguuucuc

SEQ ID NO: 59298 - RNA, 23 nt, Artificial Sequence
  RNA Oligomer
uauuaauucggugauggaaacug

SEQ ID NO: 59299 - RNA, 23 nt, Artificial Sequence
  RNA Oligomer
guugaccaacgucugaacaaugg

SEQ ID NO: 59300 - RNA, 23 nt, Artificial Sequence
  RNA Oligomer
guccacguacaaagggugucucu

SEQ ID NO: 59301 - RNA, 23 nt, Artificial Sequence
  RNA Oligomer
uuggcuguugcagguuuuaugau

SEQ ID NO: 59302 - RNA, 23 nt, Artificial Sequence
  RNA Oligomer
gugauggaaacugcuauuguuuc

SEQ ID NO: 59303 - RNA, 23 nt, Artificial Sequence
  RNA Oligomer
ugauggaaacugcuauuguuucc

SEQ ID NO: 59304 - RNA, 23 nt, Artificial Sequence
  RNA Oligomer
ugcgauacaggucuagcauguag

SEQ ID NO: 59305 - RNA, 23 nt, Artificial Sequence
  RNA Oligomer
agcaucgagauagcacugaguuc

SEQ ID NO: 59306 - RNA, 23 nt, Artificial Sequence
  RNA Oligomer
agaguuaacagaguugaccaacg

SEQ ID NO: 59307 - RNA, 23 nt, Artificial Sequence
  RNA Oligomer
auucuccguggcaguaaaaggcg

SEQ ID NO: 59308 - RNA, 23 nt, Artificial Sequence
  RNA Oligomer
aaguccacguacaaagggugucu

SEQ ID NO: 59309 - RNA, 23 nt, Artificial Sequence
  RNA Oligomer
gucucuuggagacaccuuguuuc

SEQ ID NO: 59310 - RNA, 23 nt, Artificial Sequence
  RNA Oligomer
cucugcugaggugauaaacuccu

SEQ ID NO: 59311 - RNA, 23 nt, Artificial Sequence
  RNA Oligomer
gaagaaucuccggguuguuuucc

SEQ ID NO: 59312 - RNA, 23 nt, Artificial Sequence
  RNA Oligomer
agauucuucaugguggaagcugc

SEQ ID NO: 59313 - RNA, 23 nt, Artificial Sequence
  RNA Oligomer
auggccuuaucugugaccagcug

SEQ ID NO: 59314 - RNA, 23 nt, Artificial Sequence
  RNA Oligomer
ugguguccaaaagucuggucacg

SEQ ID NO: 59315 - RNA, 23 nt, Artificial Sequence
  RNA Oligomer
ucggugauggaaacugcuauugu

SEQ ID NO: 59316 - RNA, 23 nt, Artificial Sequence
  RNA Oligomer
aaaccugaagcucugcugaggug

SEQ ID NO: 59317 - RNA, 23 nt, Artificial Sequence
  RNA Oligomer
agagcguccacauggaaaaacuc

SEQ ID NO: 59318 - RNA, 23 nt, Artificial Sequence
  RNA Oligomer
gagcguccacauggaaaaacucu

SEQ ID NO: 59319 - RNA, 23 nt, Artificial Sequence
  RNA Oligomer
ugaccaacgucugaacaauggca

SEQ ID NO: 59320 - RNA, 23 nt, Artificial Sequence
  RNA Oligomer
ucucuuacagcuggacuuaaggc

SEQ ID NO: 59321 - RNA, 23 nt, Artificial Sequence
  RNA Oligomer
gugaccagcuguguucaucuugg

SEQ ID NO: 59322 - RNA, 23 nt, Artificial Sequence
  RNA Oligomer
guucaucuuggugcaaagaccug

SEQ ID NO: 59323 - RNA, 23 nt, Artificial Sequence
  RNA Oligomer
agaccugcuuauccuaacauguc

SEQ ID NO: 59324 - RNA, 23 nt, Artificial Sequence
  RNA Oligomer
ucuuuucacgcugggaacagcgu

SEQ ID NO: 59325 - RNA, 23 nt, Artificial Sequence
  RNA Oligomer
ucugauucaccaaccuggugucc

SEQ ID NO: 59326 - RNA, 23 nt, Artificial Sequence
  RNA Oligomer
uuguuuccuaaagcaucuugcau

SEQ ID NO: 59327 - RNA, 23 nt, Artificial Sequence
  RNA Oligomer
aaccugaagcucugcugagguga

SEQ ID NO: 59328 - RNA, 23 nt, Artificial Sequence
  RNA Oligomer
uuuguggagaggaugcccuuuuc

SEQ ID NO: 59329 - RNA, 23 nt, Artificial Sequence
  RNA Oligomer
uguggagaggaugcccuuuucca

SEQ ID NO: 59330 - RNA, 23 nt, Artificial Sequence
  RNA Oligomer
aaaaccugaagcucugcugaggu

SEQ ID NO: 59331 - RNA, 23 nt, Artificial Sequence
  RNA Oligomer
aagcagcaacgcuagaagacagc

SEQ ID NO: 59332 - RNA, 23 nt, Artificial Sequence
  RNA Oligomer
gauucuucaugguggaagcugcg

SEQ ID NO: 59333 - RNA, 23 nt, Artificial Sequence
  RNA Oligomer
cucuuacagcuggacuuaaggcg

SEQ ID NO: 59334 - RNA, 23 nt, Artificial Sequence
  RNA Oligomer
cugauucaccaaccuggugucca

SEQ ID NO: 59335 - RNA, 23 nt, Artificial Sequence
  RNA Oligomer
uacaaagggugucucuuacagcu

SEQ ID NO: 59336 - RNA, 23 nt, Artificial Sequence
  RNA Oligomer
uguguucaucuuggugcaaagac

SEQ ID NO: 59337 - RNA, 23 nt, Artificial Sequence
  RNA Oligomer
uucuucaugguggaagcugcgca

SEQ ID NO: 59338 - RNA, 23 nt, Artificial Sequence
  RNA Oligomer
ucagccagaggaaaagggcauuc

SEQ ID NO: 59339 - RNA, 23 nt, Artificial Sequence
  RNA Oligomer
gcggaguuuuaaacuuuaaauag

SEQ ID NO: 59340 - RNA, 23 nt, Artificial Sequence
  RNA Oligomer
agcggaguuuuaaacuuuaaaua

SEQ ID NO: 59341 - RNA, 23 nt, Artificial Sequence
  RNA Oligomer
cagcggaguuuuaaacuuuaaau

SEQ ID NO: 59342 - RNA, 23 nt, Artificial Sequence
  RNA Oligomer
gcagcggaguuuuaaacuuuaaa

SEQ ID NO: 59343 - RNA, 23 nt, Artificial Sequence
  RNA Oligomer
agcagcggaguuuuaaacuuuaa

SEQ ID NO: 59344 - RNA, 23 nt, Artificial Sequence
  RNA Oligomer
ucagcuacauaaacaguuuugua

SEQ ID NO: 59345 - RNA, 23 nt, Artificial Sequence
  RNA Oligomer
gucagcuacauaaacaguuuugu

SEQ ID NO: 59346 - RNA, 23 nt, Artificial Sequence
  RNA Oligomer
ugucagcuacauaaacaguuuug

SEQ ID NO: 59347 - RNA, 23 nt, Artificial Sequence
  RNA Oligomer
augucagcuacauaaacaguuuu

SEQ ID NO: 59348 - RNA, 23 nt, Artificial Sequence
  RNA Oligomer
caugucagcuacauaaacaguuu

SEQ ID NO: 59349 - RNA, 23 nt, Artificial Sequence
  RNA Oligomer
gaaaaaaggugcuguagaaagug

SEQ ID NO: 59350 - RNA, 23 nt, Artificial Sequence
  RNA Oligomer
agaaaaaaggugcuguagaaagu

SEQ ID NO: 59351 - RNA, 23 nt, Artificial Sequence
  RNA Oligomer
aagaaaaaaggugcuguagaaag

SEQ ID NO: 59352 - RNA, 23 nt, Artificial Sequence
  RNA Oligomer
gaagaaaaaaggugcuguagaaa

SEQ ID NO: 59353 - RNA, 23 nt, Artificial Sequence
  RNA Oligomer
agaagaaaaaaggugcuguagaa

SEQ ID NO: 59354 - RNA, 23 nt, Artificial Sequence
  RNA Oligomer
gaaccuuucucauggauuuuugu

SEQ ID NO: 59355 - RNA, 23 nt, Artificial Sequence
  RNA Oligomer
ugaaccuuucucauggauuuuug

SEQ ID NO: 59356 - RNA, 23 nt, Artificial Sequence
  RNA Oligomer
uugaaccuuucucauggauuuuu

SEQ ID NO: 59357 - RNA, 23 nt, Artificial Sequence
  RNA Oligomer
uuugaaccuuucucauggauuuu

SEQ ID NO: 59358 - RNA, 23 nt, Artificial Sequence
  RNA Oligomer
auuugaaccuuucucauggauuu

SEQ ID NO: 59359 - RNA, 23 nt, Artificial Sequence
  RNA Oligomer
gagaagaaaaaaggugcuguaga

SEQ ID NO: 59360 - RNA, 23 nt, Artificial Sequence
  RNA Oligomer
uggagaagaaaaaaggugcugua

SEQ ID NO: 59361 - RNA, 23 nt, Artificial Sequence
  RNA Oligomer
gccuuuucauuuuacuucauccu

SEQ ID NO: 59362 - RNA, 23 nt, Artificial Sequence
  RNA Oligomer
ugccuuuucauuuuacuucaucc

SEQ ID NO: 59363 - RNA, 23 nt, Artificial Sequence
  RNA Oligomer
uugccuuuucauuuuacuucauc

SEQ ID NO: 59364 - RNA, 23 nt, Artificial Sequence
  RNA Oligomer
cuugccuuuucauuuuacuucau

SEQ ID NO: 59365 - RNA, 23 nt, Artificial Sequence
  RNA Oligomer
acuugccuuuucauuuuacuuca

SEQ ID NO: 59366 - RNA, 23 nt, Artificial Sequence
  RNA Oligomer
cagcuacauaaacaguuuuguac

SEQ ID NO: 59367 - RNA, 23 nt, Artificial Sequence
  RNA Oligomer
gcaugucagcuacauaaacaguu

SEQ ID NO: 59368 - RNA, 23 nt, Artificial Sequence
  RNA Oligomer
accuuucucauggauuuuugugg

SEQ ID NO: 59369 - RNA, 23 nt, Artificial Sequence
  RNA Oligomer
aaccuuucucauggauuuuugug

SEQ ID NO: 59370 - RNA, 23 nt, Artificial Sequence
  RNA Oligomer
ggauucaaagaacuuagauuaua

SEQ ID NO: 59371 - RNA, 23 nt, Artificial Sequence
  RNA Oligomer
uggauucaaagaacuuagauuau

SEQ ID NO: 59372 - RNA, 23 nt, Artificial Sequence
  RNA Oligomer
guggauucaaagaacuuagauua

SEQ ID NO: 59373 - RNA, 23 nt, Artificial Sequence
  RNA Oligomer
aguggauucaaagaacuuagauu

SEQ ID NO: 59374 - RNA, 23 nt, Artificial Sequence
  RNA Oligomer
uaguggauucaaagaacuuagau

SEQ ID NO: 59375 - RNA, 23 nt, Artificial Sequence
  RNA Oligomer
caauuguggagaagaaaaaaggu

SEQ ID NO: 59376 - RNA, 23 nt, Artificial Sequence
  RNA Oligomer
ucaauuguggagaagaaaaaagg

SEQ ID NO: 59377 - RNA, 23 nt, Artificial Sequence
  RNA Oligomer
cucaauuguggagaagaaaaaag

SEQ ID NO: 59378 - RNA, 23 nt, Artificial Sequence
  RNA Oligomer
acucaauuguggagaagaaaaaa

SEQ ID NO: 59379 - RNA, 23 nt, Artificial Sequence
  RNA Oligomer
cacucaauuguggagaagaaaaa

SEQ ID NO: 59380 - RNA, 23 nt, Artificial Sequence
  RNA Oligomer
gagaucuagauacaggcuugaaa

SEQ ID NO: 59381 - RNA, 23 nt, Artificial Sequence
  RNA Oligomer
ggagaucuagauacaggcuugaa

SEQ ID NO: 59382 - RNA, 23 nt, Artificial Sequence
  RNA Oligomer
uggagaucuagauacaggcuuga

SEQ ID NO: 59383 - RNA, 23 nt, Artificial Sequence
  RNA Oligomer
cuggagaucuagauacaggcuug

SEQ ID NO: 59384 - RNA, 23 nt, Artificial Sequence
  RNA Oligomer
ccuggagaucuagauacaggcuu

SEQ ID NO: 59385 - RNA, 23 nt, Artificial Sequence
  RNA Oligomer
cagcagcggaguuuuaaacuuua

SEQ ID NO: 59386 - RNA, 23 nt, Artificial Sequence
  RNA Oligomer
acagcagcggaguuuuaaacuuu

SEQ ID NO: 59387 - RNA, 23 nt, Artificial Sequence
  RNA Oligomer
aacagcagcggaguuuuaaacuu

SEQ ID NO: 59388 - RNA, 23 nt, Artificial Sequence
  RNA Oligomer
cgaaccuacaucaucaguauccu

SEQ ID NO: 59389 - RNA, 23 nt, Artificial Sequence
  RNA Oligomer
gcgaaccuacaucaucaguaucc

SEQ ID NO: 59390 - RNA, 23 nt, Artificial Sequence
  RNA Oligomer
ugcgaaccuacaucaucaguauc

SEQ ID NO: 59391 - RNA, 23 nt, Artificial Sequence
  RNA Oligomer
cugcgaaccuacaucaucaguau

SEQ ID NO: 59392 - RNA, 23 nt, Artificial Sequence
  RNA Oligomer
gcugcgaaccuacaucaucagua

SEQ ID NO: 59393 - RNA, 23 nt, Artificial Sequence
  RNA Oligomer
ccagcaacuuugauguuugcacu

SEQ ID NO: 59394 - RNA, 23 nt, Artificial Sequence
  RNA Oligomer
accagcaacuuugauguuugcac

SEQ ID NO: 59395 - RNA, 23 nt, Artificial Sequence
  RNA Oligomer
gaccagcaacuuugauguuugca

SEQ ID NO: 59396 - RNA, 23 nt, Artificial Sequence
  RNA Oligomer
ugaccagcaacuuugauguuugc

SEQ ID NO: 59397 - RNA, 23 nt, Artificial Sequence
  RNA Oligomer
gugaccagcaacuuugauguuug

SEQ ID NO: 59398 - RNA, 23 nt, Artificial Sequence
  RNA Oligomer
ccaucacuuuuucaucauuccuc

SEQ ID NO: 59399 - RNA, 23 nt, Artificial Sequence
  RNA Oligomer
accaucacuuuuucaucauuccu

SEQ ID NO: 59400 - RNA, 23 nt, Artificial Sequence
  RNA Oligomer
uaccaucacuuuuucaucauucc

SEQ ID NO: 59401 - RNA, 23 nt, Artificial Sequence
  RNA Oligomer
uuaccaucacuuuuucaucauuc

SEQ ID NO: 59402 - RNA, 23 nt, Artificial Sequence
  RNA Oligomer
auuaccaucacuuuuucaucauu

SEQ ID NO: 59403 - RNA, 23 nt, Artificial Sequence
  RNA Oligomer
ccauccacuugcacaauaucauu

SEQ ID NO: 59404 - RNA, 23 nt, Artificial Sequence
  RNA Oligomer
uccauccacuugcacaauaucau

SEQ ID NO: 59405 - RNA, 23 nt, Artificial Sequence
  RNA Oligomer
uuccauccacuugcacaauauca

SEQ ID NO: 59406 - RNA, 23 nt, Artificial Sequence
  RNA Oligomer
uuuccauccacuugcacaauauc

SEQ ID NO: 59407 - RNA, 23 nt, Artificial Sequence
  RNA Oligomer
uuuuccauccacuugcacaauau

SEQ ID NO: 59408 - RNA, 23 nt, Artificial Sequence
  RNA Oligomer
ggacuugugcuacuauauuuuuu

SEQ ID NO: 59409 - RNA, 23 nt, Artificial Sequence
  RNA Oligomer
uggacuugugcuacuauauuuuu

SEQ ID NO: 59410 - RNA, 23 nt, Artificial Sequence
  RNA Oligomer
auggacuugugcuacuauauuuu

SEQ ID NO: 59411 - RNA, 23 nt, Artificial Sequence
  RNA Oligomer
aauggacuugugcuacuauauuu

SEQ ID NO: 59412 - RNA, 23 nt, Artificial Sequence
  RNA Oligomer
caauggacuugugcuacuauauu

SEQ ID NO: 59413 - RNA, 23 nt, Artificial Sequence
  RNA Oligomer
ucccuguguauccuauuauggau

SEQ ID NO: 59414 - RNA, 23 nt, Artificial Sequence
  RNA Oligomer
uucccuguguauccuauuaugga

SEQ ID NO: 59415 - RNA, 23 nt, Artificial Sequence
  RNA Oligomer
uuucccuguguauccuauuaugg

SEQ ID NO: 59416 - RNA, 23 nt, Artificial Sequence
  RNA Oligomer
uuuucccuguguauccuauuaug

SEQ ID NO: 59417 - RNA, 23 nt, Artificial Sequence
  RNA Oligomer
uuuuucccuguguauccuauuau

SEQ ID NO: 59418 - RNA, 23 nt, Artificial Sequence
  RNA Oligomer
ccaauaugguguuuacauuauau

SEQ ID NO: 59419 - RNA, 23 nt, Artificial Sequence
  RNA Oligomer
gccaauaugguguuuacauuaua

SEQ ID NO: 59420 - RNA, 23 nt, Artificial Sequence
  RNA Oligomer
ggccaauaugguguuuacauuau

SEQ ID NO: 59421 - RNA, 23 nt, Artificial Sequence
  RNA Oligomer
gggccaauaugguguuuacauua

SEQ ID NO: 59422 - RNA, 23 nt, Artificial Sequence
  RNA Oligomer
ugggccaauaugguguuuacauu

SEQ ID NO: 59423 - RNA, 23 nt, Artificial Sequence
  RNA Oligomer
agcuacuacucacauucauuuaa

SEQ ID NO: 59424 - RNA, 23 nt, Artificial Sequence
  RNA Oligomer
cagcuacuacucacauucauuua

SEQ ID NO: 59425 - RNA, 23 nt, Artificial Sequence
  RNA Oligomer
ucagcuacuacucacauucauuu

SEQ ID NO: 59426 - RNA, 23 nt, Artificial Sequence
  RNA Oligomer
cucagcuacuacucacauucauu

SEQ ID NO: 59427 - RNA, 23 nt, Artificial Sequence
  RNA Oligomer
ccucagcuacuacucacauucau

SEQ ID NO: 59428 - RNA, 23 nt, Artificial Sequence
  RNA Oligomer
gacuugugcuacuauauuuuuuu

SEQ ID NO: 59429 - RNA, 23 nt, Artificial Sequence
  RNA Oligomer
ggcuuagaaaacacaaagacauu

SEQ ID NO: 59430 - RNA, 23 nt, Artificial Sequence
  RNA Oligomer
aggcuuagaaaacacaaagacau

SEQ ID NO: 59431 - RNA, 23 nt, Artificial Sequence
  RNA Oligomer
gaggcuuagaaaacacaaagaca

SEQ ID NO: 59432 - RNA, 23 nt, Artificial Sequence
  RNA Oligomer
ugaggcuuagaaaacacaaagac

SEQ ID NO: 59433 - RNA, 23 nt, Artificial Sequence
  RNA Oligomer
augaggcuuagaaaacacaaaga

SEQ ID NO: 59434 - RNA, 23 nt, Artificial Sequence
  RNA Oligomer
agaucuagauacaggcuugaaag

SEQ ID NO: 59435 - RNA, 23 nt, Artificial Sequence
  RNA Oligomer
ggcuaauuacagugcagaacaaa

SEQ ID NO: 59436 - RNA, 23 nt, Artificial Sequence
  RNA Oligomer
gggcuaauuacagugcagaacaa

SEQ ID NO: 59437 - RNA, 23 nt, Artificial Sequence
  RNA Oligomer
ugggcuaauuacagugcagaaca

SEQ ID NO: 59438 - RNA, 23 nt, Artificial Sequence
  RNA Oligomer
cugggcuaauuacagugcagaac

SEQ ID NO: 59439 - RNA, 23 nt, Artificial Sequence
  RNA Oligomer
acugggcuaauuacagugcagaa

SEQ ID NO: 59440 - RNA, 23 nt, Artificial Sequence
  RNA Oligomer
ucagcacuuuucuuucauuaggg

SEQ ID NO: 59441 - RNA, 23 nt, Artificial Sequence
  RNA Oligomer
aucagcacuuuucuuucauuagg

SEQ ID NO: 59442 - RNA, 23 nt, Artificial Sequence
  RNA Oligomer
uaucagcacuuuucuuucauuag

SEQ ID NO: 59443 - RNA, 23 nt, Artificial Sequence
  RNA Oligomer
guaucagcacuuuucuuucauua

SEQ ID NO: 59444 - RNA, 23 nt, Artificial Sequence
  RNA Oligomer
gguaucagcacuuuucuuucauu

SEQ ID NO: 59445 - RNA, 23 nt, Artificial Sequence
  RNA Oligomer
agugaccagcaacuuugauguuu

SEQ ID NO: 59446 - RNA, 23 nt, Artificial Sequence
  RNA Oligomer
ggauacugguuuuguuaauuaug

SEQ ID NO: 59447 - RNA, 23 nt, Artificial Sequence
  RNA Oligomer
uggauacugguuuuguuaauuau

SEQ ID NO: 59448 - RNA, 23 nt, Artificial Sequence
  RNA Oligomer
auggauacugguuuuguuaauua

SEQ ID NO: 59449 - RNA, 23 nt, Artificial Sequence
  RNA Oligomer
uauggauacugguuuuguuaauu

SEQ ID NO: 59450 - RNA, 23 nt, Artificial Sequence
  RNA Oligomer
uuauggauacugguuuuguuaau

SEQ ID NO: 59451 - RNA, 23 nt, Artificial Sequence
  RNA Oligomer
cccuguguauccuauuauggaua

SEQ ID NO: 59452 - RNA, 23 nt, Artificial Sequence
  RNA Oligomer
cuaaaauguuuuucccuguguau

SEQ ID NO: 59453 - RNA, 23 nt, Artificial Sequence
  RNA Oligomer
ccuaaaauguuuuucccugugua

SEQ ID NO: 59454 - RNA, 23 nt, Artificial Sequence
  RNA Oligomer
uccuaaaauguuuuucccugugu

SEQ ID NO: 59455 - RNA, 23 nt, Artificial Sequence
  RNA Oligomer
cuccuaaaauguuuuucccugug

SEQ ID NO: 59456 - RNA, 23 nt, Artificial Sequence
  RNA Oligomer
ucuccuaaaauguuuuucccugu

SEQ ID NO: 59457 - RNA, 23 nt, Artificial Sequence
  RNA Oligomer
ccuuucucauggauuuuuguggu

SEQ ID NO: 59458 - RNA, 23 nt, Artificial Sequence
  RNA Oligomer
gcccacagaauaagauuuuccau

SEQ ID NO: 59459 - RNA, 23 nt, Artificial Sequence
  RNA Oligomer
ggcccacagaauaagauuuucca

SEQ ID NO: 59460 - RNA, 23 nt, Artificial Sequence
  RNA Oligomer
aggcccacagaauaagauuuucc

SEQ ID NO: 59461 - RNA, 23 nt, Artificial Sequence
  RNA Oligomer
aaggcccacagaauaagauuuuc

SEQ ID NO: 59462 - RNA, 23 nt, Artificial Sequence
  RNA Oligomer
caaggcccacagaauaagauuuu

SEQ ID NO: 59463 - RNA, 23 nt, Artificial Sequence
  RNA Oligomer
ugaacaucuuaggucuuuucaac

SEQ ID NO: 59464 - RNA, 23 nt, Artificial Sequence
  RNA Oligomer
cugaacaucuuaggucuuuucaa

SEQ ID NO: 59465 - RNA, 23 nt, Artificial Sequence
  RNA Oligomer
ccugaacaucuuaggucuuuuca

SEQ ID NO: 59466 - RNA, 23 nt, Artificial Sequence
  RNA Oligomer
uccugaacaucuuaggucuuuuc

SEQ ID NO: 59467 - RNA, 23 nt, Artificial Sequence
  RNA Oligomer
uuccugaacaucuuaggucuuuu

SEQ ID NO: 59468 - RNA, 23 nt, Artificial Sequence
  RNA Oligomer
ugguaauuguggcuaaauauuuu

SEQ ID NO: 59469 - RNA, 23 nt, Artificial Sequence
  RNA Oligomer
gugguaauuguggcuaaauauuu

SEQ ID NO: 59470 - RNA, 23 nt, Artificial Sequence
  RNA Oligomer
ggugguaauuguggcuaaauauu

SEQ ID NO: 59471 - RNA, 23 nt, Artificial Sequence
  RNA Oligomer
gggugguaauuguggcuaaauau

SEQ ID NO: 59472 - RNA, 23 nt, Artificial Sequence
  RNA Oligomer
cgggugguaauuguggcuaaaua

SEQ ID NO: 59473 - RNA, 23 nt, Artificial Sequence
  RNA Oligomer
guggagaagaaaaaaggugcugu

SEQ ID NO: 59474 - RNA, 23 nt, Artificial Sequence
  RNA Oligomer
uguggagaagaaaaaaggugcug

SEQ ID NO: 59475 - RNA, 23 nt, Artificial Sequence
  RNA Oligomer
uuguggagaagaaaaaaggugcu

SEQ ID NO: 59476 - RNA, 23 nt, Artificial Sequence
  RNA Oligomer
ucuagauacaggcuugaaagcau

SEQ ID NO: 59477 - RNA, 23 nt, Artificial Sequence
  RNA Oligomer
aucuagauacaggcuugaaagca

SEQ ID NO: 59478 - RNA, 23 nt, Artificial Sequence
  RNA Oligomer
gaucuagauacaggcuugaaagc

SEQ ID NO: 59479 - RNA, 23 nt, Artificial Sequence
  RNA Oligomer
accuggagaucuagauacaggcu

SEQ ID NO: 59480 - RNA, 23 nt, Artificial Sequence
  RNA Oligomer
ucauuuuacuucauccuccaagg

SEQ ID NO: 59481 - RNA, 23 nt, Artificial Sequence
  RNA Oligomer
uucauuuuacuucauccuccaag

SEQ ID NO: 59482 - RNA, 23 nt, Artificial Sequence
  RNA Oligomer
uuucauuuuacuucauccuccaa

SEQ ID NO: 59483 - RNA, 23 nt, Artificial Sequence
  RNA Oligomer
uuuucauuuuacuucauccucca

SEQ ID NO: 59484 - RNA, 23 nt, Artificial Sequence
  RNA Oligomer
cuuuucauuuuacuucauccucc

SEQ ID NO: 59485 - RNA, 23 nt, Artificial Sequence
  RNA Oligomer
aacugggcuaauuacagugcaga

SEQ ID NO: 59486 - RNA, 23 nt, Artificial Sequence
  RNA Oligomer
caauucuucuugccgcaauuaca

SEQ ID NO: 59487 - RNA, 23 nt, Artificial Sequence
  RNA Oligomer
acaauucuucuugccgcaauuac

SEQ ID NO: 59488 - RNA, 23 nt, Artificial Sequence
  RNA Oligomer
aacaauucuucuugccgcaauua

SEQ ID NO: 59489 - RNA, 23 nt, Artificial Sequence
  RNA Oligomer
aaacaauucuucuugccgcaauu

SEQ ID NO: 59490 - RNA, 23 nt, Artificial Sequence
  RNA Oligomer
gaaacaauucuucuugccgcaau

SEQ ID NO: 59491 - RNA, 23 nt, Artificial Sequence
  RNA Oligomer
gcguuaaggaucggguuaaggga

SEQ ID NO: 59492 - RNA, 23 nt, Artificial Sequence
  RNA Oligomer
ggcguuaaggaucggguuaaggg

SEQ ID NO: 59493 - RNA, 23 nt, Artificial Sequence
  RNA Oligomer
gggcguuaaggaucggguuaagg

SEQ ID NO: 59494 - RNA, 23 nt, Artificial Sequence
  RNA Oligomer
agggcguuaaggaucggguuaag

SEQ ID NO: 59495 - RNA, 23 nt, Artificial Sequence
  RNA Oligomer
aagggcguuaaggaucggguuaa

SEQ ID NO: 59496 - RNA, 23 nt, Artificial Sequence
  RNA Oligomer
cccuggccuugaauaucauugaa

SEQ ID NO: 59497 - RNA, 23 nt, Artificial Sequence
  RNA Oligomer
ucccuggccuugaauaucauuga

SEQ ID NO: 59498 - RNA, 23 nt, Artificial Sequence
  RNA Oligomer
gucccuggccuugaauaucauug

SEQ ID NO: 59499 - RNA, 23 nt, Artificial Sequence
  RNA Oligomer
ugucccuggccuugaauaucauu

SEQ ID NO: 59500 - RNA, 23 nt, Artificial Sequence
  RNA Oligomer
gugucccuggccuugaauaucau

SEQ ID NO: 59501 - RNA, 23 nt, Artificial Sequence
  RNA Oligomer
ugaagcagauugagauaaagaag

SEQ ID NO: 59502 - RNA, 23 nt, Artificial Sequence
  RNA Oligomer
uugaagcagauugagauaaagaa

SEQ ID NO: 59503 - RNA, 23 nt, Artificial Sequence
  RNA Oligomer
cuugaagcagauugagauaaaga

SEQ ID NO: 59504 - RNA, 23 nt, Artificial Sequence
  RNA Oligomer
acuugaagcagauugagauaaag

SEQ ID NO: 59505 - RNA, 23 nt, Artificial Sequence
  RNA Oligomer
cacuugaagcagauugagauaaa

SEQ ID NO: 59506 - RNA, 23 nt, Artificial Sequence
  RNA Oligomer
agcuacauaaacaguuuuguaca

SEQ ID NO: 59507 - RNA, 23 nt, Artificial Sequence
  RNA Oligomer
ugaacuauauguugaagacaucu

SEQ ID NO: 59508 - RNA, 23 nt, Artificial Sequence
  RNA Oligomer
uugaacuauauguugaagacauc

SEQ ID NO: 59509 - RNA, 23 nt, Artificial Sequence
  RNA Oligomer
uuugaacuauauguugaagacau

SEQ ID NO: 59510 - RNA, 23 nt, Artificial Sequence
  RNA Oligomer
auuugaacuauauguugaagaca

SEQ ID NO: 59511 - RNA, 23 nt, Artificial Sequence
  RNA Oligomer
uauuugaacuauauguugaagac

SEQ ID NO: 59512 - RNA, 23 nt, Artificial Sequence
  RNA Oligomer
ggagugaccagcaacuuugaugu

SEQ ID NO: 59513 - RNA, 23 nt, Artificial Sequence
  RNA Oligomer
uggagugaccagcaacuuugaug

SEQ ID NO: 59514 - RNA, 23 nt, Artificial Sequence
  RNA Oligomer
uuggagugaccagcaacuuugau

SEQ ID NO: 59515 - RNA, 23 nt, Artificial Sequence
  RNA Oligomer
uuuggagugaccagcaacuuuga

SEQ ID NO: 59516 - RNA, 23 nt, Artificial Sequence
  RNA Oligomer
uuuuggagugaccagcaacuuug

SEQ ID NO: 59517 - RNA, 23 nt, Artificial Sequence
  RNA Oligomer
cuauuauggauacugguuuuguu

SEQ ID NO: 59518 - RNA, 23 nt, Artificial Sequence
  RNA Oligomer
ccuauuauggauacugguuuugu

SEQ ID NO: 59519 - RNA, 23 nt, Artificial Sequence
  RNA Oligomer
uccuauuauggauacugguuuug

SEQ ID NO: 59520 - RNA, 23 nt, Artificial Sequence
  RNA Oligomer
auccuauuauggauacugguuuu

SEQ ID NO: 59521 - RNA, 23 nt, Artificial Sequence
  RNA Oligomer
uauccuauuauggauacugguuu

SEQ ID NO: 59522 - RNA, 23 nt, Artificial Sequence
  RNA Oligomer
uucuccuaaaauguuuuucccug

SEQ ID NO: 59523 - RNA, 23 nt, Artificial Sequence
  RNA Oligomer
cuacuacucacauucauuuaaug

SEQ ID NO: 59524 - RNA, 23 nt, Artificial Sequence
  RNA Oligomer
gcuacuacucacauucauuuaau

SEQ ID NO: 59525 - RNA, 23 nt, Artificial Sequence
  RNA Oligomer
ucauuccucagcuacuacucaca

SEQ ID NO: 59526 - RNA, 23 nt, Artificial Sequence
  RNA Oligomer
aucauuccucagcuacuacucac

SEQ ID NO: 59527 - RNA, 23 nt, Artificial Sequence
  RNA Oligomer
caucauuccucagcuacuacuca

SEQ ID NO: 59528 - RNA, 23 nt, Artificial Sequence
  RNA Oligomer
ucaucauuccucagcuacuacuc

SEQ ID NO: 59529 - RNA, 23 nt, Artificial Sequence
  RNA Oligomer
uucaucauuccucagcuacuacu

SEQ ID NO: 59530 - RNA, 23 nt, Artificial Sequence
  RNA Oligomer
acaucuuaggucuuuucaacaag

SEQ ID NO: 59531 - RNA, 23 nt, Artificial Sequence
  RNA Oligomer
aacaucuuaggucuuuucaacaa

SEQ ID NO: 59532 - RNA, 23 nt, Artificial Sequence
  RNA Oligomer
cuuccugaacaucuuaggucuuu

SEQ ID NO: 59533 - RNA, 23 nt, Artificial Sequence
  RNA Oligomer
gcgggugguaauuguggcuaaau

SEQ ID NO: 59534 - RNA, 23 nt, Artificial Sequence
  RNA Oligomer
agcgggugguaauuguggcuaaa

SEQ ID NO: 59535 - RNA, 23 nt, Artificial Sequence
  RNA Oligomer
gagcgggugguaauuguggcuaa

SEQ ID NO: 59536 - RNA, 23 nt, Artificial Sequence
  RNA Oligomer
ccacucaauuguggagaagaaaa

SEQ ID NO: 59537 - RNA, 23 nt, Artificial Sequence
  RNA Oligomer
acaugaauuacagccacuagcca

SEQ ID NO: 59538 - RNA, 23 nt, Artificial Sequence
  RNA Oligomer
gacaugaauuacagccacuagcc

SEQ ID NO: 59539 - RNA, 23 nt, Artificial Sequence
  RNA Oligomer
ggacaugaauuacagccacuagc

SEQ ID NO: 59540 - RNA, 23 nt, Artificial Sequence
  RNA Oligomer
uggacaugaauuacagccacuag

SEQ ID NO: 59541 - RNA, 23 nt, Artificial Sequence
  RNA Oligomer
cuggacaugaauuacagccacua

SEQ ID NO: 59542 - RNA, 23 nt, Artificial Sequence
  RNA Oligomer
gcaaaacugggcuaauuacagug

SEQ ID NO: 59543 - RNA, 23 nt, Artificial Sequence
  RNA Oligomer
agcaaaacugggcuaauuacagu

SEQ ID NO: 59544 - RNA, 23 nt, Artificial Sequence
  RNA Oligomer
gagcaaaacugggcuaauuacag

SEQ ID NO: 59545 - RNA, 23 nt, Artificial Sequence
  RNA Oligomer
ugagcaaaacugggcuaauuaca

SEQ ID NO: 59546 - RNA, 23 nt, Artificial Sequence
  RNA Oligomer
gugagcaaaacugggcuaauuac

SEQ ID NO: 59547 - RNA, 23 nt, Artificial Sequence
  RNA Oligomer
ggguccugcagaucauauuugug

SEQ ID NO: 59548 - RNA, 23 nt, Artificial Sequence
  RNA Oligomer
uggguccugcagaucauauuugu

SEQ ID NO: 59549 - RNA, 23 nt, Artificial Sequence
  RNA Oligomer
cuggguccugcagaucauauuug

SEQ ID NO: 59550 - RNA, 23 nt, Artificial Sequence
  RNA Oligomer
ucuggguccugcagaucauauuu

SEQ ID NO: 59551 - RNA, 23 nt, Artificial Sequence
  RNA Oligomer
uucuggguccugcagaucauauu

SEQ ID NO: 59552 - RNA, 23 nt, Artificial Sequence
  RNA Oligomer
cagcacuuuucuuucauuagggg

SEQ ID NO: 59553 - RNA, 23 nt, Artificial Sequence
  RNA Oligomer
gcuacauaaacaguuuuguacaa

SEQ ID NO: 59554 - RNA, 23 nt, Artificial Sequence
  RNA Oligomer
acagaagauuggugaaaaugcug

SEQ ID NO: 59555 - RNA, 23 nt, Artificial Sequence
  RNA Oligomer
cacagaagauuggugaaaaugcu

SEQ ID NO: 59556 - RNA, 23 nt, Artificial Sequence
  RNA Oligomer
ucacagaagauuggugaaaaugc

SEQ ID NO: 59557 - RNA, 23 nt, Artificial Sequence
  RNA Oligomer
aucacagaagauuggugaaaaug

SEQ ID NO: 59558 - RNA, 23 nt, Artificial Sequence
  RNA Oligomer
caucacagaagauuggugaaaau

SEQ ID NO: 59559 - RNA, 23 nt, Artificial Sequence
  RNA Oligomer
gccuuuuuuaaaacucaucacag

SEQ ID NO: 59560 - RNA, 23 nt, Artificial Sequence
  RNA Oligomer
ugccuuuuuuaaaacucaucaca

SEQ ID NO: 59561 - RNA, 23 nt, Artificial Sequence
  RNA Oligomer
augccuuuuuuaaaacucaucac

SEQ ID NO: 59562 - RNA, 23 nt, Artificial Sequence
  RNA Oligomer
aaugccuuuuuuaaaacucauca

SEQ ID NO: 59563 - RNA, 23 nt, Artificial Sequence
  RNA Oligomer
aaaugccuuuuuuaaaacucauc

SEQ ID NO: 59564 - RNA, 23 nt, Artificial Sequence
  RNA Oligomer
gagugaccagcaacuuugauguu

SEQ ID NO: 59565 - RNA, 23 nt, Artificial Sequence
  RNA Oligomer
aauuugaaccuuucucauggauu

SEQ ID NO: 59566 - RNA, 23 nt, Artificial Sequence
  RNA Oligomer
uuucaucauuccucagcuacuac

SEQ ID NO: 59567 - RNA, 23 nt, Artificial Sequence
  RNA Oligomer
uuuucaucauuccucagcuacua

SEQ ID NO: 59568 - RNA, 23 nt, Artificial Sequence
  RNA Oligomer
ccauuguuaaaauuugcacuuug

SEQ ID NO: 59569 - RNA, 23 nt, Artificial Sequence
  RNA Oligomer
uccauuguuaaaauuugcacuuu

SEQ ID NO: 59570 - RNA, 23 nt, Artificial Sequence
  RNA Oligomer
uuccauuguuaaaauuugcacuu

SEQ ID NO: 59571 - RNA, 23 nt, Artificial Sequence
  RNA Oligomer
auuccauuguuaaaauuugcacu

SEQ ID NO: 59572 - RNA, 23 nt, Artificial Sequence
  RNA Oligomer
cauuccauuguuaaaauuugcac

SEQ ID NO: 59573 - RNA, 23 nt, Artificial Sequence
  RNA Oligomer
guccuuaagucccugcuaaaaca

SEQ ID NO: 59574 - RNA, 23 nt, Artificial Sequence
  RNA Oligomer
uguccuuaagucccugcuaaaac

SEQ ID NO: 59575 - RNA, 23 nt, Artificial Sequence
  RNA Oligomer
uuguccuuaagucccugcuaaaa

SEQ ID NO: 59576 - RNA, 23 nt, Artificial Sequence
  RNA Oligomer
auuguccuuaagucccugcuaaa

SEQ ID NO: 59577 - RNA, 23 nt, Artificial Sequence
  RNA Oligomer
gauuguccuuaagucccugcuaa

SEQ ID NO: 59578 - RNA, 23 nt, Artificial Sequence
  RNA Oligomer
guaguggauucaaagaacuuaga

SEQ ID NO: 59579 - RNA, 23 nt, Artificial Sequence
  RNA Oligomer
gcauguugguauuuaaaguagug

SEQ ID NO: 59580 - RNA, 23 nt, Artificial Sequence
  RNA Oligomer
ugcauguugguauuuaaaguagu

SEQ ID NO: 59581 - RNA, 23 nt, Artificial Sequence
  RNA Oligomer
gugcauguugguauuuaaaguag

SEQ ID NO: 59582 - RNA, 23 nt, Artificial Sequence
  RNA Oligomer
ggugcauguugguauuuaaagua

SEQ ID NO: 59583 - RNA, 23 nt, Artificial Sequence
  RNA Oligomer
aggugcauguugguauuuaaagu

SEQ ID NO: 59584 - RNA, 23 nt, Artificial Sequence
  RNA Oligomer
gcuuagaaaacacaaagacauua

SEQ ID NO: 59585 - RNA, 23 nt, Artificial Sequence
  RNA Oligomer
caugaggcuuagaaaacacaaag

SEQ ID NO: 59586 - RNA, 23 nt, Artificial Sequence
  RNA Oligomer
ucaugaggcuuagaaaacacaaa

SEQ ID NO: 59587 - RNA, 23 nt, Artificial Sequence
  RNA Oligomer
ccagguguuaauuuugauccggu

SEQ ID NO: 59588 - RNA, 23 nt, Artificial Sequence
  RNA Oligomer
accagguguuaauuuugauccgg

SEQ ID NO: 59589 - RNA, 23 nt, Artificial Sequence
  RNA Oligomer
caccagguguuaauuuugauccg

SEQ ID NO: 59590 - RNA, 23 nt, Artificial Sequence
  RNA Oligomer
gcaccagguguuaauuuugaucc

SEQ ID NO: 59591 - RNA, 23 nt, Artificial Sequence
  RNA Oligomer
ugcaccagguguuaauuuugauc

SEQ ID NO: 59592 - RNA, 23 nt, Artificial Sequence
  RNA Oligomer
aacuugccuuuucauuuuacuuc

SEQ ID NO: 59593 - RNA, 23 nt, Artificial Sequence
  RNA Oligomer
gcacagccuuuugauuuccccga

SEQ ID NO: 59594 - RNA, 23 nt, Artificial Sequence
  RNA Oligomer
ugcacagccuuuugauuuccccg

SEQ ID NO: 59595 - RNA, 23 nt, Artificial Sequence
  RNA Oligomer
augcacagccuuuugauuucccc

SEQ ID NO: 59596 - RNA, 23 nt, Artificial Sequence
  RNA Oligomer
caugcacagccuuuugauuuccc

SEQ ID NO: 59597 - RNA, 23 nt, Artificial Sequence
  RNA Oligomer
ccaugcacagccuuuugauuucc

SEQ ID NO: 59598 - RNA, 23 nt, Artificial Sequence
  RNA Oligomer
cccaugcacagccuuuugauuuc

SEQ ID NO: 59599 - RNA, 23 nt, Artificial Sequence
  RNA Oligomer
ucccaugcacagccuuuugauuu

SEQ ID NO: 59600 - RNA, 23 nt, Artificial Sequence
  RNA Oligomer
cucccaugcacagccuuuugauu

SEQ ID NO: 59601 - RNA, 23 nt, Artificial Sequence
  RNA Oligomer
acucccaugcacagccuuuugau

SEQ ID NO: 59602 - RNA, 23 nt, Artificial Sequence
  RNA Oligomer
gggucucaaaaauaugcuuauuu

SEQ ID NO: 59603 - RNA, 23 nt, Artificial Sequence
  RNA Oligomer
ugggucucaaaaauaugcuuauu

SEQ ID NO: 59604 - RNA, 23 nt, Artificial Sequence
  RNA Oligomer
gugggucucaaaaauaugcuuau

SEQ ID NO: 59605 - RNA, 23 nt, Artificial Sequence
  RNA Oligomer
ugugggucucaaaaauaugcuua

SEQ ID NO: 59606 - RNA, 23 nt, Artificial Sequence
  RNA Oligomer
cugugggucucaaaaauaugcuu

SEQ ID NO: 59607 - RNA, 23 nt, Artificial Sequence
  RNA Oligomer
acugugggucucaaaaauaugcu

SEQ ID NO: 59608 - RNA, 23 nt, Artificial Sequence
  RNA Oligomer
gacugugggucucaaaaauaugc

SEQ ID NO: 59609 - RNA, 23 nt, Artificial Sequence
  RNA Oligomer
agacugugggucucaaaaauaug

SEQ ID NO: 59610 - RNA, 23 nt, Artificial Sequence
  RNA Oligomer
aagacugugggucucaaaaauau

SEQ ID NO: 59611 - RNA, 23 nt, Artificial Sequence
  RNA Oligomer
gaauaucauugaacucuucuaug

SEQ ID NO: 59612 - RNA, 23 nt, Artificial Sequence
  RNA Oligomer
ugaauaucauugaacucuucuau

SEQ ID NO: 59613 - RNA, 23 nt, Artificial Sequence
  RNA Oligomer
uugaauaucauugaacucuucua

SEQ ID NO: 59614 - RNA, 23 nt, Artificial Sequence
  RNA Oligomer
cuugaauaucauugaacucuucu

SEQ ID NO: 59615 - RNA, 23 nt, Artificial Sequence
  RNA Oligomer
ccuugaauaucauugaacucuuc

SEQ ID NO: 59616 - RNA, 23 nt, Artificial Sequence
  RNA Oligomer
agcaugguaaggugaaaaugcga

SEQ ID NO: 59617 - RNA, 23 nt, Artificial Sequence
  RNA Oligomer
gagcaugguaaggugaaaaugcg

SEQ ID NO: 59618 - RNA, 23 nt, Artificial Sequence
  RNA Oligomer
agagcaugguaaggugaaaaugc

SEQ ID NO: 59619 - RNA, 23 nt, Artificial Sequence
  RNA Oligomer
aagagcaugguaaggugaaaaug

SEQ ID NO: 59620 - RNA, 23 nt, Artificial Sequence
  RNA Oligomer
gaagagcaugguaaggugaaaau

SEQ ID NO: 59621 - RNA, 23 nt, Artificial Sequence
  RNA Oligomer
caaucucucaugugcgcuucugg

SEQ ID NO: 59622 - RNA, 23 nt, Artificial Sequence
  RNA Oligomer
ccaaucucucaugugcgcuucug

SEQ ID NO: 59623 - RNA, 23 nt, Artificial Sequence
  RNA Oligomer
cccaaucucucaugugcgcuucu

SEQ ID NO: 59624 - RNA, 23 nt, Artificial Sequence
  RNA Oligomer
ucccaaucucucaugugcgcuuc

SEQ ID NO: 59625 - RNA, 23 nt, Artificial Sequence
  RNA Oligomer
uucccaaucucucaugugcgcuu

SEQ ID NO: 59626 - RNA, 23 nt, Artificial Sequence
  RNA Oligomer
ggagaguguucuuuauucaauaa

SEQ ID NO: 59627 - RNA, 23 nt, Artificial Sequence
  RNA Oligomer
uggagaguguucuuuauucaaua

SEQ ID NO: 59628 - RNA, 23 nt, Artificial Sequence
  RNA Oligomer
cuggagaguguucuuuauucaau

SEQ ID NO: 59629 - RNA, 23 nt, Artificial Sequence
  RNA Oligomer
ucuggagaguguucuuuauucaa

SEQ ID NO: 59630 - RNA, 23 nt, Artificial Sequence
  RNA Oligomer
uucuggagaguguucuuuauuca

SEQ ID NO: 59631 - RNA, 23 nt, Artificial Sequence
  RNA Oligomer
cggucauguucagcuucauugca

SEQ ID NO: 59632 - RNA, 23 nt, Artificial Sequence
  RNA Oligomer
acggucauguucagcuucauugc

SEQ ID NO: 59633 - RNA, 23 nt, Artificial Sequence
  RNA Oligomer
uacggucauguucagcuucauug

SEQ ID NO: 59634 - RNA, 23 nt, Artificial Sequence
  RNA Oligomer
cuacggucauguucagcuucauu

SEQ ID NO: 59635 - RNA, 23 nt, Artificial Sequence
  RNA Oligomer
acuacggucauguucagcuucau

SEQ ID NO: 59636 - RNA, 23 nt, Artificial Sequence
  RNA Oligomer
uggugaaaaugcugaguaugaca

SEQ ID NO: 59637 - RNA, 23 nt, Artificial Sequence
  RNA Oligomer
uuggugaaaaugcugaguaugac

SEQ ID NO: 59638 - RNA, 23 nt, Artificial Sequence
  RNA Oligomer
auuggugaaaaugcugaguauga

SEQ ID NO: 59639 - RNA, 23 nt, Artificial Sequence
  RNA Oligomer
gauuggugaaaaugcugaguaug

SEQ ID NO: 59640 - RNA, 23 nt, Artificial Sequence
  RNA Oligomer
agauuggugaaaaugcugaguau

SEQ ID NO: 59641 - RNA, 23 nt, Artificial Sequence
  RNA Oligomer
ggauucaguaguacacauacaac

SEQ ID NO: 59642 - RNA, 23 nt, Artificial Sequence
  RNA Oligomer
gaggauucaguaguacacauaca

SEQ ID NO: 59643 - RNA, 23 nt, Artificial Sequence
  RNA Oligomer
agaggauucaguaguacacauac

SEQ ID NO: 59644 - RNA, 23 nt, Artificial Sequence
  RNA Oligomer
aagaggauucaguaguacacaua

SEQ ID NO: 59645 - RNA, 23 nt, Artificial Sequence
  RNA Oligomer
gcacuaagauuuuauuuggaaug

SEQ ID NO: 59646 - RNA, 23 nt, Artificial Sequence
  RNA Oligomer
ugcacuaagauuuuauuuggaau

SEQ ID NO: 59647 - RNA, 23 nt, Artificial Sequence
  RNA Oligomer
uugcacuaagauuuuauuuggaa

SEQ ID NO: 59648 - RNA, 23 nt, Artificial Sequence
  RNA Oligomer
uuugcacuaagauuuuauuugga

SEQ ID NO: 59649 - RNA, 23 nt, Artificial Sequence
  RNA Oligomer
guuugcacuaagauuuuauuugg

SEQ ID NO: 59650 - RNA, 23 nt, Artificial Sequence
  RNA Oligomer
ucauuaaugugagagacuuagaa

SEQ ID NO: 59651 - RNA, 23 nt, Artificial Sequence
  RNA Oligomer
gucauuaaugugagagacuuaga

SEQ ID NO: 59652 - RNA, 23 nt, Artificial Sequence
  RNA Oligomer
agucauuaaugugagagacuuag

SEQ ID NO: 59653 - RNA, 23 nt, Artificial Sequence
  RNA Oligomer
uagucauuaaugugagagacuua

SEQ ID NO: 59654 - RNA, 23 nt, Artificial Sequence
  RNA Oligomer
uuagucauuaaugugagagacuu

SEQ ID NO: 59655 - RNA, 23 nt, Artificial Sequence
  RNA Oligomer
gcacacuuuuuuuuucuccuaaa

SEQ ID NO: 59656 - RNA, 23 nt, Artificial Sequence
  RNA Oligomer
agcacacuuuuuuuuucuccuaa

SEQ ID NO: 59657 - RNA, 23 nt, Artificial Sequence
  RNA Oligomer
aagcacacuuuuuuuuucuccua

SEQ ID NO: 59658 - RNA, 23 nt, Artificial Sequence
  RNA Oligomer
aaagcacacuuuuuuuuucuccu

SEQ ID NO: 59659 - RNA, 23 nt, Artificial Sequence
  RNA Oligomer
uaaagcacacuuuuuuuuucucc

SEQ ID NO: 59660 - RNA, 23 nt, Artificial Sequence
  RNA Oligomer
cucauggauuuuugugguguggg

SEQ ID NO: 59661 - RNA, 23 nt, Artificial Sequence
  RNA Oligomer
ucucauggauuuuuguggugugg

SEQ ID NO: 59662 - RNA, 23 nt, Artificial Sequence
  RNA Oligomer
uucucauggauuuuuguggugug

SEQ ID NO: 59663 - RNA, 23 nt, Artificial Sequence
  RNA Oligomer
uuucucauggauuuuuguggugu

SEQ ID NO: 59664 - RNA, 23 nt, Artificial Sequence
  RNA Oligomer
cuuucucauggauuuuuguggug

SEQ ID NO: 59665 - RNA, 23 nt, Artificial Sequence
  RNA Oligomer
agcagauacaguauaaacucaca

SEQ ID NO: 59666 - RNA, 23 nt, Artificial Sequence
  RNA Oligomer
aagcagauacaguauaaacucac

SEQ ID NO: 59667 - RNA, 23 nt, Artificial Sequence
  RNA Oligomer
caagcagauacaguauaaacuca

SEQ ID NO: 59668 - RNA, 23 nt, Artificial Sequence
  RNA Oligomer
acaagcagauacaguauaaacuc

SEQ ID NO: 59669 - RNA, 23 nt, Artificial Sequence
  RNA Oligomer
uacaagcagauacaguauaaacu

SEQ ID NO: 59670 - RNA, 23 nt, Artificial Sequence
  RNA Oligomer
gaauaagauuuuccaugcauuug

SEQ ID NO: 59671 - RNA, 23 nt, Artificial Sequence
  RNA Oligomer
agaauaagauuuuccaugcauuu

SEQ ID NO: 59672 - RNA, 23 nt, Artificial Sequence
  RNA Oligomer
cagaauaagauuuuccaugcauu

SEQ ID NO: 59673 - RNA, 23 nt, Artificial Sequence
  RNA Oligomer
acagaauaagauuuuccaugcau

SEQ ID NO: 59674 - RNA, 23 nt, Artificial Sequence
  RNA Oligomer
cacagaauaagauuuuccaugca

SEQ ID NO: 59675 - RNA, 23 nt, Artificial Sequence
  RNA Oligomer
gaggugcauguugguauuuaaag

SEQ ID NO: 59676 - RNA, 23 nt, Artificial Sequence
  RNA Oligomer
agaggugcauguugguauuuaaa

SEQ ID NO: 59677 - RNA, 23 nt, Artificial Sequence
  RNA Oligomer
gagaggugcauguugguauuuaa

SEQ ID NO: 59678 - RNA, 23 nt, Artificial Sequence
  RNA Oligomer
cacaaagacauuagaauaccuag

SEQ ID NO: 59679 - RNA, 23 nt, Artificial Sequence
  RNA Oligomer
acacaaagacauuagaauaccua

SEQ ID NO: 59680 - RNA, 23 nt, Artificial Sequence
  RNA Oligomer
aacacaaagacauuagaauaccu

SEQ ID NO: 59681 - RNA, 23 nt, Artificial Sequence
  RNA Oligomer
aaacacaaagacauuagaauacc

SEQ ID NO: 59682 - RNA, 23 nt, Artificial Sequence
  RNA Oligomer
aaaacacaaagacauuagaauac

SEQ ID NO: 59683 - RNA, 23 nt, Artificial Sequence
  RNA Oligomer
gugcaccagguguuaauuuugau

SEQ ID NO: 59684 - RNA, 23 nt, Artificial Sequence
  RNA Oligomer
agugcaccagguguuaauuuuga

SEQ ID NO: 59685 - RNA, 23 nt, Artificial Sequence
  RNA Oligomer
aagugcaccagguguuaauuuug

SEQ ID NO: 59686 - RNA, 23 nt, Artificial Sequence
  RNA Oligomer
aaagugcaccagguguuaauuuu

SEQ ID NO: 59687 - RNA, 23 nt, Artificial Sequence
  RNA Oligomer
uccacucaauuguggagaagaaa

SEQ ID NO: 59688 - RNA, 23 nt, Artificial Sequence
  RNA Oligomer
caagauuccacucaauuguggag

SEQ ID NO: 59689 - RNA, 23 nt, Artificial Sequence
  RNA Oligomer
ucaagauuccacucaauugugga

SEQ ID NO: 59690 - RNA, 23 nt, Artificial Sequence
  RNA Oligomer
aucaagauuccacucaauugugg

SEQ ID NO: 59691 - RNA, 23 nt, Artificial Sequence
  RNA Oligomer
caucaagauuccacucaauugug

SEQ ID NO: 59692 - RNA, 23 nt, Artificial Sequence
  RNA Oligomer
gcaucaagauuccacucaauugu

SEQ ID NO: 59693 - RNA, 23 nt, Artificial Sequence
  RNA Oligomer
aacucccaugcacagccuuuuga

SEQ ID NO: 59694 - RNA, 23 nt, Artificial Sequence
  RNA Oligomer
uaauuacagugcagaacaaaauc

SEQ ID NO: 59695 - RNA, 23 nt, Artificial Sequence
  RNA Oligomer
cuaauuacagugcagaacaaaau

SEQ ID NO: 59696 - RNA, 23 nt, Artificial Sequence
  RNA Oligomer
gcuaauuacagugcagaacaaaa

SEQ ID NO: 59697 - RNA, 23 nt, Artificial Sequence
  RNA Oligomer
aaacugggcuaauuacagugcag

SEQ ID NO: 59698 - RNA, 23 nt, Artificial Sequence
  RNA Oligomer
aaaacugggcuaauuacagugca

SEQ ID NO: 59699 - RNA, 23 nt, Artificial Sequence
  RNA Oligomer
ugaagagcaugguaaggugaaaa

SEQ ID NO: 59700 - RNA, 23 nt, Artificial Sequence
  RNA Oligomer
uugaagagcaugguaaggugaaa

SEQ ID NO: 59701 - RNA, 23 nt, Artificial Sequence
  RNA Oligomer
guacgguauugaagagcauggua

SEQ ID NO: 59702 - RNA, 23 nt, Artificial Sequence
  RNA Oligomer
aguacgguauugaagagcauggu

SEQ ID NO: 59703 - RNA, 23 nt, Artificial Sequence
  RNA Oligomer
aaguacgguauugaagagcaugg

SEQ ID NO: 59704 - RNA, 23 nt, Artificial Sequence
  RNA Oligomer
caaguacgguauugaagagcaug

SEQ ID NO: 59705 - RNA, 23 nt, Artificial Sequence
  RNA Oligomer
ucaaguacgguauugaagagcau

SEQ ID NO: 59706 - RNA, 23 nt, Artificial Sequence
  RNA Oligomer
ccaaacagcagcggaguuuuaaa

SEQ ID NO: 59707 - RNA, 23 nt, Artificial Sequence
  RNA Oligomer
accaaacagcagcggaguuuuaa

SEQ ID NO: 59708 - RNA, 23 nt, Artificial Sequence
  RNA Oligomer
uaccaaacagcagcggaguuuua

SEQ ID NO: 59709 - RNA, 23 nt, Artificial Sequence
  RNA Oligomer
guaccaaacagcagcggaguuuu

SEQ ID NO: 59710 - RNA, 23 nt, Artificial Sequence
  RNA Oligomer
aguaccaaacagcagcggaguuu

SEQ ID NO: 59711 - RNA, 23 nt, Artificial Sequence
  RNA Oligomer
agaaguucaaguacgguauugaa

SEQ ID NO: 59712 - RNA, 23 nt, Artificial Sequence
  RNA Oligomer
aagaaguucaaguacgguauuga

SEQ ID NO: 59713 - RNA, 23 nt, Artificial Sequence
  RNA Oligomer
aaagaaguucaaguacgguauug

SEQ ID NO: 59714 - RNA, 23 nt, Artificial Sequence
  RNA Oligomer
uaaagaaguucaaguacgguauu

SEQ ID NO: 59715 - RNA, 23 nt, Artificial Sequence
  RNA Oligomer
auaaagaaguucaaguacgguau

SEQ ID NO: 59716 - RNA, 23 nt, Artificial Sequence
  RNA Oligomer
agcagauugagauaaagaaguuc

SEQ ID NO: 59717 - RNA, 23 nt, Artificial Sequence
  RNA Oligomer
aagcagauugagauaaagaaguu

SEQ ID NO: 59718 - RNA, 23 nt, Artificial Sequence
  RNA Oligomer
gaagcagauugagauaaagaagu

SEQ ID NO: 59719 - RNA, 23 nt, Artificial Sequence
  RNA Oligomer
gcagaucauauuugugucuguac

SEQ ID NO: 59720 - RNA, 23 nt, Artificial Sequence
  RNA Oligomer
ugcagaucauauuugugucugua

SEQ ID NO: 59721 - RNA, 23 nt, Artificial Sequence
  RNA Oligomer
cugcagaucauauuugugucugu

SEQ ID NO: 59722 - RNA, 23 nt, Artificial Sequence
  RNA Oligomer
ccugcagaucauauuugugucug

SEQ ID NO: 59723 - RNA, 23 nt, Artificial Sequence
  RNA Oligomer
uccugcagaucauauuugugucu

SEQ ID NO: 59724 - RNA, 23 nt, Artificial Sequence
  RNA Oligomer
gcacuuuucuuucauuaggggga

SEQ ID NO: 59725 - RNA, 23 nt, Artificial Sequence
  RNA Oligomer
agcacuuuucuuucauuaggggg

SEQ ID NO: 59726 - RNA, 23 nt, Artificial Sequence
  RNA Oligomer
guugugaaaaugucugcuaugac

SEQ ID NO: 59727 - RNA, 23 nt, Artificial Sequence
  RNA Oligomer
gguugugaaaaugucugcuauga

SEQ ID NO: 59728 - RNA, 23 nt, Artificial Sequence
  RNA Oligomer
ugguugugaaaaugucugcuaug

SEQ ID NO: 59729 - RNA, 23 nt, Artificial Sequence
  RNA Oligomer
cugguugugaaaaugucugcuau

SEQ ID NO: 59730 - RNA, 23 nt, Artificial Sequence
  RNA Oligomer
ccugguugugaaaaugucugcua

SEQ ID NO: 59731 - RNA, 23 nt, Artificial Sequence
  RNA Oligomer
ugcauguaauguagaccuagucc

SEQ ID NO: 59732 - RNA, 23 nt, Artificial Sequence
  RNA Oligomer
uugcauguaauguagaccuaguc

SEQ ID NO: 59733 - RNA, 23 nt, Artificial Sequence
  RNA Oligomer
auugcauguaauguagaccuagu

SEQ ID NO: 59734 - RNA, 23 nt, Artificial Sequence
  RNA Oligomer
cauugcauguaauguagaccuag

SEQ ID NO: 59735 - RNA, 23 nt, Artificial Sequence
  RNA Oligomer
ucauugcauguaauguagaccua

SEQ ID NO: 59736 - RNA, 23 nt, Artificial Sequence
  RNA Oligomer
ugcugaguaugacacuuuucuuc

SEQ ID NO: 59737 - RNA, 23 nt, Artificial Sequence
  RNA Oligomer
augcugaguaugacacuuuucuu

SEQ ID NO: 59738 - RNA, 23 nt, Artificial Sequence
  RNA Oligomer
aaugcugaguaugacacuuuucu

SEQ ID NO: 59739 - RNA, 23 nt, Artificial Sequence
  RNA Oligomer
aaaugcugaguaugacacuuuuc

SEQ ID NO: 59740 - RNA, 23 nt, Artificial Sequence
  RNA Oligomer
aaaaugcugaguaugacacuuuu

SEQ ID NO: 59741 - RNA, 23 nt, Artificial Sequence
  RNA Oligomer
ggcugucaguacuuuucauuuuc

SEQ ID NO: 59742 - RNA, 23 nt, Artificial Sequence
  RNA Oligomer
uggcugucaguacuuuucauuuu

SEQ ID NO: 59743 - RNA, 23 nt, Artificial Sequence
  RNA Oligomer
guggcugucaguacuuuucauuu

SEQ ID NO: 59744 - RNA, 23 nt, Artificial Sequence
  RNA Oligomer
uguggcugucaguacuuuucauu

SEQ ID NO: 59745 - RNA, 23 nt, Artificial Sequence
  RNA Oligomer
guguggcugucaguacuuuucau

SEQ ID NO: 59746 - RNA, 23 nt, Artificial Sequence
  RNA Oligomer
agguaucagcacuuuucuuucau

SEQ ID NO: 59747 - RNA, 23 nt, Artificial Sequence
  RNA Oligomer
gagguaucagcacuuuucuuuca

SEQ ID NO: 59748 - RNA, 23 nt, Artificial Sequence
  RNA Oligomer
cgagguaucagcacuuuucuuuc

SEQ ID NO: 59749 - RNA, 23 nt, Artificial Sequence
  RNA Oligomer
acgagguaucagcacuuuucuuu

SEQ ID NO: 59750 - RNA, 23 nt, Artificial Sequence
  RNA Oligomer
caacuuugauguuugcacuaaga

SEQ ID NO: 59751 - RNA, 23 nt, Artificial Sequence
  RNA Oligomer
gcaacuuugauguuugcacuaag

SEQ ID NO: 59752 - RNA, 23 nt, Artificial Sequence
  RNA Oligomer
agcaacuuugauguuugcacuaa

SEQ ID NO: 59753 - RNA, 23 nt, Artificial Sequence
  RNA Oligomer
cagcaacuuugauguuugcacua

SEQ ID NO: 59754 - RNA, 23 nt, Artificial Sequence
  RNA Oligomer
gccuaaaugaauuuugcaguaac

SEQ ID NO: 59755 - RNA, 23 nt, Artificial Sequence
  RNA Oligomer
ugccuaaaugaauuuugcaguaa

SEQ ID NO: 59756 - RNA, 23 nt, Artificial Sequence
  RNA Oligomer
gugccuaaaugaauuuugcagua

SEQ ID NO: 59757 - RNA, 23 nt, Artificial Sequence
  RNA Oligomer
ugugccuaaaugaauuuugcagu

SEQ ID NO: 59758 - RNA, 23 nt, Artificial Sequence
  RNA Oligomer
augugccuaaaugaauuuugcag

SEQ ID NO: 59759 - RNA, 23 nt, Artificial Sequence
  RNA Oligomer
gacuauuaaaugugccuaaauga

SEQ ID NO: 59760 - RNA, 23 nt, Artificial Sequence
  RNA Oligomer
ggacuauuaaaugugccuaaaug

SEQ ID NO: 59761 - RNA, 23 nt, Artificial Sequence
  RNA Oligomer
uggacuauuaaaugugccuaaau

SEQ ID NO: 59762 - RNA, 23 nt, Artificial Sequence
  RNA Oligomer
guggacuauuaaaugugccuaaa

SEQ ID NO: 59763 - RNA, 23 nt, Artificial Sequence
  RNA Oligomer
aguggacuauuaaaugugccuaa

SEQ ID NO: 59764 - RNA, 23 nt, Artificial Sequence
  RNA Oligomer
acaggcuuuagucauuaauguga

SEQ ID NO: 59765 - RNA, 23 nt, Artificial Sequence
  RNA Oligomer
aacaggcuuuagucauuaaugug

SEQ ID NO: 59766 - RNA, 23 nt, Artificial Sequence
  RNA Oligomer
aaacaggcuuuagucauuaaugu

SEQ ID NO: 59767 - RNA, 23 nt, Artificial Sequence
  RNA Oligomer
uaaacaggcuuuagucauuaaug

SEQ ID NO: 59768 - RNA, 23 nt, Artificial Sequence
  RNA Oligomer
guaaacaggcuuuagucauuaau

SEQ ID NO: 59769 - RNA, 23 nt, Artificial Sequence
  RNA Oligomer
ugaugcuugaaugauagaauuuu

SEQ ID NO: 59770 - RNA, 23 nt, Artificial Sequence
  RNA Oligomer
uugaugcuugaaugauagaauuu

SEQ ID NO: 59771 - RNA, 23 nt, Artificial Sequence
  RNA Oligomer
auugaugcuugaaugauagaauu

SEQ ID NO: 59772 - RNA, 23 nt, Artificial Sequence
  RNA Oligomer
cauugaugcuugaaugauagaau

SEQ ID NO: 59773 - RNA, 23 nt, Artificial Sequence
  RNA Oligomer
ucauugaugcuugaaugauagaa

SEQ ID NO: 59774 - RNA, 23 nt, Artificial Sequence
  RNA Oligomer
guuuuucccuguguauccuauua

SEQ ID NO: 59775 - RNA, 23 nt, Artificial Sequence
  RNA Oligomer
aaauguuuuucccuguguauccu

SEQ ID NO: 59776 - RNA, 23 nt, Artificial Sequence
  RNA Oligomer
aaaauguuuuucccuguguaucc

SEQ ID NO: 59777 - RNA, 23 nt, Artificial Sequence
  RNA Oligomer
uaaaauguuuuucccuguguauc

SEQ ID NO: 59778 - RNA, 23 nt, Artificial Sequence
  RNA Oligomer
uuucuccuaaaauguuuuucccu

SEQ ID NO: 59779 - RNA, 23 nt, Artificial Sequence
  RNA Oligomer
uuuucuccuaaaauguuuuuccc

SEQ ID NO: 59780 - RNA, 23 nt, Artificial Sequence
  RNA Oligomer
uacgagguaucagcacuuuucuu

SEQ ID NO: 59781 - RNA, 23 nt, Artificial Sequence
  RNA Oligomer
uuacgagguaucagcacuuuucu

SEQ ID NO: 59782 - RNA, 23 nt, Artificial Sequence
  RNA Oligomer
uuuacgagguaucagcacuuuuc

SEQ ID NO: 59783 - RNA, 23 nt, Artificial Sequence
  RNA Oligomer
ucauggauuuuuguggugugggc

SEQ ID NO: 59784 - RNA, 23 nt, Artificial Sequence
  RNA Oligomer
guacaagcagauacaguauaaac

SEQ ID NO: 59785 - RNA, 23 nt, Artificial Sequence
  RNA Oligomer
gguacaagcagauacaguauaaa

SEQ ID NO: 59786 - RNA, 23 nt, Artificial Sequence
  RNA Oligomer
ugguacaagcagauacaguauaa

SEQ ID NO: 59787 - RNA, 23 nt, Artificial Sequence
  RNA Oligomer
uugguacaagcagauacaguaua

SEQ ID NO: 59788 - RNA, 23 nt, Artificial Sequence
  RNA Oligomer
auugguacaagcagauacaguau

SEQ ID NO: 59789 - RNA, 23 nt, Artificial Sequence
  RNA Oligomer
cgaagaguuuguuuuguuuguca

SEQ ID NO: 59790 - RNA, 23 nt, Artificial Sequence
  RNA Oligomer
ucgaagaguuuguuuuguuuguc

SEQ ID NO: 59791 - RNA, 23 nt, Artificial Sequence
  RNA Oligomer
gucgaagaguuuguuuuguuugu

SEQ ID NO: 59792 - RNA, 23 nt, Artificial Sequence
  RNA Oligomer
ugucgaagaguuuguuuuguuug

SEQ ID NO: 59793 - RNA, 23 nt, Artificial Sequence
  RNA Oligomer
gugucgaagaguuuguuuuguuu

SEQ ID NO: 59794 - RNA, 23 nt, Artificial Sequence
  RNA Oligomer
cauuaccaucacuuuuucaucau

SEQ ID NO: 59795 - RNA, 23 nt, Artificial Sequence
  RNA Oligomer
acaauaucauuaccaucacuuuu

SEQ ID NO: 59796 - RNA, 23 nt, Artificial Sequence
  RNA Oligomer
cacaauaucauuaccaucacuuu

SEQ ID NO: 59797 - RNA, 23 nt, Artificial Sequence
  RNA Oligomer
gcacaauaucauuaccaucacuu

SEQ ID NO: 59798 - RNA, 23 nt, Artificial Sequence
  RNA Oligomer
ugcacaauaucauuaccaucacu

SEQ ID NO: 59799 - RNA, 23 nt, Artificial Sequence
  RNA Oligomer
uugcacaauaucauuaccaucac

SEQ ID NO: 59800 - RNA, 23 nt, Artificial Sequence
  RNA Oligomer
cccacagaauaagauuuuccaug

SEQ ID NO: 59801 - RNA, 23 nt, Artificial Sequence
  RNA Oligomer
acaaggcccacagaauaagauuu

SEQ ID NO: 59802 - RNA, 23 nt, Artificial Sequence
  RNA Oligomer
ucuuaggucuuuucaacaagaaa

SEQ ID NO: 59803 - RNA, 23 nt, Artificial Sequence
  RNA Oligomer
aucuuaggucuuuucaacaagaa

SEQ ID NO: 59804 - RNA, 23 nt, Artificial Sequence
  RNA Oligomer
caucuuaggucuuuucaacaaga

SEQ ID NO: 59805 - RNA, 23 nt, Artificial Sequence
  RNA Oligomer
gguaauuguggcuaaauauuuuu

SEQ ID NO: 59806 - RNA, 23 nt, Artificial Sequence
  RNA Oligomer
aguaguggauucaaagaacuuag

SEQ ID NO: 59807 - RNA, 23 nt, Artificial Sequence
  RNA Oligomer
gguauuuaaaguaguggauucaa

SEQ ID NO: 59808 - RNA, 23 nt, Artificial Sequence
  RNA Oligomer
ugguauuuaaaguaguggauuca

SEQ ID NO: 59809 - RNA, 23 nt, Artificial Sequence
  RNA Oligomer
uugguauuuaaaguaguggauuc

SEQ ID NO: 59810 - RNA, 23 nt, Artificial Sequence
  RNA Oligomer
guugguauuuaaaguaguggauu

SEQ ID NO: 59811 - RNA, 23 nt, Artificial Sequence
  RNA Oligomer
uguugguauuuaaaguaguggau

SEQ ID NO: 59812 - RNA, 23 nt, Artificial Sequence
  RNA Oligomer
acauuagaauaccuagguucacu

SEQ ID NO: 59813 - RNA, 23 nt, Artificial Sequence
  RNA Oligomer
gacauuagaauaccuagguucac

SEQ ID NO: 59814 - RNA, 23 nt, Artificial Sequence
  RNA Oligomer
agacauuagaauaccuagguuca

SEQ ID NO: 59815 - RNA, 23 nt, Artificial Sequence
  RNA Oligomer
aagacauuagaauaccuagguuc

SEQ ID NO: 59816 - RNA, 23 nt, Artificial Sequence
  RNA Oligomer
aaagacauuagaauaccuagguu

SEQ ID NO: 59817 - RNA, 23 nt, Artificial Sequence
  RNA Oligomer
caaagacauuagaauaccuaggu

SEQ ID NO: 59818 - RNA, 23 nt, Artificial Sequence
  RNA Oligomer
acaaagacauuagaauaccuagg

SEQ ID NO: 59819 - RNA, 23 nt, Artificial Sequence
  RNA Oligomer
agaaagugcaccagguguuaauu

SEQ ID NO: 59820 - RNA, 23 nt, Artificial Sequence
  RNA Oligomer
uagaaagugcaccagguguuaau

SEQ ID NO: 59821 - RNA, 23 nt, Artificial Sequence
  RNA Oligomer
guagaaagugcaccagguguuaa

SEQ ID NO: 59822 - RNA, 23 nt, Artificial Sequence
  RNA Oligomer
uguagaaagugcaccagguguua

SEQ ID NO: 59823 - RNA, 23 nt, Artificial Sequence
  RNA Oligomer
cuguagaaagugcaccagguguu

SEQ ID NO: 59824 - RNA, 23 nt, Artificial Sequence
  RNA Oligomer
ggaagcaccaucucuaacuccca

SEQ ID NO: 59825 - RNA, 23 nt, Artificial Sequence
  RNA Oligomer
gggaagcaccaucucuaacuccc

SEQ ID NO: 59826 - RNA, 23 nt, Artificial Sequence
  RNA Oligomer
cgggaagcaccaucucuaacucc

SEQ ID NO: 59827 - RNA, 23 nt, Artificial Sequence
  RNA Oligomer
gcgggaagcaccaucucuaacuc

SEQ ID NO: 59828 - RNA, 23 nt, Artificial Sequence
  RNA Oligomer
ggcgggaagcaccaucucuaacu

SEQ ID NO: 59829 - RNA, 23 nt, Artificial Sequence
  RNA Oligomer
gcagaacaaaaucgaauggggca

SEQ ID NO: 59830 - RNA, 23 nt, Artificial Sequence
  RNA Oligomer
ugcagaacaaaaucgaauggggc

SEQ ID NO: 59831 - RNA, 23 nt, Artificial Sequence
  RNA Oligomer
gugcagaacaaaaucgaaugggg

SEQ ID NO: 59832 - RNA, 23 nt, Artificial Sequence
  RNA Oligomer
agugcagaacaaaaucgaauggg

SEQ ID NO: 59833 - RNA, 23 nt, Artificial Sequence
  RNA Oligomer
cagugcagaacaaaaucgaaugg

SEQ ID NO: 59834 - RNA, 23 nt, Artificial Sequence
  RNA Oligomer
caagggcguuaaggaucggguua

SEQ ID NO: 59835 - RNA, 23 nt, Artificial Sequence
  RNA Oligomer
gaacucuucuauguuuucuucaa

SEQ ID NO: 59836 - RNA, 23 nt, Artificial Sequence
  RNA Oligomer
ugaacucuucuauguuuucuuca

SEQ ID NO: 59837 - RNA, 23 nt, Artificial Sequence
  RNA Oligomer
uugaacucuucuauguuuucuuc

SEQ ID NO: 59838 - RNA, 23 nt, Artificial Sequence
  RNA Oligomer
auugaacucuucuauguuuucuu

SEQ ID NO: 59839 - RNA, 23 nt, Artificial Sequence
  RNA Oligomer
ccuuuucauuuuacuucauccuc

SEQ ID NO: 59840 - RNA, 23 nt, Artificial Sequence
  RNA Oligomer
gcacuugaagcagauugagauaa

SEQ ID NO: 59841 - RNA, 23 nt, Artificial Sequence
  RNA Oligomer
acaaaaaagcuuuuacgagguau

SEQ ID NO: 59842 - RNA, 23 nt, Artificial Sequence
  RNA Oligomer
gaaagugcaccagguguuaauuu

SEQ ID NO: 59843 - RNA, 23 nt, Artificial Sequence
  RNA Oligomer
ccaguuucuccaaaugccuuuuu

SEQ ID NO: 59844 - RNA, 23 nt, Artificial Sequence
  RNA Oligomer
gcagauacaguauaaacucacaa

SEQ ID NO: 59845 - RNA, 23 nt, Artificial Sequence
  RNA Oligomer
gcaguaacugguauucuuggguu

SEQ ID NO: 59846 - RNA, 23 nt, Artificial Sequence
  RNA Oligomer
caaaaaagcuuuuacgagguauc

SEQ ID NO: 59847 - RNA, 23 nt, Artificial Sequence
  RNA Oligomer
gcagauugagauaaagaaguuca

SEQ ID NO: 59848 - RNA, 23 nt, Artificial Sequence
  RNA Oligomer
agacaucuaccaguuucuccaaa

SEQ ID NO: 59849 - RNA, 23 nt, Artificial Sequence
  RNA Oligomer
uguaaacaggcuuuagucauuaa

SEQ ID NO: 59850 - RNA, 23 nt, Artificial Sequence
  RNA Oligomer
ccagugguacaucuauggauuca

SEQ ID NO: 59851 - RNA, 23 nt, Artificial Sequence
  RNA Oligomer
agauaaagaaguucaaguacggu

SEQ ID NO: 59852 - RNA, 23 nt, Artificial Sequence
  RNA Oligomer
gacacuuuucuucuugcaugcau

SEQ ID NO: 59853 - RNA, 23 nt, Artificial Sequence
  RNA Oligomer
gaagguguggcugucaguacuuu

SEQ ID NO: 59854 - RNA, 23 nt, Artificial Sequence
  RNA Oligomer
ggaagguguggcugucaguacuu

SEQ ID NO: 59855 - RNA, 23 nt, Artificial Sequence
  RNA Oligomer
aacuuugauguuugcacuaagau

SEQ ID NO: 59856 - RNA, 23 nt, Artificial Sequence
  RNA Oligomer
acuuauaugugugucgaagaguu

SEQ ID NO: 59857 - RNA, 23 nt, Artificial Sequence
  RNA Oligomer
acuuuuucaucauuccucagcua

SEQ ID NO: 59858 - RNA, 23 nt, Artificial Sequence
  RNA Oligomer
ccacuugcacaauaucauuacca

SEQ ID NO: 59859 - RNA, 23 nt, Artificial Sequence
  RNA Oligomer
ucaacaagaaaaagacagaggau

SEQ ID NO: 59860 - RNA, 23 nt, Artificial Sequence
  RNA Oligomer
ugauacauagauaagggcuuuuu

SEQ ID NO: 59861 - RNA, 23 nt, Artificial Sequence
  RNA Oligomer
aaacuagcugcuggacaugaauu

SEQ ID NO: 59862 - RNA, 23 nt, Artificial Sequence
  RNA Oligomer
ccaucucuaacucccaugcacag

SEQ ID NO: 59863 - RNA, 23 nt, Artificial Sequence
  RNA Oligomer
ugguacaucuauggauucagcuu

SEQ ID NO: 59864 - RNA, 23 nt, Artificial Sequence
  RNA Oligomer
gauaaagaaguucaaguacggua

SEQ ID NO: 59865 - RNA, 23 nt, Artificial Sequence
  RNA Oligomer
cagauugagauaaagaaguucaa

SEQ ID NO: 59866 - RNA, 23 nt, Artificial Sequence
  RNA Oligomer
agaaacugaacaagaaagaggaa

SEQ ID NO: 59867 - RNA, 23 nt, Artificial Sequence
  RNA Oligomer
guguucuggagaguguucuuuau

SEQ ID NO: 59868 - RNA, 23 nt, Artificial Sequence
  RNA Oligomer
guauucuuggguuuuccuacuua

SEQ ID NO: 59869 - RNA, 23 nt, Artificial Sequence
  RNA Oligomer
cagauacaguauaaacucacaaa

SEQ ID NO: 59870 - RNA, 23 nt, Artificial Sequence
  RNA Oligomer
acauuuuuaagacaguugggaug

SEQ ID NO: 59871 - RNA, 23 nt, Artificial Sequence
  RNA Oligomer
caacaagaaaaagacagaggauu

SEQ ID NO: 59872 - RNA, 23 nt, Artificial Sequence
  RNA Oligomer
gugauacauagauaagggcuuuu

SEQ ID NO: 59873 - RNA, 23 nt, Artificial Sequence
  RNA Oligomer
uucaugaggcuuagaaaacacaa

SEQ ID NO: 59874 - RNA, 23 nt, Artificial Sequence
  RNA Oligomer
cagguguuaauuuugauccggug

SEQ ID NO: 59875 - RNA, 23 nt, Artificial Sequence
  RNA Oligomer
cuagcugcuggacaugaauuaca

SEQ ID NO: 59876 - RNA, 23 nt, Artificial Sequence
  RNA Oligomer
acaucuauggauucagcuugagu

SEQ ID NO: 59877 - RNA, 23 nt, Artificial Sequence
  RNA Oligomer
ucauguguucuaugugaugcgaa

SEQ ID NO: 59878 - RNA, 23 nt, Artificial Sequence
  RNA Oligomer
caaccugguugugaaaaugucug

SEQ ID NO: 59879 - RNA, 23 nt, Artificial Sequence
  RNA Oligomer
cacuuuucuucuugcaugcaugu

SEQ ID NO: 59880 - RNA, 23 nt, Artificial Sequence
  RNA Oligomer
cugaguaugacacuuuucuucuu

SEQ ID NO: 59881 - RNA, 23 nt, Artificial Sequence
  RNA Oligomer
caguuucuccaaaugccuuuuuu

SEQ ID NO: 59882 - RNA, 23 nt, Artificial Sequence
  RNA Oligomer
caguaacugguauucuuggguuu

SEQ ID NO: 59883 - RNA, 23 nt, Artificial Sequence
  RNA Oligomer
gaaaaaaugcuuagaguggacua

SEQ ID NO: 59884 - RNA, 23 nt, Artificial Sequence
  RNA Oligomer
ugguaucaguuuaaaauucagac

SEQ ID NO: 59885 - RNA, 23 nt, Artificial Sequence
  RNA Oligomer
ggauuguccuuaagucccugcua

SEQ ID NO: 59886 - RNA, 23 nt, Artificial Sequence
  RNA Oligomer
ccuaagaaugguucuguguaugu

SEQ ID NO: 59887 - RNA, 23 nt, Artificial Sequence
  RNA Oligomer
agagaggugcauguugguauuua

SEQ ID NO: 59888 - RNA, 23 nt, Artificial Sequence
  RNA Oligomer
ucugccuuucguuguaacacuca

SEQ ID NO: 59889 - RNA, 23 nt, Artificial Sequence
  RNA Oligomer
ugacacuuuucuucuugcaugca

SEQ ID NO: 59890 - RNA, 23 nt, Artificial Sequence
  RNA Oligomer
guaugacacuuuucuucuugcau

SEQ ID NO: 59891 - RNA, 23 nt, Artificial Sequence
  RNA Oligomer
cagaagauuggugaaaaugcuga

SEQ ID NO: 59892 - RNA, 23 nt, Artificial Sequence
  RNA Oligomer
gcaagagagguugaaagaggauu

SEQ ID NO: 59893 - RNA, 23 nt, Artificial Sequence
  RNA Oligomer
gacuuagaaaaaaugcuuagagu

SEQ ID NO: 59894 - RNA, 23 nt, Artificial Sequence
  RNA Oligomer
agacuuagaaaaaaugcuuagag

SEQ ID NO: 59895 - RNA, 23 nt, Artificial Sequence
  RNA Oligomer
agagacuuagaaaaaaugcuuag

SEQ ID NO: 59896 - RNA, 23 nt, Artificial Sequence
  RNA Oligomer
ggcuuuagucauuaaugugagag

SEQ ID NO: 59897 - RNA, 23 nt, Artificial Sequence
  RNA Oligomer
guauaaacucacaaacacagauu

SEQ ID NO: 59898 - RNA, 23 nt, Artificial Sequence
  RNA Oligomer
cuuauaugugugucgaagaguuu

SEQ ID NO: 59899 - RNA, 23 nt, Artificial Sequence
  RNA Oligomer
cuuuuucaucauuccucagcuac

SEQ ID NO: 59900 - RNA, 23 nt, Artificial Sequence
  RNA Oligomer
cauccacuugcacaauaucauua

SEQ ID NO: 59901 - RNA, 23 nt, Artificial Sequence
  RNA Oligomer
aaaauuugcacuuugaagguaag

SEQ ID NO: 59902 - RNA, 23 nt, Artificial Sequence
  RNA Oligomer
acaagaaaaagacagaggauugu

SEQ ID NO: 59903 - RNA, 23 nt, Artificial Sequence
  RNA Oligomer
aggugauacauagauaagggcuu

SEQ ID NO: 59904 - RNA, 23 nt, Artificial Sequence
  RNA Oligomer
cuuuuacgagguaucagcacuuu

SEQ ID NO: 59905 - RNA, 23 nt, Artificial Sequence
  RNA Oligomer
cuaaaaaacuagcugcuggacau

SEQ ID NO: 59906 - RNA, 23 nt, Artificial Sequence
  RNA Oligomer
gaacuugccuuuucauuuuacuu

SEQ ID NO: 59907 - RNA, 23 nt, Artificial Sequence
  RNA Oligomer
ggucucaaaaauaugcuuauuuc

SEQ ID NO: 59908 - RNA, 23 nt, Artificial Sequence
  RNA Oligomer
gugguacaucuauggauucagcu

SEQ ID NO: 59909 - RNA, 23 nt, Artificial Sequence
  RNA Oligomer
gccuucuugcugauccaguggua

SEQ ID NO: 59910 - RNA, 23 nt, Artificial Sequence
  RNA Oligomer
acaucaucaguauccucuucaag

SEQ ID NO: 59911 - RNA, 23 nt, Artificial Sequence
  RNA Oligomer
uacaucaucaguauccucuucaa

SEQ ID NO: 59912 - RNA, 23 nt, Artificial Sequence
  RNA Oligomer
ugagauaaagaaguucaaguacg

SEQ ID NO: 59913 - RNA, 23 nt, Artificial Sequence
  RNA Oligomer
agaacucaagguugcccaaacug

SEQ ID NO: 59914 - RNA, 23 nt, Artificial Sequence
  RNA Oligomer
gguccugcagaucauauuugugu

SEQ ID NO: 59915 - RNA, 23 nt, Artificial Sequence
  RNA Oligomer
cugcuaugacaagucuuucccaa

SEQ ID NO: 59916 - RNA, 23 nt, Artificial Sequence
  RNA Oligomer
agaucauguguucuggagagugu

SEQ ID NO: 59917 - RNA, 23 nt, Artificial Sequence
  RNA Oligomer
cuaccaguuucuccaaaugccuu

SEQ ID NO: 59918 - RNA, 23 nt, Artificial Sequence
  RNA Oligomer
gacaucuaccaguuucuccaaau

SEQ ID NO: 59919 - RNA, 23 nt, Artificial Sequence
  RNA Oligomer
agaaaaaaugcuuagaguggacu

SEQ ID NO: 59920 - RNA, 23 nt, Artificial Sequence
  RNA Oligomer
ucacuuuuucaucauuccucagc

SEQ ID NO: 59921 - RNA, 23 nt, Artificial Sequence
  RNA Oligomer
uaaauacuuccugaacaucuuag

SEQ ID NO: 59922 - RNA, 23 nt, Artificial Sequence
  RNA Oligomer
gaaauaauucuggccaggaauaa

SEQ ID NO: 59923 - RNA, 23 nt, Artificial Sequence
  RNA Oligomer
guaugugaaugagcgggugguaa

SEQ ID NO: 59924 - RNA, 23 nt, Artificial Sequence
  RNA Oligomer
agaaugguucuguguaugugaau

SEQ ID NO: 59925 - RNA, 23 nt, Artificial Sequence
  RNA Oligomer
agaguuccauuaggugauacaua

SEQ ID NO: 59926 - RNA, 23 nt, Artificial Sequence
  RNA Oligomer
cuucauccuccaaggaguucaau

SEQ ID NO: 59927 - RNA, 23 nt, Artificial Sequence
  RNA Oligomer
cauuguggaccagcgaccuucaa

SEQ ID NO: 59928 - RNA, 23 nt, Artificial Sequence
  RNA Oligomer
ucaagggcguuaaggaucggguu

SEQ ID NO: 59929 - RNA, 23 nt, Artificial Sequence
  RNA Oligomer
guauccucuucaagucuaucuuu

SEQ ID NO: 59930 - RNA, 23 nt, Artificial Sequence
  RNA Oligomer
caucaguauccucuucaagucua

SEQ ID NO: 59931 - RNA, 23 nt, Artificial Sequence
  RNA Oligomer
agauugagauaaagaaguucaag

SEQ ID NO: 59932 - RNA, 23 nt, Artificial Sequence
  RNA Oligomer
uguucuaugugaugcgaaaggaa

SEQ ID NO: 59933 - RNA, 23 nt, Artificial Sequence
  RNA Oligomer
cauguguucuaugugaugcgaaa

SEQ ID NO: 59934 - RNA, 23 nt, Artificial Sequence
  RNA Oligomer
gaagauuggugaaaaugcugagu

SEQ ID NO: 59935 - RNA, 23 nt, Artificial Sequence
  RNA Oligomer
agguguggcugucaguacuuuuc

SEQ ID NO: 59936 - RNA, 23 nt, Artificial Sequence
  RNA Oligomer
gguauucuuggguuuuccuacuu

SEQ ID NO: 59937 - RNA, 23 nt, Artificial Sequence
  RNA Oligomer
guaacugguauucuuggguuuuc

SEQ ID NO: 59938 - RNA, 23 nt, Artificial Sequence
  RNA Oligomer
aguaacugguauucuuggguuuu

SEQ ID NO: 59939 - RNA, 23 nt, Artificial Sequence
  RNA Oligomer
cuauuuaaaguuuaaaacuccgc

SEQ ID NO: 59940 - RNA, 23 nt, Artificial Sequence
  RNA Oligomer
uauuuaaaguuuaaaacuccgcu

SEQ ID NO: 59941 - RNA, 23 nt, Artificial Sequence
  RNA Oligomer
auuuaaaguuuaaaacuccgcug

SEQ ID NO: 59942 - RNA, 23 nt, Artificial Sequence
  RNA Oligomer
uuuaaaguuuaaaacuccgcugc

SEQ ID NO: 59943 - RNA, 23 nt, Artificial Sequence
  RNA Oligomer
uuaaaguuuaaaacuccgcugcu

SEQ ID NO: 59944 - RNA, 23 nt, Artificial Sequence
  RNA Oligomer
uacaaaacuguuuauguagcuga

SEQ ID NO: 59945 - RNA, 23 nt, Artificial Sequence
  RNA Oligomer
acaaaacuguuuauguagcugac

SEQ ID NO: 59946 - RNA, 23 nt, Artificial Sequence
  RNA Oligomer
caaaacuguuuauguagcugaca

SEQ ID NO: 59947 - RNA, 23 nt, Artificial Sequence
  RNA Oligomer
aaaacuguuuauguagcugacau

SEQ ID NO: 59948 - RNA, 23 nt, Artificial Sequence
  RNA Oligomer
aaacuguuuauguagcugacaug

SEQ ID NO: 59949 - RNA, 23 nt, Artificial Sequence
  RNA Oligomer
cacuuucuacagcaccuuuuuuc

SEQ ID NO: 59950 - RNA, 23 nt, Artificial Sequence
  RNA Oligomer
acuuucuacagcaccuuuuuucu

SEQ ID NO: 59951 - RNA, 23 nt, Artificial Sequence
  RNA Oligomer
cuuucuacagcaccuuuuuucuu

SEQ ID NO: 59952 - RNA, 23 nt, Artificial Sequence
  RNA Oligomer
uuucuacagcaccuuuuuucuuc

SEQ ID NO: 59953 - RNA, 23 nt, Artificial Sequence
  RNA Oligomer
uucuacagcaccuuuuuucuucu

SEQ ID NO: 59954 - RNA, 23 nt, Artificial Sequence
  RNA Oligomer
acaaaaauccaugagaaagguuc

SEQ ID NO: 59955 - RNA, 23 nt, Artificial Sequence
  RNA Oligomer
caaaaauccaugagaaagguuca

SEQ ID NO: 59956 - RNA, 23 nt, Artificial Sequence
  RNA Oligomer
aaaaauccaugagaaagguucaa

SEQ ID NO: 59957 - RNA, 23 nt, Artificial Sequence
  RNA Oligomer
aaaauccaugagaaagguucaaa

SEQ ID NO: 59958 - RNA, 23 nt, Artificial Sequence
  RNA Oligomer
aaauccaugagaaagguucaaau

SEQ ID NO: 59959 - RNA, 23 nt, Artificial Sequence
  RNA Oligomer
ucuacagcaccuuuuuucuucuc

SEQ ID NO: 59960 - RNA, 23 nt, Artificial Sequence
  RNA Oligomer
uacagcaccuuuuuucuucucca

SEQ ID NO: 59961 - RNA, 23 nt, Artificial Sequence
  RNA Oligomer
aggaugaaguaaaaugaaaaggc

SEQ ID NO: 59962 - RNA, 23 nt, Artificial Sequence
  RNA Oligomer
ggaugaaguaaaaugaaaaggca

SEQ ID NO: 59963 - RNA, 23 nt, Artificial Sequence
  RNA Oligomer
gaugaaguaaaaugaaaaggcaa

SEQ ID NO: 59964 - RNA, 23 nt, Artificial Sequence
  RNA Oligomer
augaaguaaaaugaaaaggcaag

SEQ ID NO: 59965 - RNA, 23 nt, Artificial Sequence
  RNA Oligomer
ugaaguaaaaugaaaaggcaagu

SEQ ID NO: 59966 - RNA, 23 nt, Artificial Sequence
  RNA Oligomer
guacaaaacuguuuauguagcug

SEQ ID NO: 59967 - RNA, 23 nt, Artificial Sequence
  RNA Oligomer
aacuguuuauguagcugacaugc

SEQ ID NO: 59968 - RNA, 23 nt, Artificial Sequence
  RNA Oligomer
ccacaaaaauccaugagaaaggu

SEQ ID NO: 59969 - RNA, 23 nt, Artificial Sequence
  RNA Oligomer
cacaaaaauccaugagaaagguu

SEQ ID NO: 59970 - RNA, 23 nt, Artificial Sequence
  RNA Oligomer
uauaaucuaaguucuuugaaucc

SEQ ID NO: 59971 - RNA, 23 nt, Artificial Sequence
  RNA Oligomer
auaaucuaaguucuuugaaucca

SEQ ID NO: 59972 - RNA, 23 nt, Artificial Sequence
  RNA Oligomer
uaaucuaaguucuuugaauccac

SEQ ID NO: 59973 - RNA, 23 nt, Artificial Sequence
  RNA Oligomer
aaucuaaguucuuugaauccacu

SEQ ID NO: 59974 - RNA, 23 nt, Artificial Sequence
  RNA Oligomer
aucuaaguucuuugaauccacua

SEQ ID NO: 59975 - RNA, 23 nt, Artificial Sequence
  RNA Oligomer
accuuuuuucuucuccacaauug

SEQ ID NO: 59976 - RNA, 23 nt, Artificial Sequence
  RNA Oligomer
ccuuuuuucuucuccacaauuga

SEQ ID NO: 59977 - RNA, 23 nt, Artificial Sequence
  RNA Oligomer
cuuuuuucuucuccacaauugag

SEQ ID NO: 59978 - RNA, 23 nt, Artificial Sequence
  RNA Oligomer
uuuuuucuucuccacaauugagu

SEQ ID NO: 59979 - RNA, 23 nt, Artificial Sequence
  RNA Oligomer
uuuuucuucuccacaauugagug

SEQ ID NO: 59980 - RNA, 23 nt, Artificial Sequence
  RNA Oligomer
uuucaagccuguaucuagaucuc

SEQ ID NO: 59981 - RNA, 23 nt, Artificial Sequence
  RNA Oligomer
uucaagccuguaucuagaucucc

SEQ ID NO: 59982 - RNA, 23 nt, Artificial Sequence
  RNA Oligomer
ucaagccuguaucuagaucucca

SEQ ID NO: 59983 - RNA, 23 nt, Artificial Sequence
  RNA Oligomer
caagccuguaucuagaucuccag

SEQ ID NO: 59984 - RNA, 23 nt, Artificial Sequence
  RNA Oligomer
aagccuguaucuagaucuccagg

SEQ ID NO: 59985 - RNA, 23 nt, Artificial Sequence
  RNA Oligomer
uaaaguuuaaaacuccgcugcug

SEQ ID NO: 59986 - RNA, 23 nt, Artificial Sequence
  RNA Oligomer
aaaguuuaaaacuccgcugcugu

SEQ ID NO: 59987 - RNA, 23 nt, Artificial Sequence
  RNA Oligomer
aaguuuaaaacuccgcugcuguu

SEQ ID NO: 59988 - RNA, 23 nt, Artificial Sequence
  RNA Oligomer
aggauacugaugauguagguucg

SEQ ID NO: 59989 - RNA, 23 nt, Artificial Sequence
  RNA Oligomer
ggauacugaugauguagguucgc

SEQ ID NO: 59990 - RNA, 23 nt, Artificial Sequence
  RNA Oligomer
gauacugaugauguagguucgca

SEQ ID NO: 59991 - RNA, 23 nt, Artificial Sequence
  RNA Oligomer
auacugaugauguagguucgcag

SEQ ID NO: 59992 - RNA, 23 nt, Artificial Sequence
  RNA Oligomer
uacugaugauguagguucgcagc

SEQ ID NO: 59993 - RNA, 23 nt, Artificial Sequence
  RNA Oligomer
agugcaaacaucaaaguugcugg

SEQ ID NO: 59994 - RNA, 23 nt, Artificial Sequence
  RNA Oligomer
gugcaaacaucaaaguugcuggu

SEQ ID NO: 59995 - RNA, 23 nt, Artificial Sequence
  RNA Oligomer
ugcaaacaucaaaguugcugguc

SEQ ID NO: 59996 - RNA, 23 nt, Artificial Sequence
  RNA Oligomer
gcaaacaucaaaguugcugguca

SEQ ID NO: 59997 - RNA, 23 nt, Artificial Sequence
  RNA Oligomer
caaacaucaaaguugcuggucac

SEQ ID NO: 59998 - RNA, 23 nt, Artificial Sequence
  RNA Oligomer
gaggaaugaugaaaaagugaugg

SEQ ID NO: 59999 - RNA, 23 nt, Artificial Sequence
  RNA Oligomer
aggaaugaugaaaaagugauggu

SEQ ID NO: 60000 - RNA, 23 nt, Artificial Sequence
  RNA Oligomer
ggaaugaugaaaaagugauggua

SEQ ID NO: 60001 - RNA, 23 nt, Artificial Sequence
  RNA Oligomer
gaaugaugaaaaagugaugguaa

SEQ ID NO: 60002 - RNA, 23 nt, Artificial Sequence
  RNA Oligomer
aaugaugaaaaagugaugguaau

SEQ ID NO: 60003 - RNA, 23 nt, Artificial Sequence
  RNA Oligomer
aaugauauugugcaaguggaugg

SEQ ID NO: 60004 - RNA, 23 nt, Artificial Sequence
  RNA Oligomer
augauauugugcaaguggaugga

SEQ ID NO: 60005 - RNA, 23 nt, Artificial Sequence
  RNA Oligomer
ugauauugugcaaguggauggaa

SEQ ID NO: 60006 - RNA, 23 nt, Artificial Sequence
  RNA Oligomer
gauauugugcaaguggauggaaa

SEQ ID NO: 60007 - RNA, 23 nt, Artificial Sequence
  RNA Oligomer
auauugugcaaguggauggaaaa

SEQ ID NO: 60008 - RNA, 23 nt, Artificial Sequence
  RNA Oligomer
aaaaaauauaguagcacaagucc

SEQ ID NO: 60009 - RNA, 23 nt, Artificial Sequence
  RNA Oligomer
aaaaauauaguagcacaagucca

SEQ ID NO: 60010 - RNA, 23 nt, Artificial Sequence
  RNA Oligomer
aaaauauaguagcacaaguccau

SEQ ID NO: 60011 - RNA, 23 nt, Artificial Sequence
  RNA Oligomer
aaauauaguagcacaaguccauu

SEQ ID NO: 60012 - RNA, 23 nt, Artificial Sequence
  RNA Oligomer
aauauaguagcacaaguccauug

SEQ ID NO: 60013 - RNA, 23 nt, Artificial Sequence
  RNA Oligomer
auccauaauaggauacacaggga

SEQ ID NO: 60014 - RNA, 23 nt, Artificial Sequence
  RNA Oligomer
uccauaauaggauacacagggaa

SEQ ID NO: 60015 - RNA, 23 nt, Artificial Sequence
  RNA Oligomer
ccauaauaggauacacagggaaa

SEQ ID NO: 60016 - RNA, 23 nt, Artificial Sequence
  RNA Oligomer
cauaauaggauacacagggaaaa

SEQ ID NO: 60017 - RNA, 23 nt, Artificial Sequence
  RNA Oligomer
auaauaggauacacagggaaaaa

SEQ ID NO: 60018 - RNA, 23 nt, Artificial Sequence
  RNA Oligomer
auauaauguaaacaccauauugg

SEQ ID NO: 60019 - RNA, 23 nt, Artificial Sequence
  RNA Oligomer
uauaauguaaacaccauauuggc

SEQ ID NO: 60020 - RNA, 23 nt, Artificial Sequence
  RNA Oligomer
auaauguaaacaccauauuggcc

SEQ ID NO: 60021 - RNA, 23 nt, Artificial Sequence
  RNA Oligomer
uaauguaaacaccauauuggccc

SEQ ID NO: 60022 - RNA, 23 nt, Artificial Sequence
  RNA Oligomer
aauguaaacaccauauuggccca

SEQ ID NO: 60023 - RNA, 23 nt, Artificial Sequence
  RNA Oligomer
uuaaaugaaugugaguaguagcu

SEQ ID NO: 60024 - RNA, 23 nt, Artificial Sequence
  RNA Oligomer
uaaaugaaugugaguaguagcug

SEQ ID NO: 60025 - RNA, 23 nt, Artificial Sequence
  RNA Oligomer
aaaugaaugugaguaguagcuga

SEQ ID NO: 60026 - RNA, 23 nt, Artificial Sequence
  RNA Oligomer
aaugaaugugaguaguagcugag

SEQ ID NO: 60027 - RNA, 23 nt, Artificial Sequence
  RNA Oligomer
augaaugugaguaguagcugagg

SEQ ID NO: 60028 - RNA, 23 nt, Artificial Sequence
  RNA Oligomer
aaaaaaauauaguagcacaaguc

SEQ ID NO: 60029 - RNA, 23 nt, Artificial Sequence
  RNA Oligomer
aaugucuuuguguuuucuaagcc

SEQ ID NO: 60030 - RNA, 23 nt, Artificial Sequence
  RNA Oligomer
augucuuuguguuuucuaagccu

SEQ ID NO: 60031 - RNA, 23 nt, Artificial Sequence
  RNA Oligomer
ugucuuuguguuuucuaagccuc

SEQ ID NO: 60032 - RNA, 23 nt, Artificial Sequence
  RNA Oligomer
gucuuuguguuuucuaagccuca

SEQ ID NO: 60033 - RNA, 23 nt, Artificial Sequence
  RNA Oligomer
ucuuuguguuuucuaagccucau

SEQ ID NO: 60034 - RNA, 23 nt, Artificial Sequence
  RNA Oligomer
cuuucaagccuguaucuagaucu

SEQ ID NO: 60035 - RNA, 23 nt, Artificial Sequence
  RNA Oligomer
uuuguucugcacuguaauuagcc

SEQ ID NO: 60036 - RNA, 23 nt, Artificial Sequence
  RNA Oligomer
uuguucugcacuguaauuagccc

SEQ ID NO: 60037 - RNA, 23 nt, Artificial Sequence
  RNA Oligomer
uguucugcacuguaauuagccca

SEQ ID NO: 60038 - RNA, 23 nt, Artificial Sequence
  RNA Oligomer
guucugcacuguaauuagcccag

SEQ ID NO: 60039 - RNA, 23 nt, Artificial Sequence
  RNA Oligomer
uucugcacuguaauuagcccagu

SEQ ID NO: 60040 - RNA, 23 nt, Artificial Sequence
  RNA Oligomer
cccuaaugaaagaaaagugcuga

SEQ ID NO: 60041 - RNA, 23 nt, Artificial Sequence
  RNA Oligomer
ccuaaugaaagaaaagugcugau

SEQ ID NO: 60042 - RNA, 23 nt, Artificial Sequence
  RNA Oligomer
cuaaugaaagaaaagugcugaua

SEQ ID NO: 60043 - RNA, 23 nt, Artificial Sequence
  RNA Oligomer
uaaugaaagaaaagugcugauac

SEQ ID NO: 60044 - RNA, 23 nt, Artificial Sequence
  RNA Oligomer
aaugaaagaaaagugcugauacc

SEQ ID NO: 60045 - RNA, 23 nt, Artificial Sequence
  RNA Oligomer
aaacaucaaaguugcuggucacu

SEQ ID NO: 60046 - RNA, 23 nt, Artificial Sequence
  RNA Oligomer
cauaauuaacaaaaccaguaucc

SEQ ID NO: 60047 - RNA, 23 nt, Artificial Sequence
  RNA Oligomer
auaauuaacaaaaccaguaucca

SEQ ID NO: 60048 - RNA, 23 nt, Artificial Sequence
  RNA Oligomer
uaauuaacaaaaccaguauccau

SEQ ID NO: 60049 - RNA, 23 nt, Artificial Sequence
  RNA Oligomer
aauuaacaaaaccaguauccaua

SEQ ID NO: 60050 - RNA, 23 nt, Artificial Sequence
  RNA Oligomer
auuaacaaaaccaguauccauaa

SEQ ID NO: 60051 - RNA, 23 nt, Artificial Sequence
  RNA Oligomer
uauccauaauaggauacacaggg

SEQ ID NO: 60052 - RNA, 23 nt, Artificial Sequence
  RNA Oligomer
auacacagggaaaaacauuuuag

SEQ ID NO: 60053 - RNA, 23 nt, Artificial Sequence
  RNA Oligomer
uacacagggaaaaacauuuuagg

SEQ ID NO: 60054 - RNA, 23 nt, Artificial Sequence
  RNA Oligomer
acacagggaaaaacauuuuagga

SEQ ID NO: 60055 - RNA, 23 nt, Artificial Sequence
  RNA Oligomer
cacagggaaaaacauuuuaggag

SEQ ID NO: 60056 - RNA, 23 nt, Artificial Sequence
  RNA Oligomer
acagggaaaaacauuuuaggaga

SEQ ID NO: 60057 - RNA, 23 nt, Artificial Sequence
  RNA Oligomer
accacaaaaauccaugagaaagg

SEQ ID NO: 60058 - RNA, 23 nt, Artificial Sequence
  RNA Oligomer
auggaaaaucuuauucugugggc

SEQ ID NO: 60059 - RNA, 23 nt, Artificial Sequence
  RNA Oligomer
uggaaaaucuuauucugugggcc

SEQ ID NO: 60060 - RNA, 23 nt, Artificial Sequence
  RNA Oligomer
ggaaaaucuuauucugugggccu

SEQ ID NO: 60061 - RNA, 23 nt, Artificial Sequence
  RNA Oligomer
gaaaaucuuauucugugggccuu

SEQ ID NO: 60062 - RNA, 23 nt, Artificial Sequence
  RNA Oligomer
aaaaucuuauucugugggccuug

SEQ ID NO: 60063 - RNA, 23 nt, Artificial Sequence
  RNA Oligomer
guugaaaagaccuaagauguuca

SEQ ID NO: 60064 - RNA, 23 nt, Artificial Sequence
  RNA Oligomer
uugaaaagaccuaagauguucag

SEQ ID NO: 60065 - RNA, 23 nt, Artificial Sequence
  RNA Oligomer
ugaaaagaccuaagauguucagg

SEQ ID NO: 60066 - RNA, 23 nt, Artificial Sequence
  RNA Oligomer
gaaaagaccuaagauguucagga

SEQ ID NO: 60067 - RNA, 23 nt, Artificial Sequence
  RNA Oligomer
aaaagaccuaagauguucaggaa

SEQ ID NO: 60068 - RNA, 23 nt, Artificial Sequence
  RNA Oligomer
aaaauauuuagccacaauuacca

SEQ ID NO: 60069 - RNA, 23 nt, Artificial Sequence
  RNA Oligomer
aaauauuuagccacaauuaccac

SEQ ID NO: 60070 - RNA, 23 nt, Artificial Sequence
  RNA Oligomer
aauauuuagccacaauuaccacc

SEQ ID NO: 60071 - RNA, 23 nt, Artificial Sequence
  RNA Oligomer
auauuuagccacaauuaccaccc

SEQ ID NO: 60072 - RNA, 23 nt, Artificial Sequence
  RNA Oligomer
uauuuagccacaauuaccacccg

SEQ ID NO: 60073 - RNA, 23 nt, Artificial Sequence
  RNA Oligomer
acagcaccuuuuuucuucuccac

SEQ ID NO: 60074 - RNA, 23 nt, Artificial Sequence
  RNA Oligomer
cagcaccuuuuuucuucuccaca

SEQ ID NO: 60075 - RNA, 23 nt, Artificial Sequence
  RNA Oligomer
agcaccuuuuuucuucuccacaa

SEQ ID NO: 60076 - RNA, 23 nt, Artificial Sequence
  RNA Oligomer
augcuuucaagccuguaucuaga

SEQ ID NO: 60077 - RNA, 23 nt, Artificial Sequence
  RNA Oligomer
ugcuuucaagccuguaucuagau

SEQ ID NO: 60078 - RNA, 23 nt, Artificial Sequence
  RNA Oligomer
gcuuucaagccuguaucuagauc

SEQ ID NO: 60079 - RNA, 23 nt, Artificial Sequence
  RNA Oligomer
agccuguaucuagaucuccaggu

SEQ ID NO: 60080 - RNA, 23 nt, Artificial Sequence
  RNA Oligomer
ccuuggaggaugaaguaaaauga

SEQ ID NO: 60081 - RNA, 23 nt, Artificial Sequence
  RNA Oligomer
cuuggaggaugaaguaaaaugaa

SEQ ID NO: 60082 - RNA, 23 nt, Artificial Sequence
  RNA Oligomer
uuggaggaugaaguaaaaugaaa

SEQ ID NO: 60083 - RNA, 23 nt, Artificial Sequence
  RNA Oligomer
uggaggaugaaguaaaaugaaaa

SEQ ID NO: 60084 - RNA, 23 nt, Artificial Sequence
  RNA Oligomer
ggaggaugaaguaaaaugaaaag

SEQ ID NO: 60085 - RNA, 23 nt, Artificial Sequence
  RNA Oligomer
ucugcacuguaauuagcccaguu

SEQ ID NO: 60086 - RNA, 23 nt, Artificial Sequence
  RNA Oligomer
uguaauugcggcaagaagaauug

SEQ ID NO: 60087 - RNA, 23 nt, Artificial Sequence
  RNA Oligomer
guaauugcggcaagaagaauugu

SEQ ID NO: 60088 - RNA, 23 nt, Artificial Sequence
  RNA Oligomer
uaauugcggcaagaagaauuguu

SEQ ID NO: 60089 - RNA, 23 nt, Artificial Sequence
  RNA Oligomer
aauugcggcaagaagaauuguuu

SEQ ID NO: 60090 - RNA, 23 nt, Artificial Sequence
  RNA Oligomer
auugcggcaagaagaauuguuuc

SEQ ID NO: 60091 - RNA, 23 nt, Artificial Sequence
  RNA Oligomer
ucccuuaacccgauccuuaacgc

SEQ ID NO: 60092 - RNA, 23 nt, Artificial Sequence
  RNA Oligomer
cccuuaacccgauccuuaacgcc

SEQ ID NO: 60093 - RNA, 23 nt, Artificial Sequence
  RNA Oligomer
ccuuaacccgauccuuaacgccc

SEQ ID NO: 60094 - RNA, 23 nt, Artificial Sequence
  RNA Oligomer
cuuaacccgauccuuaacgcccu

SEQ ID NO: 60095 - RNA, 23 nt, Artificial Sequence
  RNA Oligomer
uuaacccgauccuuaacgcccuu

SEQ ID NO: 60096 - RNA, 23 nt, Artificial Sequence
  RNA Oligomer
uucaaugauauucaaggccaggg

SEQ ID NO: 60097 - RNA, 23 nt, Artificial Sequence
  RNA Oligomer
ucaaugauauucaaggccaggga

SEQ ID NO: 60098 - RNA, 23 nt, Artificial Sequence
  RNA Oligomer
caaugauauucaaggccagggac

SEQ ID NO: 60099 - RNA, 23 nt, Artificial Sequence
  RNA Oligomer
aaugauauucaaggccagggaca

SEQ ID NO: 60100 - RNA, 23 nt, Artificial Sequence
  RNA Oligomer
augauauucaaggccagggacac

SEQ ID NO: 60101 - RNA, 23 nt, Artificial Sequence
  RNA Oligomer
cuucuuuaucucaaucugcuuca

SEQ ID NO: 60102 - RNA, 23 nt, Artificial Sequence
  RNA Oligomer
uucuuuaucucaaucugcuucaa

SEQ ID NO: 60103 - RNA, 23 nt, Artificial Sequence
  RNA Oligomer
ucuuuaucucaaucugcuucaag

SEQ ID NO: 60104 - RNA, 23 nt, Artificial Sequence
  RNA Oligomer
cuuuaucucaaucugcuucaagu

SEQ ID NO: 60105 - RNA, 23 nt, Artificial Sequence
  RNA Oligomer
uuuaucucaaucugcuucaagug

SEQ ID NO: 60106 - RNA, 23 nt, Artificial Sequence
  RNA Oligomer
uguacaaaacuguuuauguagcu

SEQ ID NO: 60107 - RNA, 23 nt, Artificial Sequence
  RNA Oligomer
agaugucuucaacauauaguuca

SEQ ID NO: 60108 - RNA, 23 nt, Artificial Sequence
  RNA Oligomer
gaugucuucaacauauaguucaa

SEQ ID NO: 60109 - RNA, 23 nt, Artificial Sequence
  RNA Oligomer
augucuucaacauauaguucaaa

SEQ ID NO: 60110 - RNA, 23 nt, Artificial Sequence
  RNA Oligomer
ugucuucaacauauaguucaaau

SEQ ID NO: 60111 - RNA, 23 nt, Artificial Sequence
  RNA Oligomer
gucuucaacauauaguucaaaua

SEQ ID NO: 60112 - RNA, 23 nt, Artificial Sequence
  RNA Oligomer
acaucaaaguugcuggucacucc

SEQ ID NO: 60113 - RNA, 23 nt, Artificial Sequence
  RNA Oligomer
caucaaaguugcuggucacucca

SEQ ID NO: 60114 - RNA, 23 nt, Artificial Sequence
  RNA Oligomer
aucaaaguugcuggucacuccaa

SEQ ID NO: 60115 - RNA, 23 nt, Artificial Sequence
  RNA Oligomer
ucaaaguugcuggucacuccaaa

SEQ ID NO: 60116 - RNA, 23 nt, Artificial Sequence
  RNA Oligomer
caaaguugcuggucacuccaaaa

SEQ ID NO: 60117 - RNA, 23 nt, Artificial Sequence
  RNA Oligomer
aacaaaaccaguauccauaauag

SEQ ID NO: 60118 - RNA, 23 nt, Artificial Sequence
  RNA Oligomer
acaaaaccaguauccauaauagg

SEQ ID NO: 60119 - RNA, 23 nt, Artificial Sequence
  RNA Oligomer
caaaaccaguauccauaauagga

SEQ ID NO: 60120 - RNA, 23 nt, Artificial Sequence
  RNA Oligomer
aaaaccaguauccauaauaggau

SEQ ID NO: 60121 - RNA, 23 nt, Artificial Sequence
  RNA Oligomer
aaaccaguauccauaauaggaua

SEQ ID NO: 60122 - RNA, 23 nt, Artificial Sequence
  RNA Oligomer
cagggaaaaacauuuuaggagaa

SEQ ID NO: 60123 - RNA, 23 nt, Artificial Sequence
  RNA Oligomer
cauuaaaugaaugugaguaguag

SEQ ID NO: 60124 - RNA, 23 nt, Artificial Sequence
  RNA Oligomer
auuaaaugaaugugaguaguagc

SEQ ID NO: 60125 - RNA, 23 nt, Artificial Sequence
  RNA Oligomer
ugugaguaguagcugaggaauga

SEQ ID NO: 60126 - RNA, 23 nt, Artificial Sequence
  RNA Oligomer
gugaguaguagcugaggaaugau

SEQ ID NO: 60127 - RNA, 23 nt, Artificial Sequence
  RNA Oligomer
ugaguaguagcugaggaaugaug

SEQ ID NO: 60128 - RNA, 23 nt, Artificial Sequence
  RNA Oligomer
gaguaguagcugaggaaugauga

SEQ ID NO: 60129 - RNA, 23 nt, Artificial Sequence
  RNA Oligomer
aguaguagcugaggaaugaugaa

SEQ ID NO: 60130 - RNA, 23 nt, Artificial Sequence
  RNA Oligomer
cuuguugaaaagaccuaagaugu

SEQ ID NO: 60131 - RNA, 23 nt, Artificial Sequence
  RNA Oligomer
uuguugaaaagaccuaagauguu

SEQ ID NO: 60132 - RNA, 23 nt, Artificial Sequence
  RNA Oligomer
aaagaccuaagauguucaggaag

SEQ ID NO: 60133 - RNA, 23 nt, Artificial Sequence
  RNA Oligomer
auuuagccacaauuaccacccgc

SEQ ID NO: 60134 - RNA, 23 nt, Artificial Sequence
  RNA Oligomer
uuuagccacaauuaccacccgcu

SEQ ID NO: 60135 - RNA, 23 nt, Artificial Sequence
  RNA Oligomer
uuagccacaauuaccacccgcuc

SEQ ID NO: 60136 - RNA, 23 nt, Artificial Sequence
  RNA Oligomer
uuuucuucuccacaauugagugg

SEQ ID NO: 60137 - RNA, 23 nt, Artificial Sequence
  RNA Oligomer
uggcuaguggcuguaauucaugu

SEQ ID NO: 60138 - RNA, 23 nt, Artificial Sequence
  RNA Oligomer
ggcuaguggcuguaauucauguc

SEQ ID NO: 60139 - RNA, 23 nt, Artificial Sequence
  RNA Oligomer
gcuaguggcuguaauucaugucc

SEQ ID NO: 60140 - RNA, 23 nt, Artificial Sequence
  RNA Oligomer
cuaguggcuguaauucaugucca

SEQ ID NO: 60141 - RNA, 23 nt, Artificial Sequence
  RNA Oligomer
uaguggcuguaauucauguccag

SEQ ID NO: 60142 - RNA, 23 nt, Artificial Sequence
  RNA Oligomer
cacuguaauuagcccaguuuugc

SEQ ID NO: 60143 - RNA, 23 nt, Artificial Sequence
  RNA Oligomer
acuguaauuagcccaguuuugcu

SEQ ID NO: 60144 - RNA, 23 nt, Artificial Sequence
  RNA Oligomer
cuguaauuagcccaguuuugcuc

SEQ ID NO: 60145 - RNA, 23 nt, Artificial Sequence
  RNA Oligomer
uguaauuagcccaguuuugcuca

SEQ ID NO: 60146 - RNA, 23 nt, Artificial Sequence
  RNA Oligomer
guaauuagcccaguuuugcucac

SEQ ID NO: 60147 - RNA, 23 nt, Artificial Sequence
  RNA Oligomer
cacaaauaugaucugcaggaccc

SEQ ID NO: 60148 - RNA, 23 nt, Artificial Sequence
  RNA Oligomer
acaaauaugaucugcaggaccca

SEQ ID NO: 60149 - RNA, 23 nt, Artificial Sequence
  RNA Oligomer
caaauaugaucugcaggacccag

SEQ ID NO: 60150 - RNA, 23 nt, Artificial Sequence
  RNA Oligomer
aaauaugaucugcaggacccaga

SEQ ID NO: 60151 - RNA, 23 nt, Artificial Sequence
  RNA Oligomer
aauaugaucugcaggacccagaa

SEQ ID NO: 60152 - RNA, 23 nt, Artificial Sequence
  RNA Oligomer
ccccuaaugaaagaaaagugcug

SEQ ID NO: 60153 - RNA, 23 nt, Artificial Sequence
  RNA Oligomer
uuguacaaaacuguuuauguagc

SEQ ID NO: 60154 - RNA, 23 nt, Artificial Sequence
  RNA Oligomer
cagcauuuucaccaaucuucugu

SEQ ID NO: 60155 - RNA, 23 nt, Artificial Sequence
  RNA Oligomer
agcauuuucaccaaucuucugug

SEQ ID NO: 60156 - RNA, 23 nt, Artificial Sequence
  RNA Oligomer
gcauuuucaccaaucuucuguga

SEQ ID NO: 60157 - RNA, 23 nt, Artificial Sequence
  RNA Oligomer
cauuuucaccaaucuucugugau

SEQ ID NO: 60158 - RNA, 23 nt, Artificial Sequence
  RNA Oligomer
auuuucaccaaucuucugugaug

SEQ ID NO: 60159 - RNA, 23 nt, Artificial Sequence
  RNA Oligomer
cugugaugaguuuuaaaaaaggc

SEQ ID NO: 60160 - RNA, 23 nt, Artificial Sequence
  RNA Oligomer
ugugaugaguuuuaaaaaaggca

SEQ ID NO: 60161 - RNA, 23 nt, Artificial Sequence
  RNA Oligomer
gugaugaguuuuaaaaaaggcau

SEQ ID NO: 60162 - RNA, 23 nt, Artificial Sequence
  RNA Oligomer
ugaugaguuuuaaaaaaggcauu

SEQ ID NO: 60163 - RNA, 23 nt, Artificial Sequence
  RNA Oligomer
gaugaguuuuaaaaaaggcauuu

SEQ ID NO: 60164 - RNA, 23 nt, Artificial Sequence
  RNA Oligomer
aacaucaaaguugcuggucacuc

SEQ ID NO: 60165 - RNA, 23 nt, Artificial Sequence
  RNA Oligomer
aauccaugagaaagguucaaauu

SEQ ID NO: 60166 - RNA, 23 nt, Artificial Sequence
  RNA Oligomer
guaguagcugaggaaugaugaaa

SEQ ID NO: 60167 - RNA, 23 nt, Artificial Sequence
  RNA Oligomer
uaguagcugaggaaugaugaaaa

SEQ ID NO: 60168 - RNA, 23 nt, Artificial Sequence
  RNA Oligomer
caaagugcaaauuuuaacaaugg

SEQ ID NO: 60169 - RNA, 23 nt, Artificial Sequence
  RNA Oligomer
aaagugcaaauuuuaacaaugga

SEQ ID NO: 60170 - RNA, 23 nt, Artificial Sequence
  RNA Oligomer
aagugcaaauuuuaacaauggaa

SEQ ID NO: 60171 - RNA, 23 nt, Artificial Sequence
  RNA Oligomer
agugcaaauuuuaacaauggaau

SEQ ID NO: 60172 - RNA, 23 nt, Artificial Sequence
  RNA Oligomer
gugcaaauuuuaacaauggaaug

SEQ ID NO: 60173 - RNA, 23 nt, Artificial Sequence
  RNA Oligomer
uguuuuagcagggacuuaaggac

SEQ ID NO: 60174 - RNA, 23 nt, Artificial Sequence
  RNA Oligomer
guuuuagcagggacuuaaggaca

SEQ ID NO: 60175 - RNA, 23 nt, Artificial Sequence
  RNA Oligomer
uuuuagcagggacuuaaggacaa

SEQ ID NO: 60176 - RNA, 23 nt, Artificial Sequence
  RNA Oligomer
uuuagcagggacuuaaggacaau

SEQ ID NO: 60177 - RNA, 23 nt, Artificial Sequence
  RNA Oligomer
uuagcagggacuuaaggacaauc

SEQ ID NO: 60178 - RNA, 23 nt, Artificial Sequence
  RNA Oligomer
ucuaaguucuuugaauccacuac

SEQ ID NO: 60179 - RNA, 23 nt, Artificial Sequence
  RNA Oligomer
cacuacuuuaaauaccaacaugc

SEQ ID NO: 60180 - RNA, 23 nt, Artificial Sequence
  RNA Oligomer
acuacuuuaaauaccaacaugca

SEQ ID NO: 60181 - RNA, 23 nt, Artificial Sequence
  RNA Oligomer
cuacuuuaaauaccaacaugcac

SEQ ID NO: 60182 - RNA, 23 nt, Artificial Sequence
  RNA Oligomer
uacuuuaaauaccaacaugcacc

SEQ ID NO: 60183 - RNA, 23 nt, Artificial Sequence
  RNA Oligomer
acuuuaaauaccaacaugcaccu

SEQ ID NO: 60184 - RNA, 23 nt, Artificial Sequence
  RNA Oligomer
uaaugucuuuguguuuucuaagc

SEQ ID NO: 60185 - RNA, 23 nt, Artificial Sequence
  RNA Oligomer
cuuuguguuuucuaagccucaug

SEQ ID NO: 60186 - RNA, 23 nt, Artificial Sequence
  RNA Oligomer
uuuguguuuucuaagccucauga

SEQ ID NO: 60187 - RNA, 23 nt, Artificial Sequence
  RNA Oligomer
accggaucaaaauuaacaccugg

SEQ ID NO: 60188 - RNA, 23 nt, Artificial Sequence
  RNA Oligomer
ccggaucaaaauuaacaccuggu

SEQ ID NO: 60189 - RNA, 23 nt, Artificial Sequence
  RNA Oligomer
cggaucaaaauuaacaccuggug

SEQ ID NO: 60190 - RNA, 23 nt, Artificial Sequence
  RNA Oligomer
ggaucaaaauuaacaccuggugc

SEQ ID NO: 60191 - RNA, 23 nt, Artificial Sequence
  RNA Oligomer
gaucaaaauuaacaccuggugca

SEQ ID NO: 60192 - RNA, 23 nt, Artificial Sequence
  RNA Oligomer
gaaguaaaaugaaaaggcaaguu

SEQ ID NO: 60193 - RNA, 23 nt, Artificial Sequence
  RNA Oligomer
ucggggaaaucaaaaggcugugc

SEQ ID NO: 60194 - RNA, 23 nt, Artificial Sequence
  RNA Oligomer
cggggaaaucaaaaggcugugca

SEQ ID NO: 60195 - RNA, 23 nt, Artificial Sequence
  RNA Oligomer
ggggaaaucaaaaggcugugcau

SEQ ID NO: 60196 - RNA, 23 nt, Artificial Sequence
  RNA Oligomer
gggaaaucaaaaggcugugcaug

SEQ ID NO: 60197 - RNA, 23 nt, Artificial Sequence
  RNA Oligomer
ggaaaucaaaaggcugugcaugg

SEQ ID NO: 60198 - RNA, 23 nt, Artificial Sequence
  RNA Oligomer
gaaaucaaaaggcugugcauggg

SEQ ID NO: 60199 - RNA, 23 nt, Artificial Sequence
  RNA Oligomer
aaaucaaaaggcugugcauggga

SEQ ID NO: 60200 - RNA, 23 nt, Artificial Sequence
  RNA Oligomer
aaucaaaaggcugugcaugggag

SEQ ID NO: 60201 - RNA, 23 nt, Artificial Sequence
  RNA Oligomer
aucaaaaggcugugcaugggagu

SEQ ID NO: 60202 - RNA, 23 nt, Artificial Sequence
  RNA Oligomer
aaauaagcauauuuuugagaccc

SEQ ID NO: 60203 - RNA, 23 nt, Artificial Sequence
  RNA Oligomer
aauaagcauauuuuugagaccca

SEQ ID NO: 60204 - RNA, 23 nt, Artificial Sequence
  RNA Oligomer
auaagcauauuuuugagacccac

SEQ ID NO: 60205 - RNA, 23 nt, Artificial Sequence
  RNA Oligomer
uaagcauauuuuugagacccaca

SEQ ID NO: 60206 - RNA, 23 nt, Artificial Sequence
  RNA Oligomer
aagcauauuuuugagacccacag

SEQ ID NO: 60207 - RNA, 23 nt, Artificial Sequence
  RNA Oligomer
agcauauuuuugagacccacagu

SEQ ID NO: 60208 - RNA, 23 nt, Artificial Sequence
  RNA Oligomer
gcauauuuuugagacccacaguc

SEQ ID NO: 60209 - RNA, 23 nt, Artificial Sequence
  RNA Oligomer
cauauuuuugagacccacagucu

SEQ ID NO: 60210 - RNA, 23 nt, Artificial Sequence
  RNA Oligomer
auauuuuugagacccacagucuu

SEQ ID NO: 60211 - RNA, 23 nt, Artificial Sequence
  RNA Oligomer
cauagaagaguucaaugauauuc

SEQ ID NO: 60212 - RNA, 23 nt, Artificial Sequence
  RNA Oligomer
auagaagaguucaaugauauuca

SEQ ID NO: 60213 - RNA, 23 nt, Artificial Sequence
  RNA Oligomer
uagaagaguucaaugauauucaa

SEQ ID NO: 60214 - RNA, 23 nt, Artificial Sequence
  RNA Oligomer
agaagaguucaaugauauucaag

SEQ ID NO: 60215 - RNA, 23 nt, Artificial Sequence
  RNA Oligomer
gaagaguucaaugauauucaagg

SEQ ID NO: 60216 - RNA, 23 nt, Artificial Sequence
  RNA Oligomer
ucgcauuuucaccuuaccaugcu

SEQ ID NO: 60217 - RNA, 23 nt, Artificial Sequence
  RNA Oligomer
cgcauuuucaccuuaccaugcuc

SEQ ID NO: 60218 - RNA, 23 nt, Artificial Sequence
  RNA Oligomer
gcauuuucaccuuaccaugcucu

SEQ ID NO: 60219 - RNA, 23 nt, Artificial Sequence
  RNA Oligomer
cauuuucaccuuaccaugcucuu

SEQ ID NO: 60220 - RNA, 23 nt, Artificial Sequence
  RNA Oligomer
auuuucaccuuaccaugcucuuc

SEQ ID NO: 60221 - RNA, 23 nt, Artificial Sequence
  RNA Oligomer
ccagaagcgcacaugagagauug

SEQ ID NO: 60222 - RNA, 23 nt, Artificial Sequence
  RNA Oligomer
cagaagcgcacaugagagauugg

SEQ ID NO: 60223 - RNA, 23 nt, Artificial Sequence
  RNA Oligomer
agaagcgcacaugagagauuggg

SEQ ID NO: 60224 - RNA, 23 nt, Artificial Sequence
  RNA Oligomer
gaagcgcacaugagagauuggga

SEQ ID NO: 60225 - RNA, 23 nt, Artificial Sequence
  RNA Oligomer
aagcgcacaugagagauugggaa

SEQ ID NO: 60226 - RNA, 23 nt, Artificial Sequence
  RNA Oligomer
uuauugaauaaagaacacucucc

SEQ ID NO: 60227 - RNA, 23 nt, Artificial Sequence
  RNA Oligomer
uauugaauaaagaacacucucca

SEQ ID NO: 60228 - RNA, 23 nt, Artificial Sequence
  RNA Oligomer
auugaauaaagaacacucuccag

SEQ ID NO: 60229 - RNA, 23 nt, Artificial Sequence
  RNA Oligomer
uugaauaaagaacacucuccaga

SEQ ID NO: 60230 - RNA, 23 nt, Artificial Sequence
  RNA Oligomer
ugaauaaagaacacucuccagaa

SEQ ID NO: 60231 - RNA, 23 nt, Artificial Sequence
  RNA Oligomer
ugcaaugaagcugaacaugaccg

SEQ ID NO: 60232 - RNA, 23 nt, Artificial Sequence
  RNA Oligomer
gcaaugaagcugaacaugaccgu

SEQ ID NO: 60233 - RNA, 23 nt, Artificial Sequence
  RNA Oligomer
caaugaagcugaacaugaccgua

SEQ ID NO: 60234 - RNA, 23 nt, Artificial Sequence
  RNA Oligomer
aaugaagcugaacaugaccguag

SEQ ID NO: 60235 - RNA, 23 nt, Artificial Sequence
  RNA Oligomer
augaagcugaacaugaccguagu

SEQ ID NO: 60236 - RNA, 23 nt, Artificial Sequence
  RNA Oligomer
ugucauacucagcauuuucacca

SEQ ID NO: 60237 - RNA, 23 nt, Artificial Sequence
  RNA Oligomer
gucauacucagcauuuucaccaa

SEQ ID NO: 60238 - RNA, 23 nt, Artificial Sequence
  RNA Oligomer
ucauacucagcauuuucaccaau

SEQ ID NO: 60239 - RNA, 23 nt, Artificial Sequence
  RNA Oligomer
cauacucagcauuuucaccaauc

SEQ ID NO: 60240 - RNA, 23 nt, Artificial Sequence
  RNA Oligomer
auacucagcauuuucaccaaucu

SEQ ID NO: 60241 - RNA, 23 nt, Artificial Sequence
  RNA Oligomer
guuguauguguacuacugaaucc

SEQ ID NO: 60242 - RNA, 23 nt, Artificial Sequence
  RNA Oligomer
uguauguguacuacugaauccuc

SEQ ID NO: 60243 - RNA, 23 nt, Artificial Sequence
  RNA Oligomer
guauguguacuacugaauccucu

SEQ ID NO: 60244 - RNA, 23 nt, Artificial Sequence
  RNA Oligomer
uauguguacuacugaauccucuu

SEQ ID NO: 60245 - RNA, 23 nt, Artificial Sequence
  RNA Oligomer
cauuccaaauaaaaucuuagugc

SEQ ID NO: 60246 - RNA, 23 nt, Artificial Sequence
  RNA Oligomer
auuccaaauaaaaucuuagugca

SEQ ID NO: 60247 - RNA, 23 nt, Artificial Sequence
  RNA Oligomer
uuccaaauaaaaucuuagugcaa

SEQ ID NO: 60248 - RNA, 23 nt, Artificial Sequence
  RNA Oligomer
uccaaauaaaaucuuagugcaaa

SEQ ID NO: 60249 - RNA, 23 nt, Artificial Sequence
  RNA Oligomer
ccaaauaaaaucuuagugcaaac

SEQ ID NO: 60250 - RNA, 23 nt, Artificial Sequence
  RNA Oligomer
uucuaagucucucacauuaauga

SEQ ID NO: 60251 - RNA, 23 nt, Artificial Sequence
  RNA Oligomer
ucuaagucucucacauuaaugac

SEQ ID NO: 60252 - RNA, 23 nt, Artificial Sequence
  RNA Oligomer
cuaagucucucacauuaaugacu

SEQ ID NO: 60253 - RNA, 23 nt, Artificial Sequence
  RNA Oligomer
uaagucucucacauuaaugacua

SEQ ID NO: 60254 - RNA, 23 nt, Artificial Sequence
  RNA Oligomer
aagucucucacauuaaugacuaa

SEQ ID NO: 60255 - RNA, 23 nt, Artificial Sequence
  RNA Oligomer
uuuaggagaaaaaaaaagugugc

SEQ ID NO: 60256 - RNA, 23 nt, Artificial Sequence
  RNA Oligomer
uuaggagaaaaaaaaagugugcu

SEQ ID NO: 60257 - RNA, 23 nt, Artificial Sequence
  RNA Oligomer
uaggagaaaaaaaaagugugcuu

SEQ ID NO: 60258 - RNA, 23 nt, Artificial Sequence
  RNA Oligomer
aggagaaaaaaaaagugugcuuu

SEQ ID NO: 60259 - RNA, 23 nt, Artificial Sequence
  RNA Oligomer
ggagaaaaaaaaagugugcuuua

SEQ ID NO: 60260 - RNA, 23 nt, Artificial Sequence
  RNA Oligomer
cccacaccacaaaaauccaugag

SEQ ID NO: 60261 - RNA, 23 nt, Artificial Sequence
  RNA Oligomer
ccacaccacaaaaauccaugaga

SEQ ID NO: 60262 - RNA, 23 nt, Artificial Sequence
  RNA Oligomer
cacaccacaaaaauccaugagaa

SEQ ID NO: 60263 - RNA, 23 nt, Artificial Sequence
  RNA Oligomer
acaccacaaaaauccaugagaaa

SEQ ID NO: 60264 - RNA, 23 nt, Artificial Sequence
  RNA Oligomer
caccacaaaaauccaugagaaag

SEQ ID NO: 60265 - RNA, 23 nt, Artificial Sequence
  RNA Oligomer
ugugaguuuauacuguaucugcu

SEQ ID NO: 60266 - RNA, 23 nt, Artificial Sequence
  RNA Oligomer
gugaguuuauacuguaucugcuu

SEQ ID NO: 60267 - RNA, 23 nt, Artificial Sequence
  RNA Oligomer
ugaguuuauacuguaucugcuug

SEQ ID NO: 60268 - RNA, 23 nt, Artificial Sequence
  RNA Oligomer
gaguuuauacuguaucugcuugu

SEQ ID NO: 60269 - RNA, 23 nt, Artificial Sequence
  RNA Oligomer
aguuuauacuguaucugcuugua

SEQ ID NO: 60270 - RNA, 23 nt, Artificial Sequence
  RNA Oligomer
caaaugcauggaaaaucuuauuc

SEQ ID NO: 60271 - RNA, 23 nt, Artificial Sequence
  RNA Oligomer
aaaugcauggaaaaucuuauucu

SEQ ID NO: 60272 - RNA, 23 nt, Artificial Sequence
  RNA Oligomer
aaugcauggaaaaucuuauucug

SEQ ID NO: 60273 - RNA, 23 nt, Artificial Sequence
  RNA Oligomer
augcauggaaaaucuuauucugu

SEQ ID NO: 60274 - RNA, 23 nt, Artificial Sequence
  RNA Oligomer
ugcauggaaaaucuuauucugug

SEQ ID NO: 60275 - RNA, 23 nt, Artificial Sequence
  RNA Oligomer
cuuuaaauaccaacaugcaccuc

SEQ ID NO: 60276 - RNA, 23 nt, Artificial Sequence
  RNA Oligomer
uuuaaauaccaacaugcaccucu

SEQ ID NO: 60277 - RNA, 23 nt, Artificial Sequence
  RNA Oligomer
uuaaauaccaacaugcaccucuc

SEQ ID NO: 60278 - RNA, 23 nt, Artificial Sequence
  RNA Oligomer
cuagguauucuaaugucuuugug

SEQ ID NO: 60279 - RNA, 23 nt, Artificial Sequence
  RNA Oligomer
uagguauucuaaugucuuugugu

SEQ ID NO: 60280 - RNA, 23 nt, Artificial Sequence
  RNA Oligomer
agguauucuaaugucuuuguguu

SEQ ID NO: 60281 - RNA, 23 nt, Artificial Sequence
  RNA Oligomer
gguauucuaaugucuuuguguuu

SEQ ID NO: 60282 - RNA, 23 nt, Artificial Sequence
  RNA Oligomer
guauucuaaugucuuuguguuuu

SEQ ID NO: 60283 - RNA, 23 nt, Artificial Sequence
  RNA Oligomer
aucaaaauuaacaccuggugcac

SEQ ID NO: 60284 - RNA, 23 nt, Artificial Sequence
  RNA Oligomer
ucaaaauuaacaccuggugcacu

SEQ ID NO: 60285 - RNA, 23 nt, Artificial Sequence
  RNA Oligomer
caaaauuaacaccuggugcacuu

SEQ ID NO: 60286 - RNA, 23 nt, Artificial Sequence
  RNA Oligomer
aaaauuaacaccuggugcacuuu

SEQ ID NO: 60287 - RNA, 23 nt, Artificial Sequence
  RNA Oligomer
uuucuucuccacaauugagugga

SEQ ID NO: 60288 - RNA, 23 nt, Artificial Sequence
  RNA Oligomer
cuccacaauugaguggaaucuug

SEQ ID NO: 60289 - RNA, 23 nt, Artificial Sequence
  RNA Oligomer
uccacaauugaguggaaucuuga

SEQ ID NO: 60290 - RNA, 23 nt, Artificial Sequence
  RNA Oligomer
ccacaauugaguggaaucuugau

SEQ ID NO: 60291 - RNA, 23 nt, Artificial Sequence
  RNA Oligomer
cacaauugaguggaaucuugaug

SEQ ID NO: 60292 - RNA, 23 nt, Artificial Sequence
  RNA Oligomer
acaauugaguggaaucuugaugc

SEQ ID NO: 60293 - RNA, 23 nt, Artificial Sequence
  RNA Oligomer
ucaaaaggcugugcaugggaguu

SEQ ID NO: 60294 - RNA, 23 nt, Artificial Sequence
  RNA Oligomer
gauuuuguucugcacuguaauua

SEQ ID NO: 60295 - RNA, 23 nt, Artificial Sequence
  RNA Oligomer
auuuuguucugcacuguaauuag

SEQ ID NO: 60296 - RNA, 23 nt, Artificial Sequence
  RNA Oligomer
uuuuguucugcacuguaauuagc

SEQ ID NO: 60297 - RNA, 23 nt, Artificial Sequence
  RNA Oligomer
cugcacuguaauuagcccaguuu

SEQ ID NO: 60298 - RNA, 23 nt, Artificial Sequence
  RNA Oligomer
ugcacuguaauuagcccaguuuu

SEQ ID NO: 60299 - RNA, 23 nt, Artificial Sequence
  RNA Oligomer
uuuucaccuuaccaugcucuuca

SEQ ID NO: 60300 - RNA, 23 nt, Artificial Sequence
  RNA Oligomer
uuucaccuuaccaugcucuucaa

SEQ ID NO: 60301 - RNA, 23 nt, Artificial Sequence
  RNA Oligomer
uaccaugcucuucaauaccguac

SEQ ID NO: 60302 - RNA, 23 nt, Artificial Sequence
  RNA Oligomer
accaugcucuucaauaccguacu

SEQ ID NO: 60303 - RNA, 23 nt, Artificial Sequence
  RNA Oligomer
ccaugcucuucaauaccguacuu

SEQ ID NO: 60304 - RNA, 23 nt, Artificial Sequence
  RNA Oligomer
caugcucuucaauaccguacuug

SEQ ID NO: 60305 - RNA, 23 nt, Artificial Sequence
  RNA Oligomer
augcucuucaauaccguacuuga

SEQ ID NO: 60306 - RNA, 23 nt, Artificial Sequence
  RNA Oligomer
uuuaaaacuccgcugcuguuugg

SEQ ID NO: 60307 - RNA, 23 nt, Artificial Sequence
  RNA Oligomer
uuaaaacuccgcugcuguuuggu

SEQ ID NO: 60308 - RNA, 23 nt, Artificial Sequence
  RNA Oligomer
uaaaacuccgcugcuguuuggua

SEQ ID NO: 60309 - RNA, 23 nt, Artificial Sequence
  RNA Oligomer
aaaacuccgcugcuguuugguac

SEQ ID NO: 60310 - RNA, 23 nt, Artificial Sequence
  RNA Oligomer
aaacuccgcugcuguuugguacu

SEQ ID NO: 60311 - RNA, 23 nt, Artificial Sequence
  RNA Oligomer
uucaauaccguacuugaacuucu

SEQ ID NO: 60312 - RNA, 23 nt, Artificial Sequence
  RNA Oligomer
ucaauaccguacuugaacuucuu

SEQ ID NO: 60313 - RNA, 23 nt, Artificial Sequence
  RNA Oligomer
caauaccguacuugaacuucuuu

SEQ ID NO: 60314 - RNA, 23 nt, Artificial Sequence
  RNA Oligomer
aauaccguacuugaacuucuuua

SEQ ID NO: 60315 - RNA, 23 nt, Artificial Sequence
  RNA Oligomer
auaccguacuugaacuucuuuau

SEQ ID NO: 60316 - RNA, 23 nt, Artificial Sequence
  RNA Oligomer
gaacuucuuuaucucaaucugcu

SEQ ID NO: 60317 - RNA, 23 nt, Artificial Sequence
  RNA Oligomer
aacuucuuuaucucaaucugcuu

SEQ ID NO: 60318 - RNA, 23 nt, Artificial Sequence
  RNA Oligomer
acuucuuuaucucaaucugcuuc

SEQ ID NO: 60319 - RNA, 23 nt, Artificial Sequence
  RNA Oligomer
guacagacacaaauaugaucugc

SEQ ID NO: 60320 - RNA, 23 nt, Artificial Sequence
  RNA Oligomer
uacagacacaaauaugaucugca

SEQ ID NO: 60321 - RNA, 23 nt, Artificial Sequence
  RNA Oligomer
acagacacaaauaugaucugcag

SEQ ID NO: 60322 - RNA, 23 nt, Artificial Sequence
  RNA Oligomer
cagacacaaauaugaucugcagg

SEQ ID NO: 60323 - RNA, 23 nt, Artificial Sequence
  RNA Oligomer
agacacaaauaugaucugcagga

SEQ ID NO: 60324 - RNA, 23 nt, Artificial Sequence
  RNA Oligomer
ucccccuaaugaaagaaaagugc

SEQ ID NO: 60325 - RNA, 23 nt, Artificial Sequence
  RNA Oligomer
cccccuaaugaaagaaaagugcu

SEQ ID NO: 60326 - RNA, 23 nt, Artificial Sequence
  RNA Oligomer
gucauagcagacauuuucacaac

SEQ ID NO: 60327 - RNA, 23 nt, Artificial Sequence
  RNA Oligomer
ucauagcagacauuuucacaacc

SEQ ID NO: 60328 - RNA, 23 nt, Artificial Sequence
  RNA Oligomer
cauagcagacauuuucacaacca

SEQ ID NO: 60329 - RNA, 23 nt, Artificial Sequence
  RNA Oligomer
auagcagacauuuucacaaccag

SEQ ID NO: 60330 - RNA, 23 nt, Artificial Sequence
  RNA Oligomer
uagcagacauuuucacaaccagg

SEQ ID NO: 60331 - RNA, 23 nt, Artificial Sequence
  RNA Oligomer
ggacuaggucuacauuacaugca

SEQ ID NO: 60332 - RNA, 23 nt, Artificial Sequence
  RNA Oligomer
gacuaggucuacauuacaugcaa

SEQ ID NO: 60333 - RNA, 23 nt, Artificial Sequence
  RNA Oligomer
acuaggucuacauuacaugcaau

SEQ ID NO: 60334 - RNA, 23 nt, Artificial Sequence
  RNA Oligomer
cuaggucuacauuacaugcaaug

SEQ ID NO: 60335 - RNA, 23 nt, Artificial Sequence
  RNA Oligomer
uaggucuacauuacaugcaauga

SEQ ID NO: 60336 - RNA, 23 nt, Artificial Sequence
  RNA Oligomer
gaagaaaagugucauacucagca

SEQ ID NO: 60337 - RNA, 23 nt, Artificial Sequence
  RNA Oligomer
aagaaaagugucauacucagcau

SEQ ID NO: 60338 - RNA, 23 nt, Artificial Sequence
  RNA Oligomer
agaaaagugucauacucagcauu

SEQ ID NO: 60339 - RNA, 23 nt, Artificial Sequence
  RNA Oligomer
gaaaagugucauacucagcauuu

SEQ ID NO: 60340 - RNA, 23 nt, Artificial Sequence
  RNA Oligomer
aaaagugucauacucagcauuuu

SEQ ID NO: 60341 - RNA, 23 nt, Artificial Sequence
  RNA Oligomer
gaaaaugaaaaguacugacagcc

SEQ ID NO: 60342 - RNA, 23 nt, Artificial Sequence
  RNA Oligomer
aaaaugaaaaguacugacagcca

SEQ ID NO: 60343 - RNA, 23 nt, Artificial Sequence
  RNA Oligomer
aaaugaaaaguacugacagccac

SEQ ID NO: 60344 - RNA, 23 nt, Artificial Sequence
  RNA Oligomer
aaugaaaaguacugacagccaca

SEQ ID NO: 60345 - RNA, 23 nt, Artificial Sequence
  RNA Oligomer
augaaaaguacugacagccacac

SEQ ID NO: 60346 - RNA, 23 nt, Artificial Sequence
  RNA Oligomer
augaaagaaaagugcugauaccu

SEQ ID NO: 60347 - RNA, 23 nt, Artificial Sequence
  RNA Oligomer
ugaaagaaaagugcugauaccuc

SEQ ID NO: 60348 - RNA, 23 nt, Artificial Sequence
  RNA Oligomer
gaaagaaaagugcugauaccucg

SEQ ID NO: 60349 - RNA, 23 nt, Artificial Sequence
  RNA Oligomer
aaagaaaagugcugauaccucgu

SEQ ID NO: 60350 - RNA, 23 nt, Artificial Sequence
  RNA Oligomer
ucuuagugcaaacaucaaaguug

SEQ ID NO: 60351 - RNA, 23 nt, Artificial Sequence
  RNA Oligomer
cuuagugcaaacaucaaaguugc

SEQ ID NO: 60352 - RNA, 23 nt, Artificial Sequence
  RNA Oligomer
uuagugcaaacaucaaaguugcu

SEQ ID NO: 60353 - RNA, 23 nt, Artificial Sequence
  RNA Oligomer
uagugcaaacaucaaaguugcug

SEQ ID NO: 60354 - RNA, 23 nt, Artificial Sequence
  RNA Oligomer
guuacugcaaaauucauuuaggc

SEQ ID NO: 60355 - RNA, 23 nt, Artificial Sequence
  RNA Oligomer
uuacugcaaaauucauuuaggca

SEQ ID NO: 60356 - RNA, 23 nt, Artificial Sequence
  RNA Oligomer
uacugcaaaauucauuuaggcac

SEQ ID NO: 60357 - RNA, 23 nt, Artificial Sequence
  RNA Oligomer
acugcaaaauucauuuaggcaca

SEQ ID NO: 60358 - RNA, 23 nt, Artificial Sequence
  RNA Oligomer
cugcaaaauucauuuaggcacau

SEQ ID NO: 60359 - RNA, 23 nt, Artificial Sequence
  RNA Oligomer
ucauuuaggcacauuuaauaguc

SEQ ID NO: 60360 - RNA, 23 nt, Artificial Sequence
  RNA Oligomer
cauuuaggcacauuuaauagucc

SEQ ID NO: 60361 - RNA, 23 nt, Artificial Sequence
  RNA Oligomer
auuuaggcacauuuaauagucca

SEQ ID NO: 60362 - RNA, 23 nt, Artificial Sequence
  RNA Oligomer
uuuaggcacauuuaauaguccac

SEQ ID NO: 60363 - RNA, 23 nt, Artificial Sequence
  RNA Oligomer
uuaggcacauuuaauaguccacu

SEQ ID NO: 60364 - RNA, 23 nt, Artificial Sequence
  RNA Oligomer
ucacauuaaugacuaaagccugu

SEQ ID NO: 60365 - RNA, 23 nt, Artificial Sequence
  RNA Oligomer
cacauuaaugacuaaagccuguu

SEQ ID NO: 60366 - RNA, 23 nt, Artificial Sequence
  RNA Oligomer
acauuaaugacuaaagccuguuu

SEQ ID NO: 60367 - RNA, 23 nt, Artificial Sequence
  RNA Oligomer
cauuaaugacuaaagccuguuua

SEQ ID NO: 60368 - RNA, 23 nt, Artificial Sequence
  RNA Oligomer
auuaaugacuaaagccuguuuac

SEQ ID NO: 60369 - RNA, 23 nt, Artificial Sequence
  RNA Oligomer
aaaauucuaucauucaagcauca

SEQ ID NO: 60370 - RNA, 23 nt, Artificial Sequence
  RNA Oligomer
aaauucuaucauucaagcaucaa

SEQ ID NO: 60371 - RNA, 23 nt, Artificial Sequence
  RNA Oligomer
aauucuaucauucaagcaucaau

SEQ ID NO: 60372 - RNA, 23 nt, Artificial Sequence
  RNA Oligomer
auucuaucauucaagcaucaaug

SEQ ID NO: 60373 - RNA, 23 nt, Artificial Sequence
  RNA Oligomer
uucuaucauucaagcaucaauga

SEQ ID NO: 60374 - RNA, 23 nt, Artificial Sequence
  RNA Oligomer
uaauaggauacacagggaaaaac

SEQ ID NO: 60375 - RNA, 23 nt, Artificial Sequence
  RNA Oligomer
aggauacacagggaaaaacauuu

SEQ ID NO: 60376 - RNA, 23 nt, Artificial Sequence
  RNA Oligomer
ggauacacagggaaaaacauuuu

SEQ ID NO: 60377 - RNA, 23 nt, Artificial Sequence
  RNA Oligomer
gauacacagggaaaaacauuuua

SEQ ID NO: 60378 - RNA, 23 nt, Artificial Sequence
  RNA Oligomer
agggaaaaacauuuuaggagaaa

SEQ ID NO: 60379 - RNA, 23 nt, Artificial Sequence
  RNA Oligomer
gggaaaaacauuuuaggagaaaa

SEQ ID NO: 60380 - RNA, 23 nt, Artificial Sequence
  RNA Oligomer
aagaaaagugcugauaccucgua

SEQ ID NO: 60381 - RNA, 23 nt, Artificial Sequence
  RNA Oligomer
agaaaagugcugauaccucguaa

SEQ ID NO: 60382 - RNA, 23 nt, Artificial Sequence
  RNA Oligomer
gaaaagugcugauaccucguaaa

SEQ ID NO: 60383 - RNA, 23 nt, Artificial Sequence
  RNA Oligomer
gcccacaccacaaaaauccauga

SEQ ID NO: 60384 - RNA, 23 nt, Artificial Sequence
  RNA Oligomer
guuuauacuguaucugcuuguac

SEQ ID NO: 60385 - RNA, 23 nt, Artificial Sequence
  RNA Oligomer
uuuauacuguaucugcuuguacc

SEQ ID NO: 60386 - RNA, 23 nt, Artificial Sequence
  RNA Oligomer
uuauacuguaucugcuuguacca

SEQ ID NO: 60387 - RNA, 23 nt, Artificial Sequence
  RNA Oligomer
uauacuguaucugcuuguaccaa

SEQ ID NO: 60388 - RNA, 23 nt, Artificial Sequence
  RNA Oligomer
auacuguaucugcuuguaccaau

SEQ ID NO: 60389 - RNA, 23 nt, Artificial Sequence
  RNA Oligomer
ugacaaacaaaacaaacucuucg

SEQ ID NO: 60390 - RNA, 23 nt, Artificial Sequence
  RNA Oligomer
gacaaacaaaacaaacucuucga

SEQ ID NO: 60391 - RNA, 23 nt, Artificial Sequence
  RNA Oligomer
acaaacaaaacaaacucuucgac

SEQ ID NO: 60392 - RNA, 23 nt, Artificial Sequence
  RNA Oligomer
caaacaaaacaaacucuucgaca

SEQ ID NO: 60393 - RNA, 23 nt, Artificial Sequence
  RNA Oligomer
aaacaaaacaaacucuucgacac

SEQ ID NO: 60394 - RNA, 23 nt, Artificial Sequence
  RNA Oligomer
augaugaaaaagugaugguaaug

SEQ ID NO: 60395 - RNA, 23 nt, Artificial Sequence
  RNA Oligomer
aaaagugaugguaaugauauugu

SEQ ID NO: 60396 - RNA, 23 nt, Artificial Sequence
  RNA Oligomer
aaagugaugguaaugauauugug

SEQ ID NO: 60397 - RNA, 23 nt, Artificial Sequence
  RNA Oligomer
aagugaugguaaugauauugugc

SEQ ID NO: 60398 - RNA, 23 nt, Artificial Sequence
  RNA Oligomer
agugaugguaaugauauugugca

SEQ ID NO: 60399 - RNA, 23 nt, Artificial Sequence
  RNA Oligomer
gugaugguaaugauauugugcaa

SEQ ID NO: 60400 - RNA, 23 nt, Artificial Sequence
  RNA Oligomer
cauggaaaaucuuauucuguggg

SEQ ID NO: 60401 - RNA, 23 nt, Artificial Sequence
  RNA Oligomer
aaaucuuauucugugggccuugu

SEQ ID NO: 60402 - RNA, 23 nt, Artificial Sequence
  RNA Oligomer
uuucuuguugaaaagaccuaaga

SEQ ID NO: 60403 - RNA, 23 nt, Artificial Sequence
  RNA Oligomer
uucuuguugaaaagaccuaagau

SEQ ID NO: 60404 - RNA, 23 nt, Artificial Sequence
  RNA Oligomer
ucuuguugaaaagaccuaagaug

SEQ ID NO: 60405 - RNA, 23 nt, Artificial Sequence
  RNA Oligomer
aaaaauauuuagccacaauuacc

SEQ ID NO: 60406 - RNA, 23 nt, Artificial Sequence
  RNA Oligomer
cuaaguucuuugaauccacuacu

SEQ ID NO: 60407 - RNA, 23 nt, Artificial Sequence
  RNA Oligomer
uugaauccacuacuuuaaauacc

SEQ ID NO: 60408 - RNA, 23 nt, Artificial Sequence
  RNA Oligomer
ugaauccacuacuuuaaauacca

SEQ ID NO: 60409 - RNA, 23 nt, Artificial Sequence
  RNA Oligomer
gaauccacuacuuuaaauaccaa

SEQ ID NO: 60410 - RNA, 23 nt, Artificial Sequence
  RNA Oligomer
aauccacuacuuuaaauaccaac

SEQ ID NO: 60411 - RNA, 23 nt, Artificial Sequence
  RNA Oligomer
auccacuacuuuaaauaccaaca

SEQ ID NO: 60412 - RNA, 23 nt, Artificial Sequence
  RNA Oligomer
agugaaccuagguauucuaaugu

SEQ ID NO: 60413 - RNA, 23 nt, Artificial Sequence
  RNA Oligomer
gugaaccuagguauucuaauguc

SEQ ID NO: 60414 - RNA, 23 nt, Artificial Sequence
  RNA Oligomer
ugaaccuagguauucuaaugucu

SEQ ID NO: 60415 - RNA, 23 nt, Artificial Sequence
  RNA Oligomer
gaaccuagguauucuaaugucuu

SEQ ID NO: 60416 - RNA, 23 nt, Artificial Sequence
  RNA Oligomer
aaccuagguauucuaaugucuuu

SEQ ID NO: 60417 - RNA, 23 nt, Artificial Sequence
  RNA Oligomer
accuagguauucuaaugucuuug

SEQ ID NO: 60418 - RNA, 23 nt, Artificial Sequence
  RNA Oligomer
ccuagguauucuaaugucuuugu

SEQ ID NO: 60419 - RNA, 23 nt, Artificial Sequence
  RNA Oligomer
aauuaacaccuggugcacuuucu

SEQ ID NO: 60420 - RNA, 23 nt, Artificial Sequence
  RNA Oligomer
auuaacaccuggugcacuuucua

SEQ ID NO: 60421 - RNA, 23 nt, Artificial Sequence
  RNA Oligomer
uuaacaccuggugcacuuucuac

SEQ ID NO: 60422 - RNA, 23 nt, Artificial Sequence
  RNA Oligomer
uaacaccuggugcacuuucuaca

SEQ ID NO: 60423 - RNA, 23 nt, Artificial Sequence
  RNA Oligomer
aacaccuggugcacuuucuacag

SEQ ID NO: 60424 - RNA, 23 nt, Artificial Sequence
  RNA Oligomer
ugggaguuagagauggugcuucc

SEQ ID NO: 60425 - RNA, 23 nt, Artificial Sequence
  RNA Oligomer
gggaguuagagauggugcuuccc

SEQ ID NO: 60426 - RNA, 23 nt, Artificial Sequence
  RNA Oligomer
ggaguuagagauggugcuucccg

SEQ ID NO: 60427 - RNA, 23 nt, Artificial Sequence
  RNA Oligomer
gaguuagagauggugcuucccgc

SEQ ID NO: 60428 - RNA, 23 nt, Artificial Sequence
  RNA Oligomer
aguuagagauggugcuucccgcc

SEQ ID NO: 60429 - RNA, 23 nt, Artificial Sequence
  RNA Oligomer
ugccccauucgauuuuguucugc

SEQ ID NO: 60430 - RNA, 23 nt, Artificial Sequence
  RNA Oligomer
gccccauucgauuuuguucugca

SEQ ID NO: 60431 - RNA, 23 nt, Artificial Sequence
  RNA Oligomer
ccccauucgauuuuguucugcac

SEQ ID NO: 60432 - RNA, 23 nt, Artificial Sequence
  RNA Oligomer
cccauucgauuuuguucugcacu

SEQ ID NO: 60433 - RNA, 23 nt, Artificial Sequence
  RNA Oligomer
ccauucgauuuuguucugcacug

SEQ ID NO: 60434 - RNA, 23 nt, Artificial Sequence
  RNA Oligomer
uaacccgauccuuaacgcccuug

SEQ ID NO: 60435 - RNA, 23 nt, Artificial Sequence
  RNA Oligomer
uugaagaaaacauagaagaguuc

SEQ ID NO: 60436 - RNA, 23 nt, Artificial Sequence
  RNA Oligomer
ugaagaaaacauagaagaguuca

SEQ ID NO: 60437 - RNA, 23 nt, Artificial Sequence
  RNA Oligomer
gaagaaaacauagaagaguucaa

SEQ ID NO: 60438 - RNA, 23 nt, Artificial Sequence
  RNA Oligomer
aagaaaacauagaagaguucaau

SEQ ID NO: 60439 - RNA, 23 nt, Artificial Sequence
  RNA Oligomer
gaggaugaaguaaaaugaaaagg

SEQ ID NO: 60440 - RNA, 23 nt, Artificial Sequence
  RNA Oligomer
uuaucucaaucugcuucaagugc

SEQ ID NO: 60441 - RNA, 23 nt, Artificial Sequence
  RNA Oligomer
auaccucguaaaagcuuuuuugu

SEQ ID NO: 60442 - RNA, 23 nt, Artificial Sequence
  RNA Oligomer
aaauuaacaccuggugcacuuuc

SEQ ID NO: 60443 - RNA, 23 nt, Artificial Sequence
  RNA Oligomer
aaaaaggcauuuggagaaacugg

SEQ ID NO: 60444 - RNA, 23 nt, Artificial Sequence
  RNA Oligomer
uugugaguuuauacuguaucugc

SEQ ID NO: 60445 - RNA, 23 nt, Artificial Sequence
  RNA Oligomer
aacccaagaauaccaguuacugc

SEQ ID NO: 60446 - RNA, 23 nt, Artificial Sequence
  RNA Oligomer
gauaccucguaaaagcuuuuuug

SEQ ID NO: 60447 - RNA, 23 nt, Artificial Sequence
  RNA Oligomer
ugaacuucuuuaucucaaucugc

SEQ ID NO: 60448 - RNA, 23 nt, Artificial Sequence
  RNA Oligomer
uuuggagaaacugguagaugucu

SEQ ID NO: 60449 - RNA, 23 nt, Artificial Sequence
  RNA Oligomer
uuaaugacuaaagccuguuuaca

SEQ ID NO: 60450 - RNA, 23 nt, Artificial Sequence
  RNA Oligomer
ugaauccauagauguaccacugg

SEQ ID NO: 60451 - RNA, 23 nt, Artificial Sequence
  RNA Oligomer
accguacuugaacuucuuuaucu

SEQ ID NO: 60452 - RNA, 23 nt, Artificial Sequence
  RNA Oligomer
augcaugcaagaagaaaaguguc

SEQ ID NO: 60453 - RNA, 23 nt, Artificial Sequence
  RNA Oligomer
aaaguacugacagccacaccuuc

SEQ ID NO: 60454 - RNA, 23 nt, Artificial Sequence
  RNA Oligomer
aaguacugacagccacaccuucc

SEQ ID NO: 60455 - RNA, 23 nt, Artificial Sequence
  RNA Oligomer
aucuuagugcaaacaucaaaguu

SEQ ID NO: 60456 - RNA, 23 nt, Artificial Sequence
  RNA Oligomer
aacucuucgacacacauauaagu

SEQ ID NO: 60457 - RNA, 23 nt, Artificial Sequence
  RNA Oligomer
uagcugaggaaugaugaaaaagu

SEQ ID NO: 60458 - RNA, 23 nt, Artificial Sequence
  RNA Oligomer
ugguaaugauauugugcaagugg

SEQ ID NO: 60459 - RNA, 23 nt, Artificial Sequence
  RNA Oligomer
auccucugucuuuuucuuguuga

SEQ ID NO: 60460 - RNA, 23 nt, Artificial Sequence
  RNA Oligomer
aaaaagcccuuaucuauguauca

SEQ ID NO: 60461 - RNA, 23 nt, Artificial Sequence
  RNA Oligomer
aauucauguccagcagcuaguuu

SEQ ID NO: 60462 - RNA, 23 nt, Artificial Sequence
  RNA Oligomer
cugugcaugggaguuagagaugg

SEQ ID NO: 60463 - RNA, 23 nt, Artificial Sequence
  RNA Oligomer
aagcugaauccauagauguacca

SEQ ID NO: 60464 - RNA, 23 nt, Artificial Sequence
  RNA Oligomer
uaccguacuugaacuucuuuauc

SEQ ID NO: 60465 - RNA, 23 nt, Artificial Sequence
  RNA Oligomer
uugaacuucuuuaucucaaucug

SEQ ID NO: 60466 - RNA, 23 nt, Artificial Sequence
  RNA Oligomer
uuccucuuucuuguucaguuucu

SEQ ID NO: 60467 - RNA, 23 nt, Artificial Sequence
  RNA Oligomer
auaaagaacacucuccagaacac

SEQ ID NO: 60468 - RNA, 23 nt, Artificial Sequence
  RNA Oligomer
uaaguaggaaaacccaagaauac

SEQ ID NO: 60469 - RNA, 23 nt, Artificial Sequence
  RNA Oligomer
uuugugaguuuauacuguaucug

SEQ ID NO: 60470 - RNA, 23 nt, Artificial Sequence
  RNA Oligomer
caucccaacugucuuaaaaaugu

SEQ ID NO: 60471 - RNA, 23 nt, Artificial Sequence
  RNA Oligomer
aauccucugucuuuuucuuguug

SEQ ID NO: 60472 - RNA, 23 nt, Artificial Sequence
  RNA Oligomer
aaaagcccuuaucuauguaucac

SEQ ID NO: 60473 - RNA, 23 nt, Artificial Sequence
  RNA Oligomer
uuguguuuucuaagccucaugaa

SEQ ID NO: 60474 - RNA, 23 nt, Artificial Sequence
  RNA Oligomer
caccggaucaaaauuaacaccug

SEQ ID NO: 60475 - RNA, 23 nt, Artificial Sequence
  RNA Oligomer
uguaauucauguccagcagcuag

SEQ ID NO: 60476 - RNA, 23 nt, Artificial Sequence
  RNA Oligomer
acucaagcugaauccauagaugu

SEQ ID NO: 60477 - RNA, 23 nt, Artificial Sequence
  RNA Oligomer
uucgcaucacauagaacacauga

SEQ ID NO: 60478 - RNA, 23 nt, Artificial Sequence
  RNA Oligomer
cagacauuuucacaaccagguug

SEQ ID NO: 60479 - RNA, 23 nt, Artificial Sequence
  RNA Oligomer
acaugcaugcaagaagaaaagug

SEQ ID NO: 60480 - RNA, 23 nt, Artificial Sequence
  RNA Oligomer
aagaagaaaagugucauacucag

SEQ ID NO: 60481 - RNA, 23 nt, Artificial Sequence
  RNA Oligomer
aaaaaaggcauuuggagaaacug

SEQ ID NO: 60482 - RNA, 23 nt, Artificial Sequence
  RNA Oligomer
aaacccaagaauaccaguuacug

SEQ ID NO: 60483 - RNA, 23 nt, Artificial Sequence
  RNA Oligomer
uaguccacucuaagcauuuuuuc

SEQ ID NO: 60484 - RNA, 23 nt, Artificial Sequence
  RNA Oligomer
gucugaauuuuaaacugauacca

SEQ ID NO: 60485 - RNA, 23 nt, Artificial Sequence
  RNA Oligomer
uagcagggacuuaaggacaaucc

SEQ ID NO: 60486 - RNA, 23 nt, Artificial Sequence
  RNA Oligomer
acauacacagaaccauucuuagg

SEQ ID NO: 60487 - RNA, 23 nt, Artificial Sequence
  RNA Oligomer
uaaauaccaacaugcaccucucu

SEQ ID NO: 60488 - RNA, 23 nt, Artificial Sequence
  RNA Oligomer
ugaguguuacaacgaaaggcaga

SEQ ID NO: 60489 - RNA, 23 nt, Artificial Sequence
  RNA Oligomer
ugcaugcaagaagaaaaguguca

SEQ ID NO: 60490 - RNA, 23 nt, Artificial Sequence
  RNA Oligomer
augcaagaagaaaagugucauac

SEQ ID NO: 60491 - RNA, 23 nt, Artificial Sequence
  RNA Oligomer
ucagcauuuucaccaaucuucug

SEQ ID NO: 60492 - RNA, 23 nt, Artificial Sequence
  RNA Oligomer
aauccucuuucaaccucucuugc

SEQ ID NO: 60493 - RNA, 23 nt, Artificial Sequence
  RNA Oligomer
acucuaagcauuuuuucuaaguc

SEQ ID NO: 60494 - RNA, 23 nt, Artificial Sequence
  RNA Oligomer
cucuaagcauuuuuucuaagucu

SEQ ID NO: 60495 - RNA, 23 nt, Artificial Sequence
  RNA Oligomer
cuaagcauuuuuucuaagucucu

SEQ ID NO: 60496 - RNA, 23 nt, Artificial Sequence
  RNA Oligomer
cucucacauuaaugacuaaagcc

SEQ ID NO: 60497 - RNA, 23 nt, Artificial Sequence
  RNA Oligomer
aaucuguguuugugaguuuauac

SEQ ID NO: 60498 - RNA, 23 nt, Artificial Sequence
  RNA Oligomer
aaacucuucgacacacauauaag

SEQ ID NO: 60499 - RNA, 23 nt, Artificial Sequence
  RNA Oligomer
guagcugaggaaugaugaaaaag

SEQ ID NO: 60500 - RNA, 23 nt, Artificial Sequence
  RNA Oligomer
uaaugauauugugcaaguggaug

SEQ ID NO: 60501 - RNA, 23 nt, Artificial Sequence
  RNA Oligomer
cuuaccuucaaagugcaaauuuu

SEQ ID NO: 60502 - RNA, 23 nt, Artificial Sequence
  RNA Oligomer
acaauccucugucuuuuucuugu

SEQ ID NO: 60503 - RNA, 23 nt, Artificial Sequence
  RNA Oligomer
aagcccuuaucuauguaucaccu

SEQ ID NO: 60504 - RNA, 23 nt, Artificial Sequence
  RNA Oligomer
aaagugcugauaccucguaaaag

SEQ ID NO: 60505 - RNA, 23 nt, Artificial Sequence
  RNA Oligomer
auguccagcagcuaguuuuuuag

SEQ ID NO: 60506 - RNA, 23 nt, Artificial Sequence
  RNA Oligomer
aaguaaaaugaaaaggcaaguuc

SEQ ID NO: 60507 - RNA, 23 nt, Artificial Sequence
  RNA Oligomer
gaaauaagcauauuuuugagacc

SEQ ID NO: 60508 - RNA, 23 nt, Artificial Sequence
  RNA Oligomer
agcugaauccauagauguaccac

SEQ ID NO: 60509 - RNA, 23 nt, Artificial Sequence
  RNA Oligomer
uaccacuggaucagcaagaaggc

SEQ ID NO: 60510 - RNA, 23 nt, Artificial Sequence
  RNA Oligomer
cuugaagaggauacugaugaugu

SEQ ID NO: 60511 - RNA, 23 nt, Artificial Sequence
  RNA Oligomer
uugaagaggauacugaugaugua

SEQ ID NO: 60512 - RNA, 23 nt, Artificial Sequence
  RNA Oligomer
cguacuugaacuucuuuaucuca

SEQ ID NO: 60513 - RNA, 23 nt, Artificial Sequence
  RNA Oligomer
caguuugggcaaccuugaguucu

SEQ ID NO: 60514 - RNA, 23 nt, Artificial Sequence
  RNA Oligomer
acacaaauaugaucugcaggacc

SEQ ID NO: 60515 - RNA, 23 nt, Artificial Sequence
  RNA Oligomer
uugggaaagacuugucauagcag

SEQ ID NO: 60516 - RNA, 23 nt, Artificial Sequence
  RNA Oligomer
acacucuccagaacacaugaucu

SEQ ID NO: 60517 - RNA, 23 nt, Artificial Sequence
  RNA Oligomer
aaggcauuuggagaaacugguag

SEQ ID NO: 60518 - RNA, 23 nt, Artificial Sequence
  RNA Oligomer
auuuggagaaacugguagauguc

SEQ ID NO: 60519 - RNA, 23 nt, Artificial Sequence
  RNA Oligomer
aguccacucuaagcauuuuuucu

SEQ ID NO: 60520 - RNA, 23 nt, Artificial Sequence
  RNA Oligomer
gcugaggaaugaugaaaaaguga

SEQ ID NO: 60521 - RNA, 23 nt, Artificial Sequence
  RNA Oligomer
cuaagauguucaggaaguauuua

SEQ ID NO: 60522 - RNA, 23 nt, Artificial Sequence
  RNA Oligomer
uuauuccuggccagaauuauuuc

SEQ ID NO: 60523 - RNA, 23 nt, Artificial Sequence
  RNA Oligomer
uuaccacccgcucauucacauac

SEQ ID NO: 60524 - RNA, 23 nt, Artificial Sequence
  RNA Oligomer
auucacauacacagaaccauucu

SEQ ID NO: 60525 - RNA, 23 nt, Artificial Sequence
  RNA Oligomer
uauguaucaccuaauggaacucu

SEQ ID NO: 60526 - RNA, 23 nt, Artificial Sequence
  RNA Oligomer
auugaacuccuuggaggaugaag

SEQ ID NO: 60527 - RNA, 23 nt, Artificial Sequence
  RNA Oligomer
uugaaggucgcugguccacaaug

SEQ ID NO: 60528 - RNA, 23 nt, Artificial Sequence
  RNA Oligomer
aacccgauccuuaacgcccuuga

SEQ ID NO: 60529 - RNA, 23 nt, Artificial Sequence
  RNA Oligomer
aaagauagacuugaagaggauac

SEQ ID NO: 60530 - RNA, 23 nt, Artificial Sequence
  RNA Oligomer
uagacuugaagaggauacugaug

SEQ ID NO: 60531 - RNA, 23 nt, Artificial Sequence
  RNA Oligomer
cuugaacuucuuuaucucaaucu

SEQ ID NO: 60532 - RNA, 23 nt, Artificial Sequence
  RNA Oligomer
uuccuuucgcaucacauagaaca

SEQ ID NO: 60533 - RNA, 23 nt, Artificial Sequence
  RNA Oligomer
uuucgcaucacauagaacacaug

SEQ ID NO: 60534 - RNA, 23 nt, Artificial Sequence
  RNA Oligomer
acucagcauuuucaccaaucuuc

SEQ ID NO: 60535 - RNA, 23 nt, Artificial Sequence
  RNA Oligomer
gaaaaguacugacagccacaccu

SEQ ID NO: 60536 - RNA, 23 nt, Artificial Sequence
  RNA Oligomer
aaguaggaaaacccaagaauacc

SEQ ID NO: 60537 - RNA, 23 nt, Artificial Sequence
  RNA Oligomer
gaaaacccaagaauaccaguuac

SEQ ID NO: 60538 - RNA, 23 nt, Artificial Sequence
  RNA Oligomer
aaaacccaagaauaccaguuacu

SEQ ID NO: 60539 - RNA, 23 nt, Artificial Sequence
  RNA Oligomer
uccaacuccuaccgcgauacaga

SEQ ID NO: 60540 - RNA, 23 nt, Artificial Sequence
  RNA Oligomer
uuccaacuccuaccgcgauacag

SEQ ID NO: 60541 - RNA, 23 nt, Artificial Sequence
  RNA Oligomer
auuccaacuccuaccgcgauaca

SEQ ID NO: 60542 - RNA, 23 nt, Artificial Sequence
  RNA Oligomer
cauuccaacuccuaccgcgauac

SEQ ID NO: 60543 - RNA, 23 nt, Artificial Sequence
  RNA Oligomer
ucauuccaacuccuaccgcgaua

SEQ ID NO: 60544 - RNA, 23 nt, Artificial Sequence
  RNA Oligomer
ucaugacagucagcaacaugaua

SEQ ID NO: 60545 - RNA, 23 nt, Artificial Sequence
  RNA Oligomer
aucaugacagucagcaacaugau

SEQ ID NO: 60546 - RNA, 23 nt, Artificial Sequence
  RNA Oligomer
aaucaugacagucagcaacauga

SEQ ID NO: 60547 - RNA, 23 nt, Artificial Sequence
  RNA Oligomer
gaaucaugacagucagcaacaug

SEQ ID NO: 60548 - RNA, 23 nt, Artificial Sequence
  RNA Oligomer
cgaaucaugacagucagcaacau

SEQ ID NO: 60549 - RNA, 23 nt, Artificial Sequence
  RNA Oligomer
cgauacagacccacagagugcca

SEQ ID NO: 60550 - RNA, 23 nt, Artificial Sequence
  RNA Oligomer
gcgauacagacccacagagugcc

SEQ ID NO: 60551 - RNA, 23 nt, Artificial Sequence
  RNA Oligomer
cgcgauacagacccacagagugc

SEQ ID NO: 60552 - RNA, 23 nt, Artificial Sequence
  RNA Oligomer
ccgcgauacagacccacagagug

SEQ ID NO: 60553 - RNA, 23 nt, Artificial Sequence
  RNA Oligomer
accgcgauacagacccacagagu

SEQ ID NO: 60554 - RNA, 23 nt, Artificial Sequence
  RNA Oligomer
gcaccucauuccaacuccuaccg

SEQ ID NO: 60555 - RNA, 23 nt, Artificial Sequence
  RNA Oligomer
ugcaccucauuccaacuccuacc

SEQ ID NO: 60556 - RNA, 23 nt, Artificial Sequence
  RNA Oligomer
cugcaccucauuccaacuccuac

SEQ ID NO: 60557 - RNA, 23 nt, Artificial Sequence
  RNA Oligomer
ccugcaccucauuccaacuccua

SEQ ID NO: 60558 - RNA, 23 nt, Artificial Sequence
  RNA Oligomer
cccugcaccucauuccaacuccu

SEQ ID NO: 60559 - RNA, 23 nt, Artificial Sequence
  RNA Oligomer
ccgaaucaugacagucagcaaca

SEQ ID NO: 60560 - RNA, 23 nt, Artificial Sequence
  RNA Oligomer
cccgaaucaugacagucagcaac

SEQ ID NO: 60561 - RNA, 23 nt, Artificial Sequence
  RNA Oligomer
gcccgaaucaugacagucagcaa

SEQ ID NO: 60562 - RNA, 23 nt, Artificial Sequence
  RNA Oligomer
agcccgaaucaugacagucagca

SEQ ID NO: 60563 - RNA, 23 nt, Artificial Sequence
  RNA Oligomer
cagaggccguauuacaaaugagc

SEQ ID NO: 60564 - RNA, 23 nt, Artificial Sequence
  RNA Oligomer
acagaggccguauuacaaaugag

SEQ ID NO: 60565 - RNA, 23 nt, Artificial Sequence
  RNA Oligomer
cacagaggccguauuacaaauga

SEQ ID NO: 60566 - RNA, 23 nt, Artificial Sequence
  RNA Oligomer
acacagaggccguauuacaaaug

SEQ ID NO: 60567 - RNA, 23 nt, Artificial Sequence
  RNA Oligomer
cacacagaggccguauuacaaau

SEQ ID NO: 60568 - RNA, 23 nt, Artificial Sequence
  RNA Oligomer
acaaaugagcccgaaucaugaca

SEQ ID NO: 60569 - RNA, 23 nt, Artificial Sequence
  RNA Oligomer
uacaaaugagcccgaaucaugac

SEQ ID NO: 60570 - RNA, 23 nt, Artificial Sequence
  RNA Oligomer
uuacaaaugagcccgaaucauga

SEQ ID NO: 60571 - RNA, 23 nt, Artificial Sequence
  RNA Oligomer
auuacaaaugagcccgaaucaug

SEQ ID NO: 60572 - RNA, 23 nt, Artificial Sequence
  RNA Oligomer
uauuacaaaugagcccgaaucau

SEQ ID NO: 60573 - RNA, 23 nt, Artificial Sequence
  RNA Oligomer
guauuacaaaugagcccgaauca

SEQ ID NO: 60574 - RNA, 23 nt, Artificial Sequence
  RNA Oligomer
cguauuacaaaugagcccgaauc

SEQ ID NO: 60575 - RNA, 23 nt, Artificial Sequence
  RNA Oligomer
ccguauuacaaaugagcccgaau

SEQ ID NO: 60576 - RNA, 23 nt, Artificial Sequence
  RNA Oligomer
gccguauuacaaaugagcccgaa

SEQ ID NO: 60577 - RNA, 23 nt, Artificial Sequence
  RNA Oligomer
ggccguauuacaaaugagcccga

SEQ ID NO: 60578 - RNA, 23 nt, Artificial Sequence
  RNA Oligomer
gaggccguauuacaaaugagccc

SEQ ID NO: 60579 - RNA, 23 nt, Artificial Sequence
  RNA Oligomer
agaggccguauuacaaaugagcc

SEQ ID NO: 60580 - RNA, 23 nt, Artificial Sequence
  RNA Oligomer
acacacagaggccguauuacaaa

SEQ ID NO: 60581 - RNA, 23 nt, Artificial Sequence
  RNA Oligomer
aggccguauuacaaaugagcccg

SEQ ID NO: 60582 - RNA, 23 nt, Artificial Sequence
  RNA Oligomer
caccucauuccaacuccuaccgc

SEQ ID NO: 60583 - RNA, 23 nt, Artificial Sequence
  RNA Oligomer
acccugcaccucauuccaacucc

SEQ ID NO: 60584 - RNA, 23 nt, Artificial Sequence
  RNA Oligomer
cacccugcaccucauuccaacuc

SEQ ID NO: 60585 - RNA, 23 nt, Artificial Sequence
  RNA Oligomer
ccacccugcaccucauuccaacu

SEQ ID NO: 60586 - RNA, 23 nt, Artificial Sequence
  RNA Oligomer
cccacccugcaccucauuccaac

SEQ ID NO: 60587 - RNA, 23 nt, Artificial Sequence
  RNA Oligomer
gcccacccugcaccucauuccaa

SEQ ID NO: 60588 - RNA, 23 nt, Artificial Sequence
  RNA Oligomer
ugacagucagcaacaugauaccu

SEQ ID NO: 60589 - RNA, 23 nt, Artificial Sequence
  RNA Oligomer
augacagucagcaacaugauacc

SEQ ID NO: 60590 - RNA, 23 nt, Artificial Sequence
  RNA Oligomer
caugacagucagcaacaugauac

SEQ ID NO: 60591 - RNA, 23 nt, Artificial Sequence
  RNA Oligomer
agaggucggaugucuacagcgac

SEQ ID NO: 60592 - RNA, 23 nt, Artificial Sequence
  RNA Oligomer
cagaggucggaugucuacagcga

SEQ ID NO: 60593 - RNA, 23 nt, Artificial Sequence
  RNA Oligomer
ucagaggucggaugucuacagcg

SEQ ID NO: 60594 - RNA, 23 nt, Artificial Sequence
  RNA Oligomer
gucagaggucggaugucuacagc

SEQ ID NO: 60595 - RNA, 23 nt, Artificial Sequence
  RNA Oligomer
ggucagaggucggaugucuacag

SEQ ID NO: 60596 - RNA, 23 nt, Artificial Sequence
  RNA Oligomer
aacacacagaggccguauuacaa

SEQ ID NO: 60597 - RNA, 23 nt, Artificial Sequence
  RNA Oligomer
caacacacagaggccguauuaca

SEQ ID NO: 60598 - RNA, 23 nt, Artificial Sequence
  RNA Oligomer
ucaacacacagaggccguauuac

SEQ ID NO: 60599 - RNA, 23 nt, Artificial Sequence
  RNA Oligomer
cucaacacacagaggccguauua

SEQ ID NO: 60600 - RNA, 23 nt, Artificial Sequence
  RNA Oligomer
gagcccgaaucaugacagucagc

SEQ ID NO: 60601 - RNA, 23 nt, Artificial Sequence
  RNA Oligomer
ugagcccgaaucaugacagucag

SEQ ID NO: 60602 - RNA, 23 nt, Artificial Sequence
  RNA Oligomer
augagcccgaaucaugacaguca

SEQ ID NO: 60603 - RNA, 23 nt, Artificial Sequence
  RNA Oligomer
gaaacagcguaucacugagaccg

SEQ ID NO: 60604 - RNA, 23 nt, Artificial Sequence
  RNA Oligomer
ggaaacagcguaucacugagacc

SEQ ID NO: 60605 - RNA, 23 nt, Artificial Sequence
  RNA Oligomer
cggaaacagcguaucacugagac

SEQ ID NO: 60606 - RNA, 23 nt, Artificial Sequence
  RNA Oligomer
ccggaaacagcguaucacugaga

SEQ ID NO: 60607 - RNA, 23 nt, Artificial Sequence
  RNA Oligomer
cccggaaacagcguaucacugag

SEQ ID NO: 60608 - RNA, 23 nt, Artificial Sequence
  RNA Oligomer
acagcgaccucaacacacagagg

SEQ ID NO: 60609 - RNA, 23 nt, Artificial Sequence
  RNA Oligomer
uacagcgaccucaacacacagag

SEQ ID NO: 60610 - RNA, 23 nt, Artificial Sequence
  RNA Oligomer
cuacagcgaccucaacacacaga

SEQ ID NO: 60611 - RNA, 23 nt, Artificial Sequence
  RNA Oligomer
ucuacagcgaccucaacacacag

SEQ ID NO: 60612 - RNA, 23 nt, Artificial Sequence
  RNA Oligomer
gucuacagcgaccucaacacaca

SEQ ID NO: 60613 - RNA, 23 nt, Artificial Sequence
  RNA Oligomer
ggugcugacagugcucauugccc

SEQ ID NO: 60614 - RNA, 23 nt, Artificial Sequence
  RNA Oligomer
uggugcugacagugcucauugcc

SEQ ID NO: 60615 - RNA, 23 nt, Artificial Sequence
  RNA Oligomer
cuggugcugacagugcucauugc

SEQ ID NO: 60616 - RNA, 23 nt, Artificial Sequence
  RNA Oligomer
ccuggugcugacagugcucauug

SEQ ID NO: 60617 - RNA, 23 nt, Artificial Sequence
  RNA Oligomer
accuggugcugacagugcucauu

SEQ ID NO: 60618 - RNA, 23 nt, Artificial Sequence
  RNA Oligomer
guaucacugagaccgagucgccu

SEQ ID NO: 60619 - RNA, 23 nt, Artificial Sequence
  RNA Oligomer
cguaucacugagaccgagucgcc

SEQ ID NO: 60620 - RNA, 23 nt, Artificial Sequence
  RNA Oligomer
gcguaucacugagaccgagucgc

SEQ ID NO: 60621 - RNA, 23 nt, Artificial Sequence
  RNA Oligomer
agcguaucacugagaccgagucg

SEQ ID NO: 60622 - RNA, 23 nt, Artificial Sequence
  RNA Oligomer
cagcguaucacugagaccgaguc

SEQ ID NO: 60623 - RNA, 23 nt, Artificial Sequence
  RNA Oligomer
ugagaccgagucgccuuaucagg

SEQ ID NO: 60624 - RNA, 23 nt, Artificial Sequence
  RNA Oligomer
cugagaccgagucgccuuaucag

SEQ ID NO: 60625 - RNA, 23 nt, Artificial Sequence
  RNA Oligomer
acugagaccgagucgccuuauca

SEQ ID NO: 60626 - RNA, 23 nt, Artificial Sequence
  RNA Oligomer
cacugagaccgagucgccuuauc

SEQ ID NO: 60627 - RNA, 23 nt, Artificial Sequence
  RNA Oligomer
ucacugagaccgagucgccuuau

SEQ ID NO: 60628 - RNA, 23 nt, Artificial Sequence
  RNA Oligomer
agcgauugcaguugcucuacggu

SEQ ID NO: 60629 - RNA, 23 nt, Artificial Sequence
  RNA Oligomer
gagcgauugcaguugcucuacgg

SEQ ID NO: 60630 - RNA, 23 nt, Artificial Sequence
  RNA Oligomer
agagcgauugcaguugcucuacg

SEQ ID NO: 60631 - RNA, 23 nt, Artificial Sequence
  RNA Oligomer
cagagcgauugcaguugcucuac

SEQ ID NO: 60632 - RNA, 23 nt, Artificial Sequence
  RNA Oligomer
ccagagcgauugcaguugcucua

SEQ ID NO: 60633 - RNA, 23 nt, Artificial Sequence
  RNA Oligomer
aaugagcccgaaucaugacaguc

SEQ ID NO: 60634 - RNA, 23 nt, Artificial Sequence
  RNA Oligomer
aaaugagcccgaaucaugacagu

SEQ ID NO: 60635 - RNA, 23 nt, Artificial Sequence
  RNA Oligomer
caaaugagcccgaaucaugacag

SEQ ID NO: 60636 - RNA, 23 nt, Artificial Sequence
  RNA Oligomer
acccggaaacagcguaucacuga

SEQ ID NO: 60637 - RNA, 23 nt, Artificial Sequence
  RNA Oligomer
gacccggaaacagcguaucacug

SEQ ID NO: 60638 - RNA, 23 nt, Artificial Sequence
  RNA Oligomer
cgacccggaaacagcguaucacu

SEQ ID NO: 60639 - RNA, 23 nt, Artificial Sequence
  RNA Oligomer
ccucaacacacagaggccguauu

SEQ ID NO: 60640 - RNA, 23 nt, Artificial Sequence
  RNA Oligomer
accucaacacacagaggccguau

SEQ ID NO: 60641 - RNA, 23 nt, Artificial Sequence
  RNA Oligomer
gaccucaacacacagaggccgua

SEQ ID NO: 60642 - RNA, 23 nt, Artificial Sequence
  RNA Oligomer
agcgaccucaacacacagaggcc

SEQ ID NO: 60643 - RNA, 23 nt, Artificial Sequence
  RNA Oligomer
cagcgaccucaacacacagaggc

SEQ ID NO: 60644 - RNA, 23 nt, Artificial Sequence
  RNA Oligomer
ugcaguugcucuacggugagccc

SEQ ID NO: 60645 - RNA, 23 nt, Artificial Sequence
  RNA Oligomer
uugcaguugcucuacggugagcc

SEQ ID NO: 60646 - RNA, 23 nt, Artificial Sequence
  RNA Oligomer
auugcaguugcucuacggugagc

SEQ ID NO: 60647 - RNA, 23 nt, Artificial Sequence
  RNA Oligomer
gauugcaguugcucuacggugag

SEQ ID NO: 60648 - RNA, 23 nt, Artificial Sequence
  RNA Oligomer
cgauugcaguugcucuacgguga

SEQ ID NO: 60649 - RNA, 23 nt, Artificial Sequence
  RNA Oligomer
gcgauugcaguugcucuacggug

SEQ ID NO: 60650 - RNA, 23 nt, Artificial Sequence
  RNA Oligomer
ugacagugcucauugcccuggcc

SEQ ID NO: 60651 - RNA, 23 nt, Artificial Sequence
  RNA Oligomer
cugacagugcucauugcccuggc

SEQ ID NO: 60652 - RNA, 23 nt, Artificial Sequence
  RNA Oligomer
gcugacagugcucauugcccugg

SEQ ID NO: 60653 - RNA, 23 nt, Artificial Sequence
  RNA Oligomer
ugcugacagugcucauugcccug

SEQ ID NO: 60654 - RNA, 23 nt, Artificial Sequence
  RNA Oligomer
gugcugacagugcucauugcccu

SEQ ID NO: 60655 - RNA, 23 nt, Artificial Sequence
  RNA Oligomer
cccagagcgauugcaguugcucu

SEQ ID NO: 60656 - RNA, 23 nt, Artificial Sequence
  RNA Oligomer
gcccagagcgauugcaguugcuc

SEQ ID NO: 60657 - RNA, 23 nt, Artificial Sequence
  RNA Oligomer
ggcccagagcgauugcaguugcu

SEQ ID NO: 60658 - RNA, 23 nt, Artificial Sequence
  RNA Oligomer
cucauuccaacuccuaccgcgau

SEQ ID NO: 60659 - RNA, 23 nt, Artificial Sequence
  RNA Oligomer
ucggaugucuacagcgaccucaa

SEQ ID NO: 60660 - RNA, 23 nt, Artificial Sequence
  RNA Oligomer
ggaugucuacagcgaccucaaca

SEQ ID NO: 60661 - RNA, 23 nt, Artificial Sequence
  RNA Oligomer
ucuguaucgcgguaggaguugga

SEQ ID NO: 60662 - RNA, 23 nt, Artificial Sequence
  RNA Oligomer
cuguaucgcgguaggaguuggaa

SEQ ID NO: 60663 - RNA, 23 nt, Artificial Sequence
  RNA Oligomer
uguaucgcgguaggaguuggaau

SEQ ID NO: 60664 - RNA, 23 nt, Artificial Sequence
  RNA Oligomer
guaucgcgguaggaguuggaaug

SEQ ID NO: 60665 - RNA, 23 nt, Artificial Sequence
  RNA Oligomer
uaucgcgguaggaguuggaauga

SEQ ID NO: 60666 - RNA, 23 nt, Artificial Sequence
  RNA Oligomer
uaucauguugcugacugucauga

SEQ ID NO: 60667 - RNA, 23 nt, Artificial Sequence
  RNA Oligomer
aucauguugcugacugucaugau

SEQ ID NO: 60668 - RNA, 23 nt, Artificial Sequence
  RNA Oligomer
ucauguugcugacugucaugauu

SEQ ID NO: 60669 - RNA, 23 nt, Artificial Sequence
  RNA Oligomer
cauguugcugacugucaugauuc

SEQ ID NO: 60670 - RNA, 23 nt, Artificial Sequence
  RNA Oligomer
auguugcugacugucaugauucg

SEQ ID NO: 60671 - RNA, 23 nt, Artificial Sequence
  RNA Oligomer
uggcacucugugggucuguaucg

SEQ ID NO: 60672 - RNA, 23 nt, Artificial Sequence
  RNA Oligomer
ggcacucugugggucuguaucgc

SEQ ID NO: 60673 - RNA, 23 nt, Artificial Sequence
  RNA Oligomer
gcacucugugggucuguaucgcg

SEQ ID NO: 60674 - RNA, 23 nt, Artificial Sequence
  RNA Oligomer
cacucugugggucuguaucgcgg

SEQ ID NO: 60675 - RNA, 23 nt, Artificial Sequence
  RNA Oligomer
acucugugggucuguaucgcggu

SEQ ID NO: 60676 - RNA, 23 nt, Artificial Sequence
  RNA Oligomer
cgguaggaguuggaaugaggugc

SEQ ID NO: 60677 - RNA, 23 nt, Artificial Sequence
  RNA Oligomer
gguaggaguuggaaugaggugca

SEQ ID NO: 60678 - RNA, 23 nt, Artificial Sequence
  RNA Oligomer
guaggaguuggaaugaggugcag

SEQ ID NO: 60679 - RNA, 23 nt, Artificial Sequence
  RNA Oligomer
uaggaguuggaaugaggugcagg

SEQ ID NO: 60680 - RNA, 23 nt, Artificial Sequence
  RNA Oligomer
aggaguuggaaugaggugcaggg

SEQ ID NO: 60681 - RNA, 23 nt, Artificial Sequence
  RNA Oligomer
uguugcugacugucaugauucgg

SEQ ID NO: 60682 - RNA, 23 nt, Artificial Sequence
  RNA Oligomer
guugcugacugucaugauucggg

SEQ ID NO: 60683 - RNA, 23 nt, Artificial Sequence
  RNA Oligomer
uugcugacugucaugauucgggc

SEQ ID NO: 60684 - RNA, 23 nt, Artificial Sequence
  RNA Oligomer
ugcugacugucaugauucgggcu

SEQ ID NO: 60685 - RNA, 23 nt, Artificial Sequence
  RNA Oligomer
gcucauuuguaauacggccucug

SEQ ID NO: 60686 - RNA, 23 nt, Artificial Sequence
  RNA Oligomer
cucauuuguaauacggccucugu

SEQ ID NO: 60687 - RNA, 23 nt, Artificial Sequence
  RNA Oligomer
ucauuuguaauacggccucugug

SEQ ID NO: 60688 - RNA, 23 nt, Artificial Sequence
  RNA Oligomer
cauuuguaauacggccucugugu

SEQ ID NO: 60689 - RNA, 23 nt, Artificial Sequence
  RNA Oligomer
auuuguaauacggccucugugug

SEQ ID NO: 60690 - RNA, 23 nt, Artificial Sequence
  RNA Oligomer
ugucaugauucgggcucauuugu

SEQ ID NO: 60691 - RNA, 23 nt, Artificial Sequence
  RNA Oligomer
gucaugauucgggcucauuugua

SEQ ID NO: 60692 - RNA, 23 nt, Artificial Sequence
  RNA Oligomer
ucaugauucgggcucauuuguaa

SEQ ID NO: 60693 - RNA, 23 nt, Artificial Sequence
  RNA Oligomer
caugauucgggcucauuuguaau

SEQ ID NO: 60694 - RNA, 23 nt, Artificial Sequence
  RNA Oligomer
augauucgggcucauuuguaaua

SEQ ID NO: 60695 - RNA, 23 nt, Artificial Sequence
  RNA Oligomer
ugauucgggcucauuuguaauac

SEQ ID NO: 60696 - RNA, 23 nt, Artificial Sequence
  RNA Oligomer
gauucgggcucauuuguaauacg

SEQ ID NO: 60697 - RNA, 23 nt, Artificial Sequence
  RNA Oligomer
auucgggcucauuuguaauacgg

SEQ ID NO: 60698 - RNA, 23 nt, Artificial Sequence
  RNA Oligomer
uucgggcucauuuguaauacggc

SEQ ID NO: 60699 - RNA, 23 nt, Artificial Sequence
  RNA Oligomer
ucgggcucauuuguaauacggcc

SEQ ID NO: 60700 - RNA, 23 nt, Artificial Sequence
  RNA Oligomer
gggcucauuuguaauacggccuc

SEQ ID NO: 60701 - RNA, 23 nt, Artificial Sequence
  RNA Oligomer
ggcucauuuguaauacggccucu

SEQ ID NO: 60702 - RNA, 23 nt, Artificial Sequence
  RNA Oligomer
uuuguaauacggccucugugugu

SEQ ID NO: 60703 - RNA, 23 nt, Artificial Sequence
  RNA Oligomer
cgggcucauuuguaauacggccu

SEQ ID NO: 60704 - RNA, 23 nt, Artificial Sequence
  RNA Oligomer
gcgguaggaguuggaaugaggug

SEQ ID NO: 60705 - RNA, 23 nt, Artificial Sequence
  RNA Oligomer
ggaguuggaaugaggugcagggu

SEQ ID NO: 60706 - RNA, 23 nt, Artificial Sequence
  RNA Oligomer
gaguuggaaugaggugcagggug

SEQ ID NO: 60707 - RNA, 23 nt, Artificial Sequence
  RNA Oligomer
aguuggaaugaggugcagggugg

SEQ ID NO: 60708 - RNA, 23 nt, Artificial Sequence
  RNA Oligomer
guuggaaugaggugcaggguggg

SEQ ID NO: 60709 - RNA, 23 nt, Artificial Sequence
  RNA Oligomer
uuggaaugaggugcagggugggc

SEQ ID NO: 60710 - RNA, 23 nt, Artificial Sequence
  RNA Oligomer
agguaucauguugcugacuguca

SEQ ID NO: 60711 - RNA, 23 nt, Artificial Sequence
  RNA Oligomer
gguaucauguugcugacugucau

SEQ ID NO: 60712 - RNA, 23 nt, Artificial Sequence
  RNA Oligomer
guaucauguugcugacugucaug

SEQ ID NO: 60713 - RNA, 23 nt, Artificial Sequence
  RNA Oligomer
gucgcuguagacauccgaccucu

SEQ ID NO: 60714 - RNA, 23 nt, Artificial Sequence
  RNA Oligomer
ucgcuguagacauccgaccucug

SEQ ID NO: 60715 - RNA, 23 nt, Artificial Sequence
  RNA Oligomer
cgcuguagacauccgaccucuga

SEQ ID NO: 60716 - RNA, 23 nt, Artificial Sequence
  RNA Oligomer
gcuguagacauccgaccucugac

SEQ ID NO: 60717 - RNA, 23 nt, Artificial Sequence
  RNA Oligomer
cuguagacauccgaccucugacc

SEQ ID NO: 60718 - RNA, 23 nt, Artificial Sequence
  RNA Oligomer
uuguaauacggccucuguguguu

SEQ ID NO: 60719 - RNA, 23 nt, Artificial Sequence
  RNA Oligomer
uguaauacggccucuguguguug

SEQ ID NO: 60720 - RNA, 23 nt, Artificial Sequence
  RNA Oligomer
guaauacggccucuguguguuga

SEQ ID NO: 60721 - RNA, 23 nt, Artificial Sequence
  RNA Oligomer
uaauacggccucuguguguugag

SEQ ID NO: 60722 - RNA, 23 nt, Artificial Sequence
  RNA Oligomer
gcugacugucaugauucgggcuc

SEQ ID NO: 60723 - RNA, 23 nt, Artificial Sequence
  RNA Oligomer
cugacugucaugauucgggcuca

SEQ ID NO: 60724 - RNA, 23 nt, Artificial Sequence
  RNA Oligomer
ugacugucaugauucgggcucau

SEQ ID NO: 60725 - RNA, 23 nt, Artificial Sequence
  RNA Oligomer
cggucucagugauacgcuguuuc

SEQ ID NO: 60726 - RNA, 23 nt, Artificial Sequence
  RNA Oligomer
ggucucagugauacgcuguuucc

SEQ ID NO: 60727 - RNA, 23 nt, Artificial Sequence
  RNA Oligomer
gucucagugauacgcuguuuccg

SEQ ID NO: 60728 - RNA, 23 nt, Artificial Sequence
  RNA Oligomer
ucucagugauacgcuguuuccgg

SEQ ID NO: 60729 - RNA, 23 nt, Artificial Sequence
  RNA Oligomer
cucagugauacgcuguuuccggg

SEQ ID NO: 60730 - RNA, 23 nt, Artificial Sequence
  RNA Oligomer
ccucuguguguugaggucgcugu

SEQ ID NO: 60731 - RNA, 23 nt, Artificial Sequence
  RNA Oligomer
cucuguguguugaggucgcugua

SEQ ID NO: 60732 - RNA, 23 nt, Artificial Sequence
  RNA Oligomer
ucuguguguugaggucgcuguag

SEQ ID NO: 60733 - RNA, 23 nt, Artificial Sequence
  RNA Oligomer
cuguguguugaggucgcuguaga

SEQ ID NO: 60734 - RNA, 23 nt, Artificial Sequence
  RNA Oligomer
uguguguugaggucgcuguagac

SEQ ID NO: 60735 - RNA, 23 nt, Artificial Sequence
  RNA Oligomer
gggcaaugagcacugucagcacc

SEQ ID NO: 60736 - RNA, 23 nt, Artificial Sequence
  RNA Oligomer
ggcaaugagcacugucagcacca

SEQ ID NO: 60737 - RNA, 23 nt, Artificial Sequence
  RNA Oligomer
gcaaugagcacugucagcaccag

SEQ ID NO: 60738 - RNA, 23 nt, Artificial Sequence
  RNA Oligomer
caaugagcacugucagcaccagg

SEQ ID NO: 60739 - RNA, 23 nt, Artificial Sequence
  RNA Oligomer
aaugagcacugucagcaccaggu

SEQ ID NO: 60740 - RNA, 23 nt, Artificial Sequence
  RNA Oligomer
aggcgacucggucucagugauac

SEQ ID NO: 60741 - RNA, 23 nt, Artificial Sequence
  RNA Oligomer
ggcgacucggucucagugauacg

SEQ ID NO: 60742 - RNA, 23 nt, Artificial Sequence
  RNA Oligomer
gcgacucggucucagugauacgc

SEQ ID NO: 60743 - RNA, 23 nt, Artificial Sequence
  RNA Oligomer
cgacucggucucagugauacgcu

SEQ ID NO: 60744 - RNA, 23 nt, Artificial Sequence
  RNA Oligomer
gacucggucucagugauacgcug

SEQ ID NO: 60745 - RNA, 23 nt, Artificial Sequence
  RNA Oligomer
ccugauaaggcgacucggucuca

SEQ ID NO: 60746 - RNA, 23 nt, Artificial Sequence
  RNA Oligomer
cugauaaggcgacucggucucag

SEQ ID NO: 60747 - RNA, 23 nt, Artificial Sequence
  RNA Oligomer
ugauaaggcgacucggucucagu

SEQ ID NO: 60748 - RNA, 23 nt, Artificial Sequence
  RNA Oligomer
gauaaggcgacucggucucagug

SEQ ID NO: 60749 - RNA, 23 nt, Artificial Sequence
  RNA Oligomer
auaaggcgacucggucucaguga

SEQ ID NO: 60750 - RNA, 23 nt, Artificial Sequence
  RNA Oligomer
accguagagcaacugcaaucgcu

SEQ ID NO: 60751 - RNA, 23 nt, Artificial Sequence
  RNA Oligomer
ccguagagcaacugcaaucgcuc

SEQ ID NO: 60752 - RNA, 23 nt, Artificial Sequence
  RNA Oligomer
cguagagcaacugcaaucgcucu

SEQ ID NO: 60753 - RNA, 23 nt, Artificial Sequence
  RNA Oligomer
guagagcaacugcaaucgcucug

SEQ ID NO: 60754 - RNA, 23 nt, Artificial Sequence
  RNA Oligomer
uagagcaacugcaaucgcucugg

SEQ ID NO: 60755 - RNA, 23 nt, Artificial Sequence
  RNA Oligomer
gacugucaugauucgggcucauu

SEQ ID NO: 60756 - RNA, 23 nt, Artificial Sequence
  RNA Oligomer
acugucaugauucgggcucauuu

SEQ ID NO: 60757 - RNA, 23 nt, Artificial Sequence
  RNA Oligomer
cugucaugauucgggcucauuug

SEQ ID NO: 60758 - RNA, 23 nt, Artificial Sequence
  RNA Oligomer
ucagugauacgcuguuuccgggu

SEQ ID NO: 60759 - RNA, 23 nt, Artificial Sequence
  RNA Oligomer
cagugauacgcuguuuccggguc

SEQ ID NO: 60760 - RNA, 23 nt, Artificial Sequence
  RNA Oligomer
agugauacgcuguuuccgggucg

SEQ ID NO: 60761 - RNA, 23 nt, Artificial Sequence
  RNA Oligomer
aauacggccucuguguguugagg

SEQ ID NO: 60762 - RNA, 23 nt, Artificial Sequence
  RNA Oligomer
auacggccucuguguguugaggu

SEQ ID NO: 60763 - RNA, 23 nt, Artificial Sequence
  RNA Oligomer
uacggccucuguguguugagguc

SEQ ID NO: 60764 - RNA, 23 nt, Artificial Sequence
  RNA Oligomer
ggccucuguguguugaggucgcu

SEQ ID NO: 60765 - RNA, 23 nt, Artificial Sequence
  RNA Oligomer
gccucuguguguugaggucgcug

SEQ ID NO: 60766 - RNA, 23 nt, Artificial Sequence
  RNA Oligomer
gggcucaccguagagcaacugca

SEQ ID NO: 60767 - RNA, 23 nt, Artificial Sequence
  RNA Oligomer
ggcucaccguagagcaacugcaa

SEQ ID NO: 60768 - RNA, 23 nt, Artificial Sequence
  RNA Oligomer
gcucaccguagagcaacugcaau

SEQ ID NO: 60769 - RNA, 23 nt, Artificial Sequence
  RNA Oligomer
cucaccguagagcaacugcaauc

SEQ ID NO: 60770 - RNA, 23 nt, Artificial Sequence
  RNA Oligomer
ucaccguagagcaacugcaaucg

SEQ ID NO: 60771 - RNA, 23 nt, Artificial Sequence
  RNA Oligomer
caccguagagcaacugcaaucgc

SEQ ID NO: 60772 - RNA, 23 nt, Artificial Sequence
  RNA Oligomer
ggccagggcaaugagcacuguca

SEQ ID NO: 60773 - RNA, 23 nt, Artificial Sequence
  RNA Oligomer
gccagggcaaugagcacugucag

SEQ ID NO: 60774 - RNA, 23 nt, Artificial Sequence
  RNA Oligomer
ccagggcaaugagcacugucagc

SEQ ID NO: 60775 - RNA, 23 nt, Artificial Sequence
  RNA Oligomer
cagggcaaugagcacugucagca

SEQ ID NO: 60776 - RNA, 23 nt, Artificial Sequence
  RNA Oligomer
agggcaaugagcacugucagcac

SEQ ID NO: 60777 - RNA, 23 nt, Artificial Sequence
  RNA Oligomer
agagcaacugcaaucgcucuggg

SEQ ID NO: 60778 - RNA, 23 nt, Artificial Sequence
  RNA Oligomer
gagcaacugcaaucgcucugggc

SEQ ID NO: 60779 - RNA, 23 nt, Artificial Sequence
  RNA Oligomer
agcaacugcaaucgcucugggcc

SEQ ID NO: 60780 - RNA, 23 nt, Artificial Sequence
  RNA Oligomer
aucgcgguaggaguuggaaugag

SEQ ID NO: 60781 - RNA, 23 nt, Artificial Sequence
  RNA Oligomer
uugaggucgcuguagacauccga

SEQ ID NO: 60782 - RNA, 23 nt, Artificial Sequence
  RNA Oligomer
uguugaggucgcuguagacaucc

SEQ ID NO: 60783 - RNA, 23 nt, Artificial Sequence
  RNA Oligomer
acaucucauuuuuccguaaaaau

SEQ ID NO: 60784 - RNA, 23 nt, Artificial Sequence
  RNA Oligomer
cacaucucauuuuuccguaaaaa

SEQ ID NO: 60785 - RNA, 23 nt, Artificial Sequence
  RNA Oligomer
ucacaucucauuuuuccguaaaa

SEQ ID NO: 60786 - RNA, 23 nt, Artificial Sequence
  RNA Oligomer
uucacaucucauuuuuccguaaa

SEQ ID NO: 60787 - RNA, 23 nt, Artificial Sequence
  RNA Oligomer
auucacaucucauuuuuccguaa

SEQ ID NO: 60788 - RNA, 23 nt, Artificial Sequence
  RNA Oligomer
acauuaagaagggcaaaaagugc

SEQ ID NO: 60789 - RNA, 23 nt, Artificial Sequence
  RNA Oligomer
aacauuaagaagggcaaaaagug

SEQ ID NO: 60790 - RNA, 23 nt, Artificial Sequence
  RNA Oligomer
gaacauuaagaagggcaaaaagu

SEQ ID NO: 60791 - RNA, 23 nt, Artificial Sequence
  RNA Oligomer
agaacauuaagaagggcaaaaag

SEQ ID NO: 60792 - RNA, 23 nt, Artificial Sequence
  RNA Oligomer
gagaacauuaagaagggcaaaaa

SEQ ID NO: 60793 - RNA, 23 nt, Artificial Sequence
  RNA Oligomer
gcaucuuauacgaguaauaugcc

SEQ ID NO: 60794 - RNA, 23 nt, Artificial Sequence
  RNA Oligomer
agcaucuuauacgaguaauaugc

SEQ ID NO: 60795 - RNA, 23 nt, Artificial Sequence
  RNA Oligomer
uagcaucuuauacgaguaauaug

SEQ ID NO: 60796 - RNA, 23 nt, Artificial Sequence
  RNA Oligomer
auagcaucuuauacgaguaauau

SEQ ID NO: 60797 - RNA, 23 nt, Artificial Sequence
  RNA Oligomer
gauagcaucuuauacgaguaaua

SEQ ID NO: 60798 - RNA, 23 nt, Artificial Sequence
  RNA Oligomer
gcaccagaauguauauuaaggug

SEQ ID NO: 60799 - RNA, 23 nt, Artificial Sequence
  RNA Oligomer
agcaccagaauguauauuaaggu

SEQ ID NO: 60800 - RNA, 23 nt, Artificial Sequence
  RNA Oligomer
cagcaccagaauguauauuaagg

SEQ ID NO: 60801 - RNA, 23 nt, Artificial Sequence
  RNA Oligomer
acagcaccagaauguauauuaag

SEQ ID NO: 60802 - RNA, 23 nt, Artificial Sequence
  RNA Oligomer
cacagcaccagaauguauauuaa

SEQ ID NO: 60803 - RNA, 23 nt, Artificial Sequence
  RNA Oligomer
gauucacaucucauuuuuccgua

SEQ ID NO: 60804 - RNA, 23 nt, Artificial Sequence
  RNA Oligomer
cgaguaauaugccugcuauuuga

SEQ ID NO: 60805 - RNA, 23 nt, Artificial Sequence
  RNA Oligomer
acgaguaauaugccugcuauuug

SEQ ID NO: 60806 - RNA, 23 nt, Artificial Sequence
  RNA Oligomer
uacgaguaauaugccugcuauuu

SEQ ID NO: 60807 - RNA, 23 nt, Artificial Sequence
  RNA Oligomer
auacgaguaauaugccugcuauu

SEQ ID NO: 60808 - RNA, 23 nt, Artificial Sequence
  RNA Oligomer
uauacgaguaauaugccugcuau

SEQ ID NO: 60809 - RNA, 23 nt, Artificial Sequence
  RNA Oligomer
ggaaaauuuuagcgugcucacug

SEQ ID NO: 60810 - RNA, 23 nt, Artificial Sequence
  RNA Oligomer
aggaaaauuuuagcgugcucacu

SEQ ID NO: 60811 - RNA, 23 nt, Artificial Sequence
  RNA Oligomer
aaggaaaauuuuagcgugcucac

SEQ ID NO: 60812 - RNA, 23 nt, Artificial Sequence
  RNA Oligomer
gaaggaaaauuuuagcgugcuca

SEQ ID NO: 60813 - RNA, 23 nt, Artificial Sequence
  RNA Oligomer
agaaggaaaauuuuagcgugcuc

SEQ ID NO: 60814 - RNA, 23 nt, Artificial Sequence
  RNA Oligomer
caucucauuuuuccguaaaaaug

SEQ ID NO: 60815 - RNA, 23 nt, Artificial Sequence
  RNA Oligomer
ugauucacaucucauuuuuccgu

SEQ ID NO: 60816 - RNA, 23 nt, Artificial Sequence
  RNA Oligomer
agagaacauuaagaagggcaaaa

SEQ ID NO: 60817 - RNA, 23 nt, Artificial Sequence
  RNA Oligomer
aagagaacauuaagaagggcaaa

SEQ ID NO: 60818 - RNA, 23 nt, Artificial Sequence
  RNA Oligomer
gaagagaacauuaagaagggcaa

SEQ ID NO: 60819 - RNA, 23 nt, Artificial Sequence
  RNA Oligomer
gugacucuauauagcugaucagu

SEQ ID NO: 60820 - RNA, 23 nt, Artificial Sequence
  RNA Oligomer
agugacucuauauagcugaucag

SEQ ID NO: 60821 - RNA, 23 nt, Artificial Sequence
  RNA Oligomer
gagugacucuauauagcugauca

SEQ ID NO: 60822 - RNA, 23 nt, Artificial Sequence
  RNA Oligomer
ugagugacucuauauagcugauc

SEQ ID NO: 60823 - RNA, 23 nt, Artificial Sequence
  RNA Oligomer
cugagugacucuauauagcugau

SEQ ID NO: 60824 - RNA, 23 nt, Artificial Sequence
  RNA Oligomer
cucaauuucugaacaccauaggu

SEQ ID NO: 60825 - RNA, 23 nt, Artificial Sequence
  RNA Oligomer
ccucaauuucugaacaccauagg

SEQ ID NO: 60826 - RNA, 23 nt, Artificial Sequence
  RNA Oligomer
gccucaauuucugaacaccauag

SEQ ID NO: 60827 - RNA, 23 nt, Artificial Sequence
  RNA Oligomer
agccucaauuucugaacaccaua

SEQ ID NO: 60828 - RNA, 23 nt, Artificial Sequence
  RNA Oligomer
uagccucaauuucugaacaccau

SEQ ID NO: 60829 - RNA, 23 nt, Artificial Sequence
  RNA Oligomer
gcagaaagguuaguaucaucaga

SEQ ID NO: 60830 - RNA, 23 nt, Artificial Sequence
  RNA Oligomer
agcagaaagguuaguaucaucag

SEQ ID NO: 60831 - RNA, 23 nt, Artificial Sequence
  RNA Oligomer
cagcagaaagguuaguaucauca

SEQ ID NO: 60832 - RNA, 23 nt, Artificial Sequence
  RNA Oligomer
ccagcagaaagguuaguaucauc

SEQ ID NO: 60833 - RNA, 23 nt, Artificial Sequence
  RNA Oligomer
accagcagaaagguuaguaucau

SEQ ID NO: 60834 - RNA, 23 nt, Artificial Sequence
  RNA Oligomer
agacuugacaguggaacuacauu

SEQ ID NO: 60835 - RNA, 23 nt, Artificial Sequence
  RNA Oligomer
aagacuugacaguggaacuacau

SEQ ID NO: 60836 - RNA, 23 nt, Artificial Sequence
  RNA Oligomer
uaagacuugacaguggaacuaca

SEQ ID NO: 60837 - RNA, 23 nt, Artificial Sequence
  RNA Oligomer
uuaagacuugacaguggaacuac

SEQ ID NO: 60838 - RNA, 23 nt, Artificial Sequence
  RNA Oligomer
guuaagacuugacaguggaacua

SEQ ID NO: 60839 - RNA, 23 nt, Artificial Sequence
  RNA Oligomer
ccacccaauucaaaacauugugc

SEQ ID NO: 60840 - RNA, 23 nt, Artificial Sequence
  RNA Oligomer
cccacccaauucaaaacauugug

SEQ ID NO: 60841 - RNA, 23 nt, Artificial Sequence
  RNA Oligomer
ucccacccaauucaaaacauugu

SEQ ID NO: 60842 - RNA, 23 nt, Artificial Sequence
  RNA Oligomer
uucccacccaauucaaaacauug

SEQ ID NO: 60843 - RNA, 23 nt, Artificial Sequence
  RNA Oligomer
auucccacccaauucaaaacauu

SEQ ID NO: 60844 - RNA, 23 nt, Artificial Sequence
  RNA Oligomer
gcauuuguuucuacuuugauaug

SEQ ID NO: 60845 - RNA, 23 nt, Artificial Sequence
  RNA Oligomer
agcauuuguuucuacuuugauau

SEQ ID NO: 60846 - RNA, 23 nt, Artificial Sequence
  RNA Oligomer
aagcauuuguuucuacuuugaua

SEQ ID NO: 60847 - RNA, 23 nt, Artificial Sequence
  RNA Oligomer
gaagcauuuguuucuacuuugau

SEQ ID NO: 60848 - RNA, 23 nt, Artificial Sequence
  RNA Oligomer
ggaagcauuuguuucuacuuuga

SEQ ID NO: 60849 - RNA, 23 nt, Artificial Sequence
  RNA Oligomer
cuauauagcugaucaguuuuuuc

SEQ ID NO: 60850 - RNA, 23 nt, Artificial Sequence
  RNA Oligomer
ucuauauagcugaucaguuuuuu

SEQ ID NO: 60851 - RNA, 23 nt, Artificial Sequence
  RNA Oligomer
cucuauauagcugaucaguuuuu

SEQ ID NO: 60852 - RNA, 23 nt, Artificial Sequence
  RNA Oligomer
acucuauauagcugaucaguuuu

SEQ ID NO: 60853 - RNA, 23 nt, Artificial Sequence
  RNA Oligomer
gacucuauauagcugaucaguuu

SEQ ID NO: 60854 - RNA, 23 nt, Artificial Sequence
  RNA Oligomer
agauagcaucuuauacgaguaau

SEQ ID NO: 60855 - RNA, 23 nt, Artificial Sequence
  RNA Oligomer
ccagaauguauauuaaggugugg

SEQ ID NO: 60856 - RNA, 23 nt, Artificial Sequence
  RNA Oligomer
accagaauguauauuaaggugug

SEQ ID NO: 60857 - RNA, 23 nt, Artificial Sequence
  RNA Oligomer
caccagaauguauauuaaggugu

SEQ ID NO: 60858 - RNA, 23 nt, Artificial Sequence
  RNA Oligomer
acacagcaccagaauguauauua

SEQ ID NO: 60859 - RNA, 23 nt, Artificial Sequence
  RNA Oligomer
gauucccacccaauucaaaacau

SEQ ID NO: 60860 - RNA, 23 nt, Artificial Sequence
  RNA Oligomer
agccagagagugagagacauuaa

SEQ ID NO: 60861 - RNA, 23 nt, Artificial Sequence
  RNA Oligomer
aagccagagagugagagacauua

SEQ ID NO: 60862 - RNA, 23 nt, Artificial Sequence
  RNA Oligomer
gaagccagagagugagagacauu

SEQ ID NO: 60863 - RNA, 23 nt, Artificial Sequence
  RNA Oligomer
ugaagccagagagugagagacau

SEQ ID NO: 60864 - RNA, 23 nt, Artificial Sequence
  RNA Oligomer
ccgacuggaagacacguuuggcc

SEQ ID NO: 60865 - RNA, 23 nt, Artificial Sequence
  RNA Oligomer
accgacuggaagacacguuuggc

SEQ ID NO: 60866 - RNA, 23 nt, Artificial Sequence
  RNA Oligomer
uaccgacuggaagacacguuugg

SEQ ID NO: 60867 - RNA, 23 nt, Artificial Sequence
  RNA Oligomer
uuaccgacuggaagacacguuug

SEQ ID NO: 60868 - RNA, 23 nt, Artificial Sequence
  RNA Oligomer
cuuaccgacuggaagacacguuu

SEQ ID NO: 60869 - RNA, 23 nt, Artificial Sequence
  RNA Oligomer
ggaagauguacggagacauggca

SEQ ID NO: 60870 - RNA, 23 nt, Artificial Sequence
  RNA Oligomer
aggaagauguacggagacauggc

SEQ ID NO: 60871 - RNA, 23 nt, Artificial Sequence
  RNA Oligomer
caggaagauguacggagacaugg

SEQ ID NO: 60872 - RNA, 23 nt, Artificial Sequence
  RNA Oligomer
acaggaagauguacggagacaug

SEQ ID NO: 60873 - RNA, 23 nt, Artificial Sequence
  RNA Oligomer
uacaggaagauguacggagacau

SEQ ID NO: 60874 - RNA, 23 nt, Artificial Sequence
  RNA Oligomer
gaccaaaaguuacauguuugcac

SEQ ID NO: 60875 - RNA, 23 nt, Artificial Sequence
  RNA Oligomer
ugaccaaaaguuacauguuugca

SEQ ID NO: 60876 - RNA, 23 nt, Artificial Sequence
  RNA Oligomer
gugaccaaaaguuacauguuugc

SEQ ID NO: 60877 - RNA, 23 nt, Artificial Sequence
  RNA Oligomer
ugugaccaaaaguuacauguuug

SEQ ID NO: 60878 - RNA, 23 nt, Artificial Sequence
  RNA Oligomer
gugugaccaaaaguuacauguuu

SEQ ID NO: 60879 - RNA, 23 nt, Artificial Sequence
  RNA Oligomer
ugacucuauauagcugaucaguu

SEQ ID NO: 60880 - RNA, 23 nt, Artificial Sequence
  RNA Oligomer
accuggaagagaacauuaagaag

SEQ ID NO: 60881 - RNA, 23 nt, Artificial Sequence
  RNA Oligomer
gaccuggaagagaacauuaagaa

SEQ ID NO: 60882 - RNA, 23 nt, Artificial Sequence
  RNA Oligomer
ugaccuggaagagaacauuaaga

SEQ ID NO: 60883 - RNA, 23 nt, Artificial Sequence
  RNA Oligomer
cugaccuggaagagaacauuaag

SEQ ID NO: 60884 - RNA, 23 nt, Artificial Sequence
  RNA Oligomer
gcugaccuggaagagaacauuaa

SEQ ID NO: 60885 - RNA, 23 nt, Artificial Sequence
  RNA Oligomer
ucaauguuagccucaauuucuga

SEQ ID NO: 60886 - RNA, 23 nt, Artificial Sequence
  RNA Oligomer
uucaauguuagccucaauuucug

SEQ ID NO: 60887 - RNA, 23 nt, Artificial Sequence
  RNA Oligomer
uuucaauguuagccucaauuucu

SEQ ID NO: 60888 - RNA, 23 nt, Artificial Sequence
  RNA Oligomer
auuucaauguuagccucaauuuc

SEQ ID NO: 60889 - RNA, 23 nt, Artificial Sequence
  RNA Oligomer
uauuucaauguuagccucaauuu

SEQ ID NO: 60890 - RNA, 23 nt, Artificial Sequence
  RNA Oligomer
ugauucgaaugacacuguucagg

SEQ ID NO: 60891 - RNA, 23 nt, Artificial Sequence
  RNA Oligomer
cugauucgaaugacacuguucag

SEQ ID NO: 60892 - RNA, 23 nt, Artificial Sequence
  RNA Oligomer
ucugauucgaaugacacuguuca

SEQ ID NO: 60893 - RNA, 23 nt, Artificial Sequence
  RNA Oligomer
uucugauucgaaugacacuguuc

SEQ ID NO: 60894 - RNA, 23 nt, Artificial Sequence
  RNA Oligomer
auucugauucgaaugacacuguu

SEQ ID NO: 60895 - RNA, 23 nt, Artificial Sequence
  RNA Oligomer
gaaguguaauugagaaggaaaau

SEQ ID NO: 60896 - RNA, 23 nt, Artificial Sequence
  RNA Oligomer
ugaaguguaauugagaaggaaaa

SEQ ID NO: 60897 - RNA, 23 nt, Artificial Sequence
  RNA Oligomer
uugaaguguaauugagaaggaaa

SEQ ID NO: 60898 - RNA, 23 nt, Artificial Sequence
  RNA Oligomer
uuugaaguguaauugagaaggaa

SEQ ID NO: 60899 - RNA, 23 nt, Artificial Sequence
  RNA Oligomer
auuugaaguguaauugagaagga

SEQ ID NO: 60900 - RNA, 23 nt, Artificial Sequence
  RNA Oligomer
gccugcuauuugaaguguaauug

SEQ ID NO: 60901 - RNA, 23 nt, Artificial Sequence
  RNA Oligomer
ugccugcuauuugaaguguaauu

SEQ ID NO: 60902 - RNA, 23 nt, Artificial Sequence
  RNA Oligomer
augccugcuauuugaaguguaau

SEQ ID NO: 60903 - RNA, 23 nt, Artificial Sequence
  RNA Oligomer
uaugccugcuauuugaaguguaa

SEQ ID NO: 60904 - RNA, 23 nt, Artificial Sequence
  RNA Oligomer
auaugccugcuauuugaagugua

SEQ ID NO: 60905 - RNA, 23 nt, Artificial Sequence
  RNA Oligomer
uuauacgaguaauaugccugcua

SEQ ID NO: 60906 - RNA, 23 nt, Artificial Sequence
  RNA Oligomer
ugacaguggaacuacauuaguac

SEQ ID NO: 60907 - RNA, 23 nt, Artificial Sequence
  RNA Oligomer
uugacaguggaacuacauuagua

SEQ ID NO: 60908 - RNA, 23 nt, Artificial Sequence
  RNA Oligomer
cuugacaguggaacuacauuagu

SEQ ID NO: 60909 - RNA, 23 nt, Artificial Sequence
  RNA Oligomer
acuugacaguggaacuacauuag

SEQ ID NO: 60910 - RNA, 23 nt, Artificial Sequence
  RNA Oligomer
gacuugacaguggaacuacauua

SEQ ID NO: 60911 - RNA, 23 nt, Artificial Sequence
  RNA Oligomer
ccaugucaaacaaauagucuauc

SEQ ID NO: 60912 - RNA, 23 nt, Artificial Sequence
  RNA Oligomer
gccaugucaaacaaauagucuau

SEQ ID NO: 60913 - RNA, 23 nt, Artificial Sequence
  RNA Oligomer
ugccaugucaaacaaauagucua

SEQ ID NO: 60914 - RNA, 23 nt, Artificial Sequence
  RNA Oligomer
gugccaugucaaacaaauagucu

SEQ ID NO: 60915 - RNA, 23 nt, Artificial Sequence
  RNA Oligomer
ugugccaugucaaacaaauaguc

SEQ ID NO: 60916 - RNA, 23 nt, Artificial Sequence
  RNA Oligomer
uugugccaugucaaacaaauagu

SEQ ID NO: 60917 - RNA, 23 nt, Artificial Sequence
  RNA Oligomer
ccagacccaacuaugauuagagc

SEQ ID NO: 60918 - RNA, 23 nt, Artificial Sequence
  RNA Oligomer
cccagacccaacuaugauuagag

SEQ ID NO: 60919 - RNA, 23 nt, Artificial Sequence
  RNA Oligomer
gcccagacccaacuaugauuaga

SEQ ID NO: 60920 - RNA, 23 nt, Artificial Sequence
  RNA Oligomer
ggcccagacccaacuaugauuag

SEQ ID NO: 60921 - RNA, 23 nt, Artificial Sequence
  RNA Oligomer
uggcccagacccaacuaugauua

SEQ ID NO: 60922 - RNA, 23 nt, Artificial Sequence
  RNA Oligomer
ccagagagugagagacauuaacu

SEQ ID NO: 60923 - RNA, 23 nt, Artificial Sequence
  RNA Oligomer
ugaagaagaacaugauguucauc

SEQ ID NO: 60924 - RNA, 23 nt, Artificial Sequence
  RNA Oligomer
augaagaagaacaugauguucau

SEQ ID NO: 60925 - RNA, 23 nt, Artificial Sequence
  RNA Oligomer
caugaagaagaacaugauguuca

SEQ ID NO: 60926 - RNA, 23 nt, Artificial Sequence
  RNA Oligomer
ucaugaagaagaacaugauguuc

SEQ ID NO: 60927 - RNA, 23 nt, Artificial Sequence
  RNA Oligomer
gucaugaagaagaacaugauguu

SEQ ID NO: 60928 - RNA, 23 nt, Artificial Sequence
  RNA Oligomer
gcuaaauucuguggaguauguac

SEQ ID NO: 60929 - RNA, 23 nt, Artificial Sequence
  RNA Oligomer
agcuaaauucuguggaguaugua

SEQ ID NO: 60930 - RNA, 23 nt, Artificial Sequence
  RNA Oligomer
gagcuaaauucuguggaguaugu

SEQ ID NO: 60931 - RNA, 23 nt, Artificial Sequence
  RNA Oligomer
cgagcuaaauucuguggaguaug

SEQ ID NO: 60932 - RNA, 23 nt, Artificial Sequence
  RNA Oligomer
ccgagcuaaauucuguggaguau

SEQ ID NO: 60933 - RNA, 23 nt, Artificial Sequence
  RNA Oligomer
accgagcuaaauucuguggagua

SEQ ID NO: 60934 - RNA, 23 nt, Artificial Sequence
  RNA Oligomer
uaccgagcuaaauucuguggagu

SEQ ID NO: 60935 - RNA, 23 nt, Artificial Sequence
  RNA Oligomer
auaccgagcuaaauucuguggag

SEQ ID NO: 60936 - RNA, 23 nt, Artificial Sequence
  RNA Oligomer
gcaggcugauuucuagguaggaa

SEQ ID NO: 60937 - RNA, 23 nt, Artificial Sequence
  RNA Oligomer
ggcaggcugauuucuagguagga

SEQ ID NO: 60938 - RNA, 23 nt, Artificial Sequence
  RNA Oligomer
uggcaggcugauuucuagguagg

SEQ ID NO: 60939 - RNA, 23 nt, Artificial Sequence
  RNA Oligomer
uuggcaggcugauuucuagguag

SEQ ID NO: 60940 - RNA, 23 nt, Artificial Sequence
  RNA Oligomer
cuuggcaggcugauuucuaggua

SEQ ID NO: 60941 - RNA, 23 nt, Artificial Sequence
  RNA Oligomer
accauagguagaauguaaagcuu

SEQ ID NO: 60942 - RNA, 23 nt, Artificial Sequence
  RNA Oligomer
caccauagguagaauguaaagcu

SEQ ID NO: 60943 - RNA, 23 nt, Artificial Sequence
  RNA Oligomer
acaccauagguagaauguaaagc

SEQ ID NO: 60944 - RNA, 23 nt, Artificial Sequence
  RNA Oligomer
aacaccauagguagaauguaaag

SEQ ID NO: 60945 - RNA, 23 nt, Artificial Sequence
  RNA Oligomer
gaacaccauagguagaauguaaa

SEQ ID NO: 60946 - RNA, 23 nt, Artificial Sequence
  RNA Oligomer
ucaauuucugaacaccauaggua

SEQ ID NO: 60947 - RNA, 23 nt, Artificial Sequence
  RNA Oligomer
auauuucaauguuagccucaauu

SEQ ID NO: 60948 - RNA, 23 nt, Artificial Sequence
  RNA Oligomer
aguuguuugugccuuuuuauuuu

SEQ ID NO: 60949 - RNA, 23 nt, Artificial Sequence
  RNA Oligomer
aaguuguuugugccuuuuuauuu

SEQ ID NO: 60950 - RNA, 23 nt, Artificial Sequence
  RNA Oligomer
aaaguuguuugugccuuuuuauu

SEQ ID NO: 60951 - RNA, 23 nt, Artificial Sequence
  RNA Oligomer
uaaaguuguuugugccuuuuuau

SEQ ID NO: 60952 - RNA, 23 nt, Artificial Sequence
  RNA Oligomer
uuaaaguuguuugugccuuuuua

SEQ ID NO: 60953 - RNA, 23 nt, Artificial Sequence
  RNA Oligomer
gagaaggaaaauuuuagcgugcu

SEQ ID NO: 60954 - RNA, 23 nt, Artificial Sequence
  RNA Oligomer
ccugcuauuugaaguguaauuga

SEQ ID NO: 60955 - RNA, 23 nt, Artificial Sequence
  RNA Oligomer
uacacagcaccagaauguauauu

SEQ ID NO: 60956 - RNA, 23 nt, Artificial Sequence
  RNA Oligomer
guacacagcaccagaauguauau

SEQ ID NO: 60957 - RNA, 23 nt, Artificial Sequence
  RNA Oligomer
aguacacagcaccagaauguaua

SEQ ID NO: 60958 - RNA, 23 nt, Artificial Sequence
  RNA Oligomer
gacauuaacucauuagacuggaa

SEQ ID NO: 60959 - RNA, 23 nt, Artificial Sequence
  RNA Oligomer
agacauuaacucauuagacugga

SEQ ID NO: 60960 - RNA, 23 nt, Artificial Sequence
  RNA Oligomer
gagacauuaacucauuagacugg

SEQ ID NO: 60961 - RNA, 23 nt, Artificial Sequence
  RNA Oligomer
agagacauuaacucauuagacug

SEQ ID NO: 60962 - RNA, 23 nt, Artificial Sequence
  RNA Oligomer
gagagacauuaacucauuagacu

SEQ ID NO: 60963 - RNA, 23 nt, Artificial Sequence
  RNA Oligomer
agagagugagagacauuaacuca

SEQ ID NO: 60964 - RNA, 23 nt, Artificial Sequence
  RNA Oligomer
cagagagugagagacauuaacuc

SEQ ID NO: 60965 - RNA, 23 nt, Artificial Sequence
  RNA Oligomer
gcgaggucaugaagaagaacaug

SEQ ID NO: 60966 - RNA, 23 nt, Artificial Sequence
  RNA Oligomer
ggcgaggucaugaagaagaacau

SEQ ID NO: 60967 - RNA, 23 nt, Artificial Sequence
  RNA Oligomer
cggcgaggucaugaagaagaaca

SEQ ID NO: 60968 - RNA, 23 nt, Artificial Sequence
  RNA Oligomer
acggcgaggucaugaagaagaac

SEQ ID NO: 60969 - RNA, 23 nt, Artificial Sequence
  RNA Oligomer
gacggcgaggucaugaagaagaa

SEQ ID NO: 60970 - RNA, 23 nt, Artificial Sequence
  RNA Oligomer
acugagugacucuauauagcuga

SEQ ID NO: 60971 - RNA, 23 nt, Artificial Sequence
  RNA Oligomer
aacugagugacucuauauagcug

SEQ ID NO: 60972 - RNA, 23 nt, Artificial Sequence
  RNA Oligomer
augaacaaauggccuuuauuaaa

SEQ ID NO: 60973 - RNA, 23 nt, Artificial Sequence
  RNA Oligomer
aaugaacaaauggccuuuauuaa

SEQ ID NO: 60974 - RNA, 23 nt, Artificial Sequence
  RNA Oligomer
uaaugaacaaauggccuuuauua

SEQ ID NO: 60975 - RNA, 23 nt, Artificial Sequence
  RNA Oligomer
uuaaugaacaaauggccuuuauu

SEQ ID NO: 60976 - RNA, 23 nt, Artificial Sequence
  RNA Oligomer
uuuaaugaacaaauggccuuuau

SEQ ID NO: 60977 - RNA, 23 nt, Artificial Sequence
  RNA Oligomer
ggaagagaacauuaagaagggca

SEQ ID NO: 60978 - RNA, 23 nt, Artificial Sequence
  RNA Oligomer
caauuucugaacaccauagguag

SEQ ID NO: 60979 - RNA, 23 nt, Artificial Sequence
  RNA Oligomer
gauauuucaauguuagccucaau

SEQ ID NO: 60980 - RNA, 23 nt, Artificial Sequence
  RNA Oligomer
gcauucuccagccaucaagagac

SEQ ID NO: 60981 - RNA, 23 nt, Artificial Sequence
  RNA Oligomer
ugcauucuccagccaucaagaga

SEQ ID NO: 60982 - RNA, 23 nt, Artificial Sequence
  RNA Oligomer
gugcauucuccagccaucaagag

SEQ ID NO: 60983 - RNA, 23 nt, Artificial Sequence
  RNA Oligomer
ugugcauucuccagccaucaaga

SEQ ID NO: 60984 - RNA, 23 nt, Artificial Sequence
  RNA Oligomer
augugcauucuccagccaucaag

SEQ ID NO: 60985 - RNA, 23 nt, Artificial Sequence
  RNA Oligomer
gaaaauuuuagcgugcucacuga

SEQ ID NO: 60986 - RNA, 23 nt, Artificial Sequence
  RNA Oligomer
ugagaaggaaaauuuuagcgugc

SEQ ID NO: 60987 - RNA, 23 nt, Artificial Sequence
  RNA Oligomer
cagauagcaucuuauacgaguaa

SEQ ID NO: 60988 - RNA, 23 nt, Artificial Sequence
  RNA Oligomer
ugaagaauguuaagacuugacag

SEQ ID NO: 60989 - RNA, 23 nt, Artificial Sequence
  RNA Oligomer
uugaagaauguuaagacuugaca

SEQ ID NO: 60990 - RNA, 23 nt, Artificial Sequence
  RNA Oligomer
uuugaagaauguuaagacuugac

SEQ ID NO: 60991 - RNA, 23 nt, Artificial Sequence
  RNA Oligomer
guuugaagaauguuaagacuuga

SEQ ID NO: 60992 - RNA, 23 nt, Artificial Sequence
  RNA Oligomer
gguuugaagaauguuaagacuug

SEQ ID NO: 60993 - RNA, 23 nt, Artificial Sequence
  RNA Oligomer
uuggcccagacccaacuaugauu

SEQ ID NO: 60994 - RNA, 23 nt, Artificial Sequence
  RNA Oligomer
gacuggaacuugaacugauucac

SEQ ID NO: 60995 - RNA, 23 nt, Artificial Sequence
  RNA Oligomer
agacuggaacuugaacugauuca

SEQ ID NO: 60996 - RNA, 23 nt, Artificial Sequence
  RNA Oligomer
uagacuggaacuugaacugauuc

SEQ ID NO: 60997 - RNA, 23 nt, Artificial Sequence
  RNA Oligomer
uuagacuggaacuugaacugauu

SEQ ID NO: 60998 - RNA, 23 nt, Artificial Sequence
  RNA Oligomer
auuagacuggaacuugaacugau

SEQ ID NO: 60999 - RNA, 23 nt, Artificial Sequence
  RNA Oligomer
ugagagacauuaacucauuagac

SEQ ID NO: 61000 - RNA, 23 nt, Artificial Sequence
  RNA Oligomer
cuacaggaagauguacggagaca

SEQ ID NO: 61001 - RNA, 23 nt, Artificial Sequence
  RNA Oligomer
acuacaggaagauguacggagac

SEQ ID NO: 61002 - RNA, 23 nt, Artificial Sequence
  RNA Oligomer
uacuacaggaagauguacggaga

SEQ ID NO: 61003 - RNA, 23 nt, Artificial Sequence
  RNA Oligomer
cauaccgagcuaaauucugugga

SEQ ID NO: 61004 - RNA, 23 nt, Artificial Sequence
  RNA Oligomer
ugaagacauaccgagcuaaauuc

SEQ ID NO: 61005 - RNA, 23 nt, Artificial Sequence
  RNA Oligomer
augaagacauaccgagcuaaauu

SEQ ID NO: 61006 - RNA, 23 nt, Artificial Sequence
  RNA Oligomer
caugaagacauaccgagcuaaau

SEQ ID NO: 61007 - RNA, 23 nt, Artificial Sequence
  RNA Oligomer
gcaugaagacauaccgagcuaaa

SEQ ID NO: 61008 - RNA, 23 nt, Artificial Sequence
  RNA Oligomer
agcaugaagacauaccgagcuaa

SEQ ID NO: 61009 - RNA, 23 nt, Artificial Sequence
  RNA Oligomer
ccuaucaaguuugagcuuucugg

SEQ ID NO: 61010 - RNA, 23 nt, Artificial Sequence
  RNA Oligomer
gccuaucaaguuugagcuuucug

SEQ ID NO: 61011 - RNA, 23 nt, Artificial Sequence
  RNA Oligomer
agccuaucaaguuugagcuuucu

SEQ ID NO: 61012 - RNA, 23 nt, Artificial Sequence
  RNA Oligomer
aagccuaucaaguuugagcuuuc

SEQ ID NO: 61013 - RNA, 23 nt, Artificial Sequence
  RNA Oligomer
caagccuaucaaguuugagcuuu

SEQ ID NO: 61014 - RNA, 23 nt, Artificial Sequence
  RNA Oligomer
ccaaaaucuccaagccuaucaag

SEQ ID NO: 61015 - RNA, 23 nt, Artificial Sequence
  RNA Oligomer
cccaaaaucuccaagccuaucaa

SEQ ID NO: 61016 - RNA, 23 nt, Artificial Sequence
  RNA Oligomer
ucccaaaaucuccaagccuauca

SEQ ID NO: 61017 - RNA, 23 nt, Artificial Sequence
  RNA Oligomer
cucccaaaaucuccaagccuauc

SEQ ID NO: 61018 - RNA, 23 nt, Artificial Sequence
  RNA Oligomer
acucccaaaaucuccaagccuau

SEQ ID NO: 61019 - RNA, 23 nt, Artificial Sequence
  RNA Oligomer
cuacuuugauaugacuguuuuuc

SEQ ID NO: 61020 - RNA, 23 nt, Artificial Sequence
  RNA Oligomer
ucuacuuugauaugacuguuuuu

SEQ ID NO: 61021 - RNA, 23 nt, Artificial Sequence
  RNA Oligomer
uucuacuuugauaugacuguuuu

SEQ ID NO: 61022 - RNA, 23 nt, Artificial Sequence
  RNA Oligomer
uuucuacuuugauaugacuguuu

SEQ ID NO: 61023 - RNA, 23 nt, Artificial Sequence
  RNA Oligomer
guuucuacuuugauaugacuguu

SEQ ID NO: 61024 - RNA, 23 nt, Artificial Sequence
  RNA Oligomer
gcaugaaauggauacuuauaugg

SEQ ID NO: 61025 - RNA, 23 nt, Artificial Sequence
  RNA Oligomer
agcaugaaauggauacuuauaug

SEQ ID NO: 61026 - RNA, 23 nt, Artificial Sequence
  RNA Oligomer
aagcaugaaauggauacuuauau

SEQ ID NO: 61027 - RNA, 23 nt, Artificial Sequence
  RNA Oligomer
aaagcaugaaauggauacuuaua

SEQ ID NO: 61028 - RNA, 23 nt, Artificial Sequence
  RNA Oligomer
caaagcaugaaauggauacuuau

SEQ ID NO: 61029 - RNA, 23 nt, Artificial Sequence
  RNA Oligomer
uaaagcuugucugaucguucaaa

SEQ ID NO: 61030 - RNA, 23 nt, Artificial Sequence
  RNA Oligomer
guaaagcuugucugaucguucaa

SEQ ID NO: 61031 - RNA, 23 nt, Artificial Sequence
  RNA Oligomer
uguaaagcuugucugaucguuca

SEQ ID NO: 61032 - RNA, 23 nt, Artificial Sequence
  RNA Oligomer
auguaaagcuugucugaucguuc

SEQ ID NO: 61033 - RNA, 23 nt, Artificial Sequence
  RNA Oligomer
aauguaaagcuugucugaucguu

SEQ ID NO: 61034 - RNA, 23 nt, Artificial Sequence
  RNA Oligomer
agaauguaaagcuugucugaucg

SEQ ID NO: 61035 - RNA, 23 nt, Artificial Sequence
  RNA Oligomer
uagaauguaaagcuugucugauc

SEQ ID NO: 61036 - RNA, 23 nt, Artificial Sequence
  RNA Oligomer
guagaauguaaagcuugucugau

SEQ ID NO: 61037 - RNA, 23 nt, Artificial Sequence
  RNA Oligomer
gguagaauguaaagcuugucuga

SEQ ID NO: 61038 - RNA, 23 nt, Artificial Sequence
  RNA Oligomer
agguagaauguaaagcuugucug

SEQ ID NO: 61039 - RNA, 23 nt, Artificial Sequence
  RNA Oligomer
uagguagaauguaaagcuugucu

SEQ ID NO: 61040 - RNA, 23 nt, Artificial Sequence
  RNA Oligomer
auagguagaauguaaagcuuguc

SEQ ID NO: 61041 - RNA, 23 nt, Artificial Sequence
  RNA Oligomer
cauagguagaauguaaagcuugu

SEQ ID NO: 61042 - RNA, 23 nt, Artificial Sequence
  RNA Oligomer
ccauagguagaauguaaagcuug

SEQ ID NO: 61043 - RNA, 23 nt, Artificial Sequence
  RNA Oligomer
agcugaccuggaagagaacauua

SEQ ID NO: 61044 - RNA, 23 nt, Artificial Sequence
  RNA Oligomer
aagcugaccuggaagagaacauu

SEQ ID NO: 61045 - RNA, 23 nt, Artificial Sequence
  RNA Oligomer
uuagccucaauuucugaacacca

SEQ ID NO: 61046 - RNA, 23 nt, Artificial Sequence
  RNA Oligomer
guuagccucaauuucugaacacc

SEQ ID NO: 61047 - RNA, 23 nt, Artificial Sequence
  RNA Oligomer
uuuaaaguuguuugugccuuuuu

SEQ ID NO: 61048 - RNA, 23 nt, Artificial Sequence
  RNA Oligomer
auuuaaaguuguuugugccuuuu

SEQ ID NO: 61049 - RNA, 23 nt, Artificial Sequence
  RNA Oligomer
auugagaaggaaaauuuuagcgu

SEQ ID NO: 61050 - RNA, 23 nt, Artificial Sequence
  RNA Oligomer
ucaucagauagcaucuuauacga

SEQ ID NO: 61051 - RNA, 23 nt, Artificial Sequence
  RNA Oligomer
aucaucagauagcaucuuauacg

SEQ ID NO: 61052 - RNA, 23 nt, Artificial Sequence
  RNA Oligomer
uaucaucagauagcaucuuauac

SEQ ID NO: 61053 - RNA, 23 nt, Artificial Sequence
  RNA Oligomer
guaucaucagauagcaucuuaua

SEQ ID NO: 61054 - RNA, 23 nt, Artificial Sequence
  RNA Oligomer
aguaucaucagauagcaucuuau

SEQ ID NO: 61055 - RNA, 23 nt, Artificial Sequence
  RNA Oligomer
ccguaaaaaugauuucaguagca

SEQ ID NO: 61056 - RNA, 23 nt, Artificial Sequence
  RNA Oligomer
uccguaaaaaugauuucaguagc

SEQ ID NO: 61057 - RNA, 23 nt, Artificial Sequence
  RNA Oligomer
uuccguaaaaaugauuucaguag

SEQ ID NO: 61058 - RNA, 23 nt, Artificial Sequence
  RNA Oligomer
uuuccguaaaaaugauuucagua

SEQ ID NO: 61059 - RNA, 23 nt, Artificial Sequence
  RNA Oligomer
uuuuccguaaaaaugauuucagu

SEQ ID NO: 61060 - RNA, 23 nt, Artificial Sequence
  RNA Oligomer
gagagugagagacauuaacucau

SEQ ID NO: 61061 - RNA, 23 nt, Artificial Sequence
  RNA Oligomer
gcuuaccgacuggaagacacguu

SEQ ID NO: 61062 - RNA, 23 nt, Artificial Sequence
  RNA Oligomer
agacauaccgagcuaaauucugu

SEQ ID NO: 61063 - RNA, 23 nt, Artificial Sequence
  RNA Oligomer
aagacauaccgagcuaaauucug

SEQ ID NO: 61064 - RNA, 23 nt, Artificial Sequence
  RNA Oligomer
gaagacauaccgagcuaaauucu

SEQ ID NO: 61065 - RNA, 23 nt, Artificial Sequence
  RNA Oligomer
cuaucaaguuugagcuuucuggc

SEQ ID NO: 61066 - RNA, 23 nt, Artificial Sequence
  RNA Oligomer
ccaagccuaucaaguuugagcuu

SEQ ID NO: 61067 - RNA, 23 nt, Artificial Sequence
  RNA Oligomer
ccaaaaguuacauguuugcaccu

SEQ ID NO: 61068 - RNA, 23 nt, Artificial Sequence
  RNA Oligomer
accaaaaguuacauguuugcacc

SEQ ID NO: 61069 - RNA, 23 nt, Artificial Sequence
  RNA Oligomer
agugugaccaaaaguuacauguu

SEQ ID NO: 61070 - RNA, 23 nt, Artificial Sequence
  RNA Oligomer
ggacaguuuauuuguugagagug

SEQ ID NO: 61071 - RNA, 23 nt, Artificial Sequence
  RNA Oligomer
cggacaguuuauuuguugagagu

SEQ ID NO: 61072 - RNA, 23 nt, Artificial Sequence
  RNA Oligomer
ucggacaguuuauuuguugagag

SEQ ID NO: 61073 - RNA, 23 nt, Artificial Sequence
  RNA Oligomer
uucggacaguuuauuuguugaga

SEQ ID NO: 61074 - RNA, 23 nt, Artificial Sequence
  RNA Oligomer
uuucggacaguuuauuuguugag

SEQ ID NO: 61075 - RNA, 23 nt, Artificial Sequence
  RNA Oligomer
gccuuuauuaaaaacugagugac

SEQ ID NO: 61076 - RNA, 23 nt, Artificial Sequence
  RNA Oligomer
ggccuuuauuaaaaacugaguga

SEQ ID NO: 61077 - RNA, 23 nt, Artificial Sequence
  RNA Oligomer
uggccuuuauuaaaaacugagug

SEQ ID NO: 61078 - RNA, 23 nt, Artificial Sequence
  RNA Oligomer
auggccuuuauuaaaaacugagu

SEQ ID NO: 61079 - RNA, 23 nt, Artificial Sequence
  RNA Oligomer
aauggccuuuauuaaaaacugag

SEQ ID NO: 61080 - RNA, 23 nt, Artificial Sequence
  RNA Oligomer
guuguuugugccuuuuuauuuuu

SEQ ID NO: 61081 - RNA, 23 nt, Artificial Sequence
  RNA Oligomer
aauuuaaaguuguuugugccuuu

SEQ ID NO: 61082 - RNA, 23 nt, Artificial Sequence
  RNA Oligomer
cauucugauucgaaugacacugu

SEQ ID NO: 61083 - RNA, 23 nt, Artificial Sequence
  RNA Oligomer
ccuuaagucagaacagcagacuc

SEQ ID NO: 61084 - RNA, 23 nt, Artificial Sequence
  RNA Oligomer
uccuuaagucagaacagcagacu

SEQ ID NO: 61085 - RNA, 23 nt, Artificial Sequence
  RNA Oligomer
uuccuuaagucagaacagcagac

SEQ ID NO: 61086 - RNA, 23 nt, Artificial Sequence
  RNA Oligomer
guuccuuaagucagaacagcaga

SEQ ID NO: 61087 - RNA, 23 nt, Artificial Sequence
  RNA Oligomer
uguuccuuaagucagaacagcag

SEQ ID NO: 61088 - RNA, 23 nt, Artificial Sequence
  RNA Oligomer
gaguaauaugccugcuauuugaa

SEQ ID NO: 61089 - RNA, 23 nt, Artificial Sequence
  RNA Oligomer
ucagauagcaucuuauacgagua

SEQ ID NO: 61090 - RNA, 23 nt, Artificial Sequence
  RNA Oligomer
gaagaauguuaagacuugacagu

SEQ ID NO: 61091 - RNA, 23 nt, Artificial Sequence
  RNA Oligomer
caguagcacaaguuauuuaaauc

SEQ ID NO: 61092 - RNA, 23 nt, Artificial Sequence
  RNA Oligomer
ucaguagcacaaguuauuuaaau

SEQ ID NO: 61093 - RNA, 23 nt, Artificial Sequence
  RNA Oligomer
uucaguagcacaaguuauuuaaa

SEQ ID NO: 61094 - RNA, 23 nt, Artificial Sequence
  RNA Oligomer
uuucaguagcacaaguuauuuaa

SEQ ID NO: 61095 - RNA, 23 nt, Artificial Sequence
  RNA Oligomer
auuucaguagcacaaguuauuua

SEQ ID NO: 61096 - RNA, 23 nt, Artificial Sequence
  RNA Oligomer
acuggaacuugaacugauucaca

SEQ ID NO: 61097 - RNA, 23 nt, Artificial Sequence
  RNA Oligomer
uuaacucauuagacuggaacuug

SEQ ID NO: 61098 - RNA, 23 nt, Artificial Sequence
  RNA Oligomer
auuaacucauuagacuggaacuu

SEQ ID NO: 61099 - RNA, 23 nt, Artificial Sequence
  RNA Oligomer
cauuaacucauuagacuggaacu

SEQ ID NO: 61100 - RNA, 23 nt, Artificial Sequence
  RNA Oligomer
acauuaacucauuagacuggaac

SEQ ID NO: 61101 - RNA, 23 nt, Artificial Sequence
  RNA Oligomer
cgacuggaagacacguuuggccc

SEQ ID NO: 61102 - RNA, 23 nt, Artificial Sequence
  RNA Oligomer
gacauaccgagcuaaauucugug

SEQ ID NO: 61103 - RNA, 23 nt, Artificial Sequence
  RNA Oligomer
gagagugugaccaaaaguuacau

SEQ ID NO: 61104 - RNA, 23 nt, Artificial Sequence
  RNA Oligomer
ugagagugugaccaaaaguuaca

SEQ ID NO: 61105 - RNA, 23 nt, Artificial Sequence
  RNA Oligomer
uugagagugugaccaaaaguuac

SEQ ID NO: 61106 - RNA, 23 nt, Artificial Sequence
  RNA Oligomer
guugagagugugaccaaaaguua

SEQ ID NO: 61107 - RNA, 23 nt, Artificial Sequence
  RNA Oligomer
gaagcugaccuggaagagaacau

SEQ ID NO: 61108 - RNA, 23 nt, Artificial Sequence
  RNA Oligomer
gcuauuugaaguguaauugagaa

SEQ ID NO: 61109 - RNA, 23 nt, Artificial Sequence
  RNA Oligomer
ugcuauuugaaguguaauugaga

SEQ ID NO: 61110 - RNA, 23 nt, Artificial Sequence
  RNA Oligomer
cugcuauuugaaguguaauugag

SEQ ID NO: 61111 - RNA, 23 nt, Artificial Sequence
  RNA Oligomer
gacaguggaacuacauuaguaca

SEQ ID NO: 61112 - RNA, 23 nt, Artificial Sequence
  RNA Oligomer
agaauguuaagacuugacagugg

SEQ ID NO: 61113 - RNA, 23 nt, Artificial Sequence
  RNA Oligomer
aagaauguuaagacuugacagug

SEQ ID NO: 61114 - RNA, 23 nt, Artificial Sequence
  RNA Oligomer
cugauucacaucucauuuuuccg

SEQ ID NO: 61115 - RNA, 23 nt, Artificial Sequence
  RNA Oligomer
acugauucacaucucauuuuucc

SEQ ID NO: 61116 - RNA, 23 nt, Artificial Sequence
  RNA Oligomer
aacugauucacaucucauuuuuc

SEQ ID NO: 61117 - RNA, 23 nt, Artificial Sequence
  RNA Oligomer
gaacugauucacaucucauuuuu

SEQ ID NO: 61118 - RNA, 23 nt, Artificial Sequence
  RNA Oligomer
ugaacugauucacaucucauuuu

SEQ ID NO: 61119 - RNA, 23 nt, Artificial Sequence
  RNA Oligomer
ugacggcgaggucaugaagaaga

SEQ ID NO: 61120 - RNA, 23 nt, Artificial Sequence
  RNA Oligomer
cugacggcgaggucaugaagaag

SEQ ID NO: 61121 - RNA, 23 nt, Artificial Sequence
  RNA Oligomer
ccugacggcgaggucaugaagaa

SEQ ID NO: 61122 - RNA, 23 nt, Artificial Sequence
  RNA Oligomer
cagcaugaagacauaccgagcua

SEQ ID NO: 61123 - RNA, 23 nt, Artificial Sequence
  RNA Oligomer
cuccaagccuaucaaguuugagc

SEQ ID NO: 61124 - RNA, 23 nt, Artificial Sequence
  RNA Oligomer
ucuccaagccuaucaaguuugag

SEQ ID NO: 61125 - RNA, 23 nt, Artificial Sequence
  RNA Oligomer
aucuccaagccuaucaaguuuga

SEQ ID NO: 61126 - RNA, 23 nt, Artificial Sequence
  RNA Oligomer
aaucuccaagccuaucaaguuug

SEQ ID NO: 61127 - RNA, 23 nt, Artificial Sequence
  RNA Oligomer
aaaucuccaagccuaucaaguuu

SEQ ID NO: 61128 - RNA, 23 nt, Artificial Sequence
  RNA Oligomer
guacucccaaaaucuccaagccu

SEQ ID NO: 61129 - RNA, 23 nt, Artificial Sequence
  RNA Oligomer
cguacucccaaaaucuccaagcc

SEQ ID NO: 61130 - RNA, 23 nt, Artificial Sequence
  RNA Oligomer
ccguacucccaaaaucuccaagc

SEQ ID NO: 61131 - RNA, 23 nt, Artificial Sequence
  RNA Oligomer
uccguacucccaaaaucuccaag

SEQ ID NO: 61132 - RNA, 23 nt, Artificial Sequence
  RNA Oligomer
auccguacucccaaaaucuccaa

SEQ ID NO: 61133 - RNA, 23 nt, Artificial Sequence
  RNA Oligomer
acaguuuauuuguugagagugug

SEQ ID NO: 61134 - RNA, 23 nt, Artificial Sequence
  RNA Oligomer
gacaguuuauuuguugagagugu

SEQ ID NO: 61135 - RNA, 23 nt, Artificial Sequence
  RNA Oligomer
uuuucggacaguuuauuuguuga

SEQ ID NO: 61136 - RNA, 23 nt, Artificial Sequence
  RNA Oligomer
uuuuaaugaacaaauggccuuua

SEQ ID NO: 61137 - RNA, 23 nt, Artificial Sequence
  RNA Oligomer
cuuuuaaugaacaaauggccuuu

SEQ ID NO: 61138 - RNA, 23 nt, Artificial Sequence
  RNA Oligomer
acuuuuaaugaacaaauggccuu

SEQ ID NO: 61139 - RNA, 23 nt, Artificial Sequence
  RNA Oligomer
gcugauuucuagguaggaaaugu

SEQ ID NO: 61140 - RNA, 23 nt, Artificial Sequence
  RNA Oligomer
ggcugauuucuagguaggaaaug

SEQ ID NO: 61141 - RNA, 23 nt, Artificial Sequence
  RNA Oligomer
aggcugauuucuagguaggaaau

SEQ ID NO: 61142 - RNA, 23 nt, Artificial Sequence
  RNA Oligomer
caggcugauuucuagguaggaaa

SEQ ID NO: 61143 - RNA, 23 nt, Artificial Sequence
  RNA Oligomer
acagauuguuugcaaaggggagg

SEQ ID NO: 61144 - RNA, 23 nt, Artificial Sequence
  RNA Oligomer
aacagauuguuugcaaaggggag

SEQ ID NO: 61145 - RNA, 23 nt, Artificial Sequence
  RNA Oligomer
aaacagauuguuugcaaagggga

SEQ ID NO: 61146 - RNA, 23 nt, Artificial Sequence
  RNA Oligomer
aaaacagauuguuugcaaagggg

SEQ ID NO: 61147 - RNA, 23 nt, Artificial Sequence
  RNA Oligomer
caaaacagauuguuugcaaaggg

SEQ ID NO: 61148 - RNA, 23 nt, Artificial Sequence
  RNA Oligomer
gaaugacacuguucaggaaucgg

SEQ ID NO: 61149 - RNA, 23 nt, Artificial Sequence
  RNA Oligomer
cgaaugacacuguucaggaaucg

SEQ ID NO: 61150 - RNA, 23 nt, Artificial Sequence
  RNA Oligomer
ucgaaugacacuguucaggaauc

SEQ ID NO: 61151 - RNA, 23 nt, Artificial Sequence
  RNA Oligomer
uucgaaugacacuguucaggaau

SEQ ID NO: 61152 - RNA, 23 nt, Artificial Sequence
  RNA Oligomer
auucgaaugacacuguucaggaa

SEQ ID NO: 61153 - RNA, 23 nt, Artificial Sequence
  RNA Oligomer
uaguaucaucagauagcaucuua

SEQ ID NO: 61154 - RNA, 23 nt, Artificial Sequence
  RNA Oligomer
agaaagguuaguaucaucagaua

SEQ ID NO: 61155 - RNA, 23 nt, Artificial Sequence
  RNA Oligomer
cagaaagguuaguaucaucagau

SEQ ID NO: 61156 - RNA, 23 nt, Artificial Sequence
  RNA Oligomer
gaauguauauuaagguguggcuu

SEQ ID NO: 61157 - RNA, 23 nt, Artificial Sequence
  RNA Oligomer
agaauguauauuaagguguggcu

SEQ ID NO: 61158 - RNA, 23 nt, Artificial Sequence
  RNA Oligomer
cagaauguauauuaagguguggc

SEQ ID NO: 61159 - RNA, 23 nt, Artificial Sequence
  RNA Oligomer
acaguggaacuacauuaguacac

SEQ ID NO: 61160 - RNA, 23 nt, Artificial Sequence
  RNA Oligomer
uuuggcccagacccaacuaugau

SEQ ID NO: 61161 - RNA, 23 nt, Artificial Sequence
  RNA Oligomer
ucauuagacuggaacuugaacug

SEQ ID NO: 61162 - RNA, 23 nt, Artificial Sequence
  RNA Oligomer
cucauuagacuggaacuugaacu

SEQ ID NO: 61163 - RNA, 23 nt, Artificial Sequence
  RNA Oligomer
acucauuagacuggaacuugaac

SEQ ID NO: 61164 - RNA, 23 nt, Artificial Sequence
  RNA Oligomer
aacucauuagacuggaacuugaa

SEQ ID NO: 61165 - RNA, 23 nt, Artificial Sequence
  RNA Oligomer
uaacucauuagacuggaacuuga

SEQ ID NO: 61166 - RNA, 23 nt, Artificial Sequence
  RNA Oligomer
aaaaucuccaagccuaucaaguu

SEQ ID NO: 61167 - RNA, 23 nt, Artificial Sequence
  RNA Oligomer
caaaaucuccaagccuaucaagu

SEQ ID NO: 61168 - RNA, 23 nt, Artificial Sequence
  RNA Oligomer
agagugugaccaaaaguuacaug

SEQ ID NO: 61169 - RNA, 23 nt, Artificial Sequence
  RNA Oligomer
caguuuauuuguugagaguguga

SEQ ID NO: 61170 - RNA, 23 nt, Artificial Sequence
  RNA Oligomer
cuagguaggaaaugugguagccu

SEQ ID NO: 61171 - RNA, 23 nt, Artificial Sequence
  RNA Oligomer
ucuagguaggaaaugugguagcc

SEQ ID NO: 61172 - RNA, 23 nt, Artificial Sequence
  RNA Oligomer
uucuagguaggaaaugugguagc

SEQ ID NO: 61173 - RNA, 23 nt, Artificial Sequence
  RNA Oligomer
uuucuagguaggaaaugugguag

SEQ ID NO: 61174 - RNA, 23 nt, Artificial Sequence
  RNA Oligomer
auuucuagguaggaaauguggua

SEQ ID NO: 61175 - RNA, 23 nt, Artificial Sequence
  RNA Oligomer
cugauuucuagguaggaaaugug

SEQ ID NO: 61176 - RNA, 23 nt, Artificial Sequence
  RNA Oligomer
ccuuggcaggcugauuucuaggu

SEQ ID NO: 61177 - RNA, 23 nt, Artificial Sequence
  RNA Oligomer
cugcucagauagaaugacagucc

SEQ ID NO: 61178 - RNA, 23 nt, Artificial Sequence
  RNA Oligomer
ucugcucagauagaaugacaguc

SEQ ID NO: 61179 - RNA, 23 nt, Artificial Sequence
  RNA Oligomer
uucugcucagauagaaugacagu

SEQ ID NO: 61180 - RNA, 23 nt, Artificial Sequence
  RNA Oligomer
auucugcucagauagaaugacag

SEQ ID NO: 61181 - RNA, 23 nt, Artificial Sequence
  RNA Oligomer
aauucugcucagauagaaugaca

SEQ ID NO: 61182 - RNA, 23 nt, Artificial Sequence
  RNA Oligomer
uaauuuaaaguuguuugugccuu

SEQ ID NO: 61183 - RNA, 23 nt, Artificial Sequence
  RNA Oligomer
guguaauugagaaggaaaauuuu

SEQ ID NO: 61184 - RNA, 23 nt, Artificial Sequence
  RNA Oligomer
aguguaauugagaaggaaaauuu

SEQ ID NO: 61185 - RNA, 23 nt, Artificial Sequence
  RNA Oligomer
aaguguaauugagaaggaaaauu

SEQ ID NO: 61186 - RNA, 23 nt, Artificial Sequence
  RNA Oligomer
aucagauagcaucuuauacgagu

SEQ ID NO: 61187 - RNA, 23 nt, Artificial Sequence
  RNA Oligomer
caucagauagcaucuuauacgag

SEQ ID NO: 61188 - RNA, 23 nt, Artificial Sequence
  RNA Oligomer
ugguuugaagaauguuaagacuu

SEQ ID NO: 61189 - RNA, 23 nt, Artificial Sequence
  RNA Oligomer
cugguuugaagaauguuaagacu

SEQ ID NO: 61190 - RNA, 23 nt, Artificial Sequence
  RNA Oligomer
acugguuugaagaauguuaagac

SEQ ID NO: 61191 - RNA, 23 nt, Artificial Sequence
  RNA Oligomer
cacugguuugaagaauguuaaga

SEQ ID NO: 61192 - RNA, 23 nt, Artificial Sequence
  RNA Oligomer
cagacacugguuugaagaauguu

SEQ ID NO: 61193 - RNA, 23 nt, Artificial Sequence
  RNA Oligomer
ccagacacugguuugaagaaugu

SEQ ID NO: 61194 - RNA, 23 nt, Artificial Sequence
  RNA Oligomer
cccagacacugguuugaagaaug

SEQ ID NO: 61195 - RNA, 23 nt, Artificial Sequence
  RNA Oligomer
ccccagacacugguuugaagaau

SEQ ID NO: 61196 - RNA, 23 nt, Artificial Sequence
  RNA Oligomer
accccagacacugguuugaagaa

SEQ ID NO: 61197 - RNA, 23 nt, Artificial Sequence
  RNA Oligomer
agauucccacccaauucaaaaca

SEQ ID NO: 61198 - RNA, 23 nt, Artificial Sequence
  RNA Oligomer
gauuucaguagcacaaguuauuu

SEQ ID NO: 61199 - RNA, 23 nt, Artificial Sequence
  RNA Oligomer
ugauuucaguagcacaaguuauu

SEQ ID NO: 61200 - RNA, 23 nt, Artificial Sequence
  RNA Oligomer
augauuucaguagcacaaguuau

SEQ ID NO: 61201 - RNA, 23 nt, Artificial Sequence
  RNA Oligomer
aaugauuucaguagcacaaguua

SEQ ID NO: 61202 - RNA, 23 nt, Artificial Sequence
  RNA Oligomer
aaaugauuucaguagcacaaguu

SEQ ID NO: 61203 - RNA, 23 nt, Artificial Sequence
  RNA Oligomer
aaaaugauuucaguagcacaagu

SEQ ID NO: 61204 - RNA, 23 nt, Artificial Sequence
  RNA Oligomer
acaucuuugaaucgcuguacuac

SEQ ID NO: 61205 - RNA, 23 nt, Artificial Sequence
  RNA Oligomer
gacaucuuugaaucgcuguacua

SEQ ID NO: 61206 - RNA, 23 nt, Artificial Sequence
  RNA Oligomer
ugacaucuuugaaucgcuguacu

SEQ ID NO: 61207 - RNA, 23 nt, Artificial Sequence
  RNA Oligomer
augacaucuuugaaucgcuguac

SEQ ID NO: 61208 - RNA, 23 nt, Artificial Sequence
  RNA Oligomer
aaugacaucuuugaaucgcugua

SEQ ID NO: 61209 - RNA, 23 nt, Artificial Sequence
  RNA Oligomer
uaaauucuguggaguauguaccg

SEQ ID NO: 61210 - RNA, 23 nt, Artificial Sequence
  RNA Oligomer
cuaaauucuguggaguauguacc

SEQ ID NO: 61211 - RNA, 23 nt, Artificial Sequence
  RNA Oligomer
gagugugaccaaaaguuacaugu

SEQ ID NO: 61212 - RNA, 23 nt, Artificial Sequence
  RNA Oligomer
uuuuucggacaguuuauuuguug

SEQ ID NO: 61213 - RNA, 23 nt, Artificial Sequence
  RNA Oligomer
caccuggaagcauuuguuucuac

SEQ ID NO: 61214 - RNA, 23 nt, Artificial Sequence
  RNA Oligomer
ucaccuggaagcauuuguuucua

SEQ ID NO: 61215 - RNA, 23 nt, Artificial Sequence
  RNA Oligomer
uucaccuggaagcauuuguuucu

SEQ ID NO: 61216 - RNA, 23 nt, Artificial Sequence
  RNA Oligomer
uuucaccuggaagcauuuguuuc

SEQ ID NO: 61217 - RNA, 23 nt, Artificial Sequence
  RNA Oligomer
uuuucaccuggaagcauuuguuu

SEQ ID NO: 61218 - RNA, 23 nt, Artificial Sequence
  RNA Oligomer
ugauuucuagguaggaaaugugg

SEQ ID NO: 61219 - RNA, 23 nt, Artificial Sequence
  RNA Oligomer
guaacaagccagauuuuuuaaaa

SEQ ID NO: 61220 - RNA, 23 nt, Artificial Sequence
  RNA Oligomer
uguaacaagccagauuuuuuaaa

SEQ ID NO: 61221 - RNA, 23 nt, Artificial Sequence
  RNA Oligomer
cuguaacaagccagauuuuuuaa

SEQ ID NO: 61222 - RNA, 23 nt, Artificial Sequence
  RNA Oligomer
ccuguaacaagccagauuuuuua

SEQ ID NO: 61223 - RNA, 23 nt, Artificial Sequence
  RNA Oligomer
gccuguaacaagccagauuuuuu

SEQ ID NO: 61224 - RNA, 23 nt, Artificial Sequence
  RNA Oligomer
gauucgaaugacacuguucagga

SEQ ID NO: 61225 - RNA, 23 nt, Artificial Sequence
  RNA Oligomer
acaagggccucuucugugacuuc

SEQ ID NO: 61226 - RNA, 23 nt, Artificial Sequence
  RNA Oligomer
cacaagggccucuucugugacuu

SEQ ID NO: 61227 - RNA, 23 nt, Artificial Sequence
  RNA Oligomer
gcacaagggccucuucugugacu

SEQ ID NO: 61228 - RNA, 23 nt, Artificial Sequence
  RNA Oligomer
cgcacaagggccucuucugugac

SEQ ID NO: 61229 - RNA, 23 nt, Artificial Sequence
  RNA Oligomer
ccgcacaagggccucuucuguga

SEQ ID NO: 61230 - RNA, 23 nt, Artificial Sequence
  RNA Oligomer
gcaugaagccagagagugagaga

SEQ ID NO: 61231 - RNA, 23 nt, Artificial Sequence
  RNA Oligomer
ggcaugaagccagagagugagag

SEQ ID NO: 61232 - RNA, 23 nt, Artificial Sequence
  RNA Oligomer
uggcaugaagccagagagugaga

SEQ ID NO: 61233 - RNA, 23 nt, Artificial Sequence
  RNA Oligomer
auggcaugaagccagagagugag

SEQ ID NO: 61234 - RNA, 23 nt, Artificial Sequence
  RNA Oligomer
cauggcaugaagccagagaguga

SEQ ID NO: 61235 - RNA, 23 nt, Artificial Sequence
  RNA Oligomer
acggagacauggcaugaagccag

SEQ ID NO: 61236 - RNA, 23 nt, Artificial Sequence
  RNA Oligomer
uacggagacauggcaugaagcca

SEQ ID NO: 61237 - RNA, 23 nt, Artificial Sequence
  RNA Oligomer
guacggagacauggcaugaagcc

SEQ ID NO: 61238 - RNA, 23 nt, Artificial Sequence
  RNA Oligomer
uguacggagacauggcaugaagc

SEQ ID NO: 61239 - RNA, 23 nt, Artificial Sequence
  RNA Oligomer
auguacggagacauggcaugaag

SEQ ID NO: 61240 - RNA, 23 nt, Artificial Sequence
  RNA Oligomer
uugcaccuuucuaguugaaaaua

SEQ ID NO: 61241 - RNA, 23 nt, Artificial Sequence
  RNA Oligomer
uuugcaccuuucuaguugaaaau

SEQ ID NO: 61242 - RNA, 23 nt, Artificial Sequence
  RNA Oligomer
guuugcaccuuucuaguugaaaa

SEQ ID NO: 61243 - RNA, 23 nt, Artificial Sequence
  RNA Oligomer
uguuugcaccuuucuaguugaaa

SEQ ID NO: 61244 - RNA, 23 nt, Artificial Sequence
  RNA Oligomer
auguuugcaccuuucuaguugaa

SEQ ID NO: 61245 - RNA, 23 nt, Artificial Sequence
  RNA Oligomer
acauguuugcaccuuucuaguug

SEQ ID NO: 61246 - RNA, 23 nt, Artificial Sequence
  RNA Oligomer
uacauguuugcaccuuucuaguu

SEQ ID NO: 61247 - RNA, 23 nt, Artificial Sequence
  RNA Oligomer
uuacauguuugcaccuuucuagu

SEQ ID NO: 61248 - RNA, 23 nt, Artificial Sequence
  RNA Oligomer
guuacauguuugcaccuuucuag

SEQ ID NO: 61249 - RNA, 23 nt, Artificial Sequence
  RNA Oligomer
aguuacauguuugcaccuuucua

SEQ ID NO: 61250 - RNA, 23 nt, Artificial Sequence
  RNA Oligomer
uuguugagagugugaccaaaagu

SEQ ID NO: 61251 - RNA, 23 nt, Artificial Sequence
  RNA Oligomer
uuuguugagagugugaccaaaag

SEQ ID NO: 61252 - RNA, 23 nt, Artificial Sequence
  RNA Oligomer
auuuguugagagugugaccaaaa

SEQ ID NO: 61253 - RNA, 23 nt, Artificial Sequence
  RNA Oligomer
uauuuguugagagugugaccaaa

SEQ ID NO: 61254 - RNA, 23 nt, Artificial Sequence
  RNA Oligomer
guuuuucggacaguuuauuuguu

SEQ ID NO: 61255 - RNA, 23 nt, Artificial Sequence
  RNA Oligomer
uguuucuacuuugauaugacugu

SEQ ID NO: 61256 - RNA, 23 nt, Artificial Sequence
  RNA Oligomer
uuguuucuacuuugauaugacug

SEQ ID NO: 61257 - RNA, 23 nt, Artificial Sequence
  RNA Oligomer
uuuguuucuacuuugauaugacu

SEQ ID NO: 61258 - RNA, 23 nt, Artificial Sequence
  RNA Oligomer
auuuguuucuacuuugauaugac

SEQ ID NO: 61259 - RNA, 23 nt, Artificial Sequence
  RNA Oligomer
ugcucagauagaaugacaguccg

SEQ ID NO: 61260 - RNA, 23 nt, Artificial Sequence
  RNA Oligomer
uggaagagaacauuaagaagggc

SEQ ID NO: 61261 - RNA, 23 nt, Artificial Sequence
  RNA Oligomer
cuggaagagaacauuaagaaggg

SEQ ID NO: 61262 - RNA, 23 nt, Artificial Sequence
  RNA Oligomer
ccuggaagagaacauuaagaagg

SEQ ID NO: 61263 - RNA, 23 nt, Artificial Sequence
  RNA Oligomer
ucaaagcaugaaauggauacuua

SEQ ID NO: 61264 - RNA, 23 nt, Artificial Sequence
  RNA Oligomer
uucaaagcaugaaauggauacuu

SEQ ID NO: 61265 - RNA, 23 nt, Artificial Sequence
  RNA Oligomer
guucaaagcaugaaauggauacu

SEQ ID NO: 61266 - RNA, 23 nt, Artificial Sequence
  RNA Oligomer
cguucaaagcaugaaauggauac

SEQ ID NO: 61267 - RNA, 23 nt, Artificial Sequence
  RNA Oligomer
acacuguucaggaaucggaaucc

SEQ ID NO: 61268 - RNA, 23 nt, Artificial Sequence
  RNA Oligomer
gacacuguucaggaaucggaauc

SEQ ID NO: 61269 - RNA, 23 nt, Artificial Sequence
  RNA Oligomer
ugacacuguucaggaaucggaau

SEQ ID NO: 61270 - RNA, 23 nt, Artificial Sequence
  RNA Oligomer
augacacuguucaggaaucggaa

SEQ ID NO: 61271 - RNA, 23 nt, Artificial Sequence
  RNA Oligomer
aaugacacuguucaggaaucgga

SEQ ID NO: 61272 - RNA, 23 nt, Artificial Sequence
  RNA Oligomer
guaauaugccugcuauuugaagu

SEQ ID NO: 61273 - RNA, 23 nt, Artificial Sequence
  RNA Oligomer
aguaauaugccugcuauuugaag

SEQ ID NO: 61274 - RNA, 23 nt, Artificial Sequence
  RNA Oligomer
cgcuguacuacaggaagauguac

SEQ ID NO: 61275 - RNA, 23 nt, Artificial Sequence
  RNA Oligomer
ucgcuguacuacaggaagaugua

SEQ ID NO: 61276 - RNA, 23 nt, Artificial Sequence
  RNA Oligomer
aucgcuguacuacaggaagaugu

SEQ ID NO: 61277 - RNA, 23 nt, Artificial Sequence
  RNA Oligomer
aaucgcuguacuacaggaagaug

SEQ ID NO: 61278 - RNA, 23 nt, Artificial Sequence
  RNA Oligomer
gaaucgcuguacuacaggaagau

SEQ ID NO: 61279 - RNA, 23 nt, Artificial Sequence
  RNA Oligomer
ucguucaaagcaugaaauggaua

SEQ ID NO: 61280 - RNA, 23 nt, Artificial Sequence
  RNA Oligomer
cgaagcugaccuggaagagaaca

SEQ ID NO: 61281 - RNA, 23 nt, Artificial Sequence
  RNA Oligomer
gcgaagcugaccuggaagagaac

SEQ ID NO: 61282 - RNA, 23 nt, Artificial Sequence
  RNA Oligomer
ugcgaagcugaccuggaagagaa

SEQ ID NO: 61283 - RNA, 23 nt, Artificial Sequence
  RNA Oligomer
caauguuagccucaauuucugaa

SEQ ID NO: 61284 - RNA, 23 nt, Artificial Sequence
  RNA Oligomer
ugauauuucaauguuagccucaa

SEQ ID NO: 61285 - RNA, 23 nt, Artificial Sequence
  RNA Oligomer
gaauguaaagcuugucugaucgu

SEQ ID NO: 61286 - RNA, 23 nt, Artificial Sequence
  RNA Oligomer
ccuuuauuaaaaacugagugacu

SEQ ID NO: 61287 - RNA, 23 nt, Artificial Sequence
  RNA Oligomer
ggauacuuauauggaaauucugc

SEQ ID NO: 61288 - RNA, 23 nt, Artificial Sequence
  RNA Oligomer
uggauacuuauauggaaauucug

SEQ ID NO: 61289 - RNA, 23 nt, Artificial Sequence
  RNA Oligomer
aauguuaagacuugacaguggaa

SEQ ID NO: 61290 - RNA, 23 nt, Artificial Sequence
  RNA Oligomer
guagcacaaguuauuuaaaucug

SEQ ID NO: 61291 - RNA, 23 nt, Artificial Sequence
  RNA Oligomer
guaaaaaugauuucaguagcaca

SEQ ID NO: 61292 - RNA, 23 nt, Artificial Sequence
  RNA Oligomer
gaagauguacggagacauggcau

SEQ ID NO: 61293 - RNA, 23 nt, Artificial Sequence
  RNA Oligomer
cuauuugaaguguaauugagaag

SEQ ID NO: 61294 - RNA, 23 nt, Artificial Sequence
  RNA Oligomer
gauguacggagacauggcaugaa

SEQ ID NO: 61295 - RNA, 23 nt, Artificial Sequence
  RNA Oligomer
caugaaauggauacuuauaugga

SEQ ID NO: 61296 - RNA, 23 nt, Artificial Sequence
  RNA Oligomer
cugaacaccauagguagaaugua

SEQ ID NO: 61297 - RNA, 23 nt, Artificial Sequence
  RNA Oligomer
ucugaacaccauagguagaaugu

SEQ ID NO: 61298 - RNA, 23 nt, Artificial Sequence
  RNA Oligomer
agacacugguuugaagaauguua

SEQ ID NO: 61299 - RNA, 23 nt, Artificial Sequence
  RNA Oligomer
gguuaguaucaucagauagcauc

SEQ ID NO: 61300 - RNA, 23 nt, Artificial Sequence
  RNA Oligomer
ggaacuacauuaguacacagcac

SEQ ID NO: 61301 - RNA, 23 nt, Artificial Sequence
  RNA Oligomer
acacugguuugaagaauguuaag

SEQ ID NO: 61302 - RNA, 23 nt, Artificial Sequence
  RNA Oligomer
cuugaacugauucacaucucauu

SEQ ID NO: 61303 - RNA, 23 nt, Artificial Sequence
  RNA Oligomer
ucaucaagaccugugccugccau

SEQ ID NO: 61304 - RNA, 23 nt, Artificial Sequence
  RNA Oligomer
gcaccuuucuaguugaaaauaaa

SEQ ID NO: 61305 - RNA, 23 nt, Artificial Sequence
  RNA Oligomer
ucaaaacauugugccaugucaaa

SEQ ID NO: 61306 - RNA, 23 nt, Artificial Sequence
  RNA Oligomer
acauuaguacacagcaccagaau

SEQ ID NO: 61307 - RNA, 23 nt, Artificial Sequence
  RNA Oligomer
ggaacuugaacugauucacaucu

SEQ ID NO: 61308 - RNA, 23 nt, Artificial Sequence
  RNA Oligomer
gagugagagacauuaacucauua

SEQ ID NO: 61309 - RNA, 23 nt, Artificial Sequence
  RNA Oligomer
caccuuucuaguugaaaauaaag

SEQ ID NO: 61310 - RNA, 23 nt, Artificial Sequence
  RNA Oligomer
ugcaccuuucuaguugaaaauaa

SEQ ID NO: 61311 - RNA, 23 nt, Artificial Sequence
  RNA Oligomer
gaaaugugguagccucacuuuua

SEQ ID NO: 61312 - RNA, 23 nt, Artificial Sequence
  RNA Oligomer
cgucaaaacagauuguuugcaaa

SEQ ID NO: 61313 - RNA, 23 nt, Artificial Sequence
  RNA Oligomer
uacauuaguacacagcaccagaa

SEQ ID NO: 61314 - RNA, 23 nt, Artificial Sequence
  RNA Oligomer
gacacugguuugaagaauguuaa

SEQ ID NO: 61315 - RNA, 23 nt, Artificial Sequence
  RNA Oligomer
ggaaaugugguagccucacuuuu

SEQ ID NO: 61316 - RNA, 23 nt, Artificial Sequence
  RNA Oligomer
acauugugccaugucaaacaaau

SEQ ID NO: 61317 - RNA, 23 nt, Artificial Sequence
  RNA Oligomer
cccaauucaaaacauugugccau

SEQ ID NO: 61318 - RNA, 23 nt, Artificial Sequence
  RNA Oligomer
acuugaacugauucacaucucau

SEQ ID NO: 61319 - RNA, 23 nt, Artificial Sequence
  RNA Oligomer
ugaaucgcuguacuacaggaaga

SEQ ID NO: 61320 - RNA, 23 nt, Artificial Sequence
  RNA Oligomer
gccucacuuuuaaugaacaaaug

SEQ ID NO: 61321 - RNA, 23 nt, Artificial Sequence
  RNA Oligomer
ugaacaccauagguagaauguaa

SEQ ID NO: 61322 - RNA, 23 nt, Artificial Sequence
  RNA Oligomer
gcaagugaauuugccuguaacaa

SEQ ID NO: 61323 - RNA, 23 nt, Artificial Sequence
  RNA Oligomer
gacauucugauucgaaugacacu

SEQ ID NO: 61324 - RNA, 23 nt, Artificial Sequence
  RNA Oligomer
guauauuaagguguggcuuuagg

SEQ ID NO: 61325 - RNA, 23 nt, Artificial Sequence
  RNA Oligomer
agagugagagacauuaacucauu

SEQ ID NO: 61326 - RNA, 23 nt, Artificial Sequence
  RNA Oligomer
ggucaugaagaagaacaugaugu

SEQ ID NO: 61327 - RNA, 23 nt, Artificial Sequence
  RNA Oligomer
caaauggccuuuauuaaaaacug

SEQ ID NO: 61328 - RNA, 23 nt, Artificial Sequence
  RNA Oligomer
agccucacuuuuaaugaacaaau

SEQ ID NO: 61329 - RNA, 23 nt, Artificial Sequence
  RNA Oligomer
aggaaaugugguagccucacuuu

SEQ ID NO: 61330 - RNA, 23 nt, Artificial Sequence
  RNA Oligomer
gucaaaacagauuguuugcaaag

SEQ ID NO: 61331 - RNA, 23 nt, Artificial Sequence
  RNA Oligomer
gggcaaaaagugcauccguacuc

SEQ ID NO: 61332 - RNA, 23 nt, Artificial Sequence
  RNA Oligomer
ggacagcuuguggcaagugaauu

SEQ ID NO: 61333 - RNA, 23 nt, Artificial Sequence
  RNA Oligomer
uggacagcuuguggcaagugaau

SEQ ID NO: 61334 - RNA, 23 nt, Artificial Sequence
  RNA Oligomer
ggaaucggaauccugucgauuag

SEQ ID NO: 61335 - RNA, 23 nt, Artificial Sequence
  RNA Oligomer
cugagucaaguuguuccuuaagu

SEQ ID NO: 61336 - RNA, 23 nt, Artificial Sequence
  RNA Oligomer
ccaucaagagacugagucaaguu

SEQ ID NO: 61337 - RNA, 23 nt, Artificial Sequence
  RNA Oligomer
cuggaacuugaacugauucacau

SEQ ID NO: 61338 - RNA, 23 nt, Artificial Sequence
  RNA Oligomer
agugagagacauuaacucauuag

SEQ ID NO: 61339 - RNA, 23 nt, Artificial Sequence
  RNA Oligomer
guacuacaggaagauguacggag

SEQ ID NO: 61340 - RNA, 23 nt, Artificial Sequence
  RNA Oligomer
gucccggagacaaugacaucuuu

SEQ ID NO: 61341 - RNA, 23 nt, Artificial Sequence
  RNA Oligomer
guagccucacuuuuaaugaacaa

SEQ ID NO: 61342 - RNA, 23 nt, Artificial Sequence
  RNA Oligomer
aagugcauccguacucccaaaau

SEQ ID NO: 61343 - RNA, 23 nt, Artificial Sequence
  RNA Oligomer
guggcaagugaauuugccuguaa

SEQ ID NO: 61344 - RNA, 23 nt, Artificial Sequence
  RNA Oligomer
ucggaauccugucgauuagacug

SEQ ID NO: 61345 - RNA, 23 nt, Artificial Sequence
  RNA Oligomer
caaguuguuccuuaagucagaac

SEQ ID NO: 61346 - RNA, 23 nt, Artificial Sequence
  RNA Oligomer
agguuaguaucaucagauagcau

SEQ ID NO: 61347 - RNA, 23 nt, Artificial Sequence
  RNA Oligomer
caaaaguuacauguuugcaccuu

SEQ ID NO: 61348 - RNA, 23 nt, Artificial Sequence
  RNA Oligomer
ggcaagugaauuugccuguaaca

SEQ ID NO: 61349 - RNA, 23 nt, Artificial Sequence
  RNA Oligomer
ugacauucugauucgaaugacac

SEQ ID NO: 61350 - RNA, 23 nt, Artificial Sequence
  RNA Oligomer
ugucaaacaaauagucuaucaac

SEQ ID NO: 61351 - RNA, 23 nt, Artificial Sequence
  RNA Oligomer
uccacccggguuaccaaugacaa

SEQ ID NO: 61352 - RNA, 23 nt, Artificial Sequence
  RNA Oligomer
aacauugugccaugucaaacaaa

SEQ ID NO: 61353 - RNA, 23 nt, Artificial Sequence
  RNA Oligomer
acguuuggcccagacccaacuau

SEQ ID NO: 61354 - RNA, 23 nt, Artificial Sequence
  RNA Oligomer
gcaccagcaugaagacauaccga

SEQ ID NO: 61355 - RNA, 23 nt, Artificial Sequence
  RNA Oligomer
ugacuguuuuucggacaguuuau

SEQ ID NO: 61356 - RNA, 23 nt, Artificial Sequence
  RNA Oligomer
agauagaaugacaguccgucaaa

SEQ ID NO: 61357 - RNA, 23 nt, Artificial Sequence
  RNA Oligomer
cugaucguucaaagcaugaaaug

SEQ ID NO: 61358 - RNA, 23 nt, Artificial Sequence
  RNA Oligomer
ucugaucguucaaagcaugaaau

SEQ ID NO: 61359 - RNA, 23 nt, Artificial Sequence
  RNA Oligomer
aggaaucggaauccugucgauua

SEQ ID NO: 61360 - RNA, 23 nt, Artificial Sequence
  RNA Oligomer
gagucaaguuguuccuuaaguca

SEQ ID NO: 61361 - RNA, 23 nt, Artificial Sequence
  RNA Oligomer
gccaucaagagacugagucaagu

SEQ ID NO: 61362 - RNA, 23 nt, Artificial Sequence
  RNA Oligomer
uuaguaucaucagauagcaucuu

SEQ ID NO: 61363 - RNA, 23 nt, Artificial Sequence
  RNA Oligomer
guaccagcagaaagguuaguauc

SEQ ID NO: 61364 - RNA, 23 nt, Artificial Sequence
  RNA Oligomer
uggaacuacauuaguacacagca

SEQ ID NO: 61365 - RNA, 23 nt, Artificial Sequence
  RNA Oligomer
aaaagauucccacccaauucaaa

SEQ ID NO: 61366 - RNA, 23 nt, Artificial Sequence
  RNA Oligomer
gugagagacauuaacucauuaga

SEQ ID NO: 61367 - RNA, 23 nt, Artificial Sequence
  RNA Oligomer
acaugauguucaucaagaccugu

SEQ ID NO: 61368 - RNA, 23 nt, Artificial Sequence
  RNA Oligomer
gaagaacaugauguucaucaaga

SEQ ID NO: 61369 - RNA, 23 nt, Artificial Sequence
  RNA Oligomer
agaagaacaugauguucaucaag

SEQ ID NO: 61370 - RNA, 23 nt, Artificial Sequence
  RNA Oligomer
gaagaagaacaugauguucauca

SEQ ID NO: 61371 - RNA, 23 nt, Artificial Sequence
  RNA Oligomer
ccagcaugaagacauaccgagcu

SEQ ID NO: 61372 - RNA, 23 nt, Artificial Sequence
  RNA Oligomer
caaguuugagcuuucuggcugca

SEQ ID NO: 61373 - RNA, 23 nt, Artificial Sequence
  RNA Oligomer
guguccuuggcaggcugauuucu

SEQ ID NO: 61374 - RNA, 23 nt, Artificial Sequence
  RNA Oligomer
caguguccuuggcaggcugauuu

SEQ ID NO: 61375 - RNA, 23 nt, Artificial Sequence
  RNA Oligomer
ccgucaaaacagauuguuugcaa

SEQ ID NO: 61376 - RNA, 23 nt, Artificial Sequence
  RNA Oligomer
ggaaauucugcucagauagaaug

SEQ ID NO: 61377 - RNA, 23 nt, Artificial Sequence
  RNA Oligomer
agggcaaaaagugcauccguacu

SEQ ID NO: 61378 - RNA, 23 nt, Artificial Sequence
  RNA Oligomer
uugccuguaacaagccagauuuu

SEQ ID NO: 61379 - RNA, 23 nt, Artificial Sequence
  RNA Oligomer
gugaauuugccuguaacaagcca

SEQ ID NO: 61380 - RNA, 23 nt, Artificial Sequence
  RNA Oligomer
gacagcuuguggcaagugaauuu

SEQ ID NO: 61381 - RNA, 23 nt, Artificial Sequence
  RNA Oligomer
cugucgauuagacuggacagcuu

SEQ ID NO: 61382 - RNA, 23 nt, Artificial Sequence
  RNA Oligomer
ucaggaaucggaauccugucgau

SEQ ID NO: 61383 - RNA, 23 nt, Artificial Sequence
  RNA Oligomer
auuuuuacggaaaaaugagaugu

SEQ ID NO: 61384 - RNA, 23 nt, Artificial Sequence
  RNA Oligomer
uuuuuacggaaaaaugagaugug

SEQ ID NO: 61385 - RNA, 23 nt, Artificial Sequence
  RNA Oligomer
uuuuacggaaaaaugagauguga

SEQ ID NO: 61386 - RNA, 23 nt, Artificial Sequence
  RNA Oligomer
uuuacggaaaaaugagaugugaa

SEQ ID NO: 61387 - RNA, 23 nt, Artificial Sequence
  RNA Oligomer
uuacggaaaaaugagaugugaau

SEQ ID NO: 61388 - RNA, 23 nt, Artificial Sequence
  RNA Oligomer
gcacuuuuugcccuucuuaaugu

SEQ ID NO: 61389 - RNA, 23 nt, Artificial Sequence
  RNA Oligomer
cacuuuuugcccuucuuaauguu

SEQ ID NO: 61390 - RNA, 23 nt, Artificial Sequence
  RNA Oligomer
acuuuuugcccuucuuaauguuc

SEQ ID NO: 61391 - RNA, 23 nt, Artificial Sequence
  RNA Oligomer
cuuuuugcccuucuuaauguucu

SEQ ID NO: 61392 - RNA, 23 nt, Artificial Sequence
  RNA Oligomer
uuuuugcccuucuuaauguucuc

SEQ ID NO: 61393 - RNA, 23 nt, Artificial Sequence
  RNA Oligomer
ggcauauuacucguauaagaugc

SEQ ID NO: 61394 - RNA, 23 nt, Artificial Sequence
  RNA Oligomer
gcauauuacucguauaagaugcu

SEQ ID NO: 61395 - RNA, 23 nt, Artificial Sequence
  RNA Oligomer
cauauuacucguauaagaugcua

SEQ ID NO: 61396 - RNA, 23 nt, Artificial Sequence
  RNA Oligomer
auauuacucguauaagaugcuau

SEQ ID NO: 61397 - RNA, 23 nt, Artificial Sequence
  RNA Oligomer
uauuacucguauaagaugcuauc

SEQ ID NO: 61398 - RNA, 23 nt, Artificial Sequence
  RNA Oligomer
caccuuaauauacauucuggugc

SEQ ID NO: 61399 - RNA, 23 nt, Artificial Sequence
  RNA Oligomer
accuuaauauacauucuggugcu

SEQ ID NO: 61400 - RNA, 23 nt, Artificial Sequence
  RNA Oligomer
ccuuaauauacauucuggugcug

SEQ ID NO: 61401 - RNA, 23 nt, Artificial Sequence
  RNA Oligomer
cuuaauauacauucuggugcugu

SEQ ID NO: 61402 - RNA, 23 nt, Artificial Sequence
  RNA Oligomer
uuaauauacauucuggugcugug

SEQ ID NO: 61403 - RNA, 23 nt, Artificial Sequence
  RNA Oligomer
uacggaaaaaugagaugugaauc

SEQ ID NO: 61404 - RNA, 23 nt, Artificial Sequence
  RNA Oligomer
ucaaauagcaggcauauuacucg

SEQ ID NO: 61405 - RNA, 23 nt, Artificial Sequence
  RNA Oligomer
caaauagcaggcauauuacucgu

SEQ ID NO: 61406 - RNA, 23 nt, Artificial Sequence
  RNA Oligomer
aaauagcaggcauauuacucgua

SEQ ID NO: 61407 - RNA, 23 nt, Artificial Sequence
  RNA Oligomer
aauagcaggcauauuacucguau

SEQ ID NO: 61408 - RNA, 23 nt, Artificial Sequence
  RNA Oligomer
auagcaggcauauuacucguaua

SEQ ID NO: 61409 - RNA, 23 nt, Artificial Sequence
  RNA Oligomer
cagugagcacgcuaaaauuuucc

SEQ ID NO: 61410 - RNA, 23 nt, Artificial Sequence
  RNA Oligomer
agugagcacgcuaaaauuuuccu

SEQ ID NO: 61411 - RNA, 23 nt, Artificial Sequence
  RNA Oligomer
gugagcacgcuaaaauuuuccuu

SEQ ID NO: 61412 - RNA, 23 nt, Artificial Sequence
  RNA Oligomer
ugagcacgcuaaaauuuuccuuc

SEQ ID NO: 61413 - RNA, 23 nt, Artificial Sequence
  RNA Oligomer
gagcacgcuaaaauuuuccuucu

SEQ ID NO: 61414 - RNA, 23 nt, Artificial Sequence
  RNA Oligomer
cauuuuuacggaaaaaugagaug

SEQ ID NO: 61415 - RNA, 23 nt, Artificial Sequence
  RNA Oligomer
acggaaaaaugagaugugaauca

SEQ ID NO: 61416 - RNA, 23 nt, Artificial Sequence
  RNA Oligomer
uuuugcccuucuuaauguucucu

SEQ ID NO: 61417 - RNA, 23 nt, Artificial Sequence
  RNA Oligomer
uuugcccuucuuaauguucucuu

SEQ ID NO: 61418 - RNA, 23 nt, Artificial Sequence
  RNA Oligomer
uugcccuucuuaauguucucuuc

SEQ ID NO: 61419 - RNA, 23 nt, Artificial Sequence
  RNA Oligomer
acugaucagcuauauagagucac

SEQ ID NO: 61420 - RNA, 23 nt, Artificial Sequence
  RNA Oligomer
cugaucagcuauauagagucacu

SEQ ID NO: 61421 - RNA, 23 nt, Artificial Sequence
  RNA Oligomer
ugaucagcuauauagagucacuc

SEQ ID NO: 61422 - RNA, 23 nt, Artificial Sequence
  RNA Oligomer
gaucagcuauauagagucacuca

SEQ ID NO: 61423 - RNA, 23 nt, Artificial Sequence
  RNA Oligomer
aucagcuauauagagucacucag

SEQ ID NO: 61424 - RNA, 23 nt, Artificial Sequence
  RNA Oligomer
accuaugguguucagaaauugag

SEQ ID NO: 61425 - RNA, 23 nt, Artificial Sequence
  RNA Oligomer
ccuaugguguucagaaauugagg

SEQ ID NO: 61426 - RNA, 23 nt, Artificial Sequence
  RNA Oligomer
cuaugguguucagaaauugaggc

SEQ ID NO: 61427 - RNA, 23 nt, Artificial Sequence
  RNA Oligomer
uaugguguucagaaauugaggcu

SEQ ID NO: 61428 - RNA, 23 nt, Artificial Sequence
  RNA Oligomer
augguguucagaaauugaggcua

SEQ ID NO: 61429 - RNA, 23 nt, Artificial Sequence
  RNA Oligomer
ucugaugauacuaaccuuucugc

SEQ ID NO: 61430 - RNA, 23 nt, Artificial Sequence
  RNA Oligomer
cugaugauacuaaccuuucugcu

SEQ ID NO: 61431 - RNA, 23 nt, Artificial Sequence
  RNA Oligomer
ugaugauacuaaccuuucugcug

SEQ ID NO: 61432 - RNA, 23 nt, Artificial Sequence
  RNA Oligomer
gaugauacuaaccuuucugcugg

SEQ ID NO: 61433 - RNA, 23 nt, Artificial Sequence
  RNA Oligomer
augauacuaaccuuucugcuggu

SEQ ID NO: 61434 - RNA, 23 nt, Artificial Sequence
  RNA Oligomer
aauguaguuccacugucaagucu

SEQ ID NO: 61435 - RNA, 23 nt, Artificial Sequence
  RNA Oligomer
auguaguuccacugucaagucuu

SEQ ID NO: 61436 - RNA, 23 nt, Artificial Sequence
  RNA Oligomer
uguaguuccacugucaagucuua

SEQ ID NO: 61437 - RNA, 23 nt, Artificial Sequence
  RNA Oligomer
guaguuccacugucaagucuuaa

SEQ ID NO: 61438 - RNA, 23 nt, Artificial Sequence
  RNA Oligomer
uaguuccacugucaagucuuaac

SEQ ID NO: 61439 - RNA, 23 nt, Artificial Sequence
  RNA Oligomer
gcacaauguuuugaauugggugg

SEQ ID NO: 61440 - RNA, 23 nt, Artificial Sequence
  RNA Oligomer
cacaauguuuugaauuggguggg

SEQ ID NO: 61441 - RNA, 23 nt, Artificial Sequence
  RNA Oligomer
acaauguuuugaauuggguggga

SEQ ID NO: 61442 - RNA, 23 nt, Artificial Sequence
  RNA Oligomer
caauguuuugaauugggugggaa

SEQ ID NO: 61443 - RNA, 23 nt, Artificial Sequence
  RNA Oligomer
aauguuuugaauugggugggaau

SEQ ID NO: 61444 - RNA, 23 nt, Artificial Sequence
  RNA Oligomer
cauaucaaaguagaaacaaaugc

SEQ ID NO: 61445 - RNA, 23 nt, Artificial Sequence
  RNA Oligomer
auaucaaaguagaaacaaaugcu

SEQ ID NO: 61446 - RNA, 23 nt, Artificial Sequence
  RNA Oligomer
uaucaaaguagaaacaaaugcuu

SEQ ID NO: 61447 - RNA, 23 nt, Artificial Sequence
  RNA Oligomer
aucaaaguagaaacaaaugcuuc

SEQ ID NO: 61448 - RNA, 23 nt, Artificial Sequence
  RNA Oligomer
ucaaaguagaaacaaaugcuucc

SEQ ID NO: 61449 - RNA, 23 nt, Artificial Sequence
  RNA Oligomer
gaaaaaacugaucagcuauauag

SEQ ID NO: 61450 - RNA, 23 nt, Artificial Sequence
  RNA Oligomer
aaaaaacugaucagcuauauaga

SEQ ID NO: 61451 - RNA, 23 nt, Artificial Sequence
  RNA Oligomer
aaaaacugaucagcuauauagag

SEQ ID NO: 61452 - RNA, 23 nt, Artificial Sequence
  RNA Oligomer
aaaacugaucagcuauauagagu

SEQ ID NO: 61453 - RNA, 23 nt, Artificial Sequence
  RNA Oligomer
aaacugaucagcuauauagaguc

SEQ ID NO: 61454 - RNA, 23 nt, Artificial Sequence
  RNA Oligomer
auuacucguauaagaugcuaucu

SEQ ID NO: 61455 - RNA, 23 nt, Artificial Sequence
  RNA Oligomer
ccacaccuuaauauacauucugg

SEQ ID NO: 61456 - RNA, 23 nt, Artificial Sequence
  RNA Oligomer
cacaccuuaauauacauucuggu

SEQ ID NO: 61457 - RNA, 23 nt, Artificial Sequence
  RNA Oligomer
acaccuuaauauacauucuggug

SEQ ID NO: 61458 - RNA, 23 nt, Artificial Sequence
  RNA Oligomer
uaauauacauucuggugcugugu

SEQ ID NO: 61459 - RNA, 23 nt, Artificial Sequence
  RNA Oligomer
auguuuugaauugggugggaauc

SEQ ID NO: 61460 - RNA, 23 nt, Artificial Sequence
  RNA Oligomer
uuaaugucucucacucucuggcu

SEQ ID NO: 61461 - RNA, 23 nt, Artificial Sequence
  RNA Oligomer
uaaugucucucacucucuggcuu

SEQ ID NO: 61462 - RNA, 23 nt, Artificial Sequence
  RNA Oligomer
aaugucucucacucucuggcuuc

SEQ ID NO: 61463 - RNA, 23 nt, Artificial Sequence
  RNA Oligomer
augucucucacucucuggcuuca

SEQ ID NO: 61464 - RNA, 23 nt, Artificial Sequence
  RNA Oligomer
ggccaaacgugucuuccagucgg

SEQ ID NO: 61465 - RNA, 23 nt, Artificial Sequence
  RNA Oligomer
gccaaacgugucuuccagucggu

SEQ ID NO: 61466 - RNA, 23 nt, Artificial Sequence
  RNA Oligomer
ccaaacgugucuuccagucggua

SEQ ID NO: 61467 - RNA, 23 nt, Artificial Sequence
  RNA Oligomer
caaacgugucuuccagucgguaa

SEQ ID NO: 61468 - RNA, 23 nt, Artificial Sequence
  RNA Oligomer
aaacgugucuuccagucgguaag

SEQ ID NO: 61469 - RNA, 23 nt, Artificial Sequence
  RNA Oligomer
ugccaugucuccguacaucuucc

SEQ ID NO: 61470 - RNA, 23 nt, Artificial Sequence
  RNA Oligomer
gccaugucuccguacaucuuccu

SEQ ID NO: 61471 - RNA, 23 nt, Artificial Sequence
  RNA Oligomer
ccaugucuccguacaucuuccug

SEQ ID NO: 61472 - RNA, 23 nt, Artificial Sequence
  RNA Oligomer
caugucuccguacaucuuccugu

SEQ ID NO: 61473 - RNA, 23 nt, Artificial Sequence
  RNA Oligomer
augucuccguacaucuuccugua

SEQ ID NO: 61474 - RNA, 23 nt, Artificial Sequence
  RNA Oligomer
gugcaaacauguaacuuuugguc

SEQ ID NO: 61475 - RNA, 23 nt, Artificial Sequence
  RNA Oligomer
ugcaaacauguaacuuuugguca

SEQ ID NO: 61476 - RNA, 23 nt, Artificial Sequence
  RNA Oligomer
gcaaacauguaacuuuuggucac

SEQ ID NO: 61477 - RNA, 23 nt, Artificial Sequence
  RNA Oligomer
caaacauguaacuuuuggucaca

SEQ ID NO: 61478 - RNA, 23 nt, Artificial Sequence
  RNA Oligomer
aaacauguaacuuuuggucacac

SEQ ID NO: 61479 - RNA, 23 nt, Artificial Sequence
  RNA Oligomer
aacugaucagcuauauagaguca

SEQ ID NO: 61480 - RNA, 23 nt, Artificial Sequence
  RNA Oligomer
cuucuuaauguucucuuccaggu

SEQ ID NO: 61481 - RNA, 23 nt, Artificial Sequence
  RNA Oligomer
uucuuaauguucucuuccagguc

SEQ ID NO: 61482 - RNA, 23 nt, Artificial Sequence
  RNA Oligomer
ucuuaauguucucuuccagguca

SEQ ID NO: 61483 - RNA, 23 nt, Artificial Sequence
  RNA Oligomer
cuuaauguucucuuccaggucag

SEQ ID NO: 61484 - RNA, 23 nt, Artificial Sequence
  RNA Oligomer
uuaauguucucuuccaggucagc

SEQ ID NO: 61485 - RNA, 23 nt, Artificial Sequence
  RNA Oligomer
ucagaaauugaggcuaacauuga

SEQ ID NO: 61486 - RNA, 23 nt, Artificial Sequence
  RNA Oligomer
cagaaauugaggcuaacauugaa

SEQ ID NO: 61487 - RNA, 23 nt, Artificial Sequence
  RNA Oligomer
agaaauugaggcuaacauugaaa

SEQ ID NO: 61488 - RNA, 23 nt, Artificial Sequence
  RNA Oligomer
gaaauugaggcuaacauugaaau

SEQ ID NO: 61489 - RNA, 23 nt, Artificial Sequence
  RNA Oligomer
aaauugaggcuaacauugaaaua

SEQ ID NO: 61490 - RNA, 23 nt, Artificial Sequence
  RNA Oligomer
ccugaacagugucauucgaauca

SEQ ID NO: 61491 - RNA, 23 nt, Artificial Sequence
  RNA Oligomer
cugaacagugucauucgaaucag

SEQ ID NO: 61492 - RNA, 23 nt, Artificial Sequence
  RNA Oligomer
ugaacagugucauucgaaucaga

SEQ ID NO: 61493 - RNA, 23 nt, Artificial Sequence
  RNA Oligomer
gaacagugucauucgaaucagaa

SEQ ID NO: 61494 - RNA, 23 nt, Artificial Sequence
  RNA Oligomer
aacagugucauucgaaucagaau

SEQ ID NO: 61495 - RNA, 23 nt, Artificial Sequence
  RNA Oligomer
auuuuccuucucaauuacacuuc

SEQ ID NO: 61496 - RNA, 23 nt, Artificial Sequence
  RNA Oligomer
uuuuccuucucaauuacacuuca

SEQ ID NO: 61497 - RNA, 23 nt, Artificial Sequence
  RNA Oligomer
uuuccuucucaauuacacuucaa

SEQ ID NO: 61498 - RNA, 23 nt, Artificial Sequence
  RNA Oligomer
uuccuucucaauuacacuucaaa

SEQ ID NO: 61499 - RNA, 23 nt, Artificial Sequence
  RNA Oligomer
uccuucucaauuacacuucaaau

SEQ ID NO: 61500 - RNA, 23 nt, Artificial Sequence
  RNA Oligomer
caauuacacuucaaauagcaggc

SEQ ID NO: 61501 - RNA, 23 nt, Artificial Sequence
  RNA Oligomer
aauuacacuucaaauagcaggca

SEQ ID NO: 61502 - RNA, 23 nt, Artificial Sequence
  RNA Oligomer
auuacacuucaaauagcaggcau

SEQ ID NO: 61503 - RNA, 23 nt, Artificial Sequence
  RNA Oligomer
uuacacuucaaauagcaggcaua

SEQ ID NO: 61504 - RNA, 23 nt, Artificial Sequence
  RNA Oligomer
uacacuucaaauagcaggcauau

SEQ ID NO: 61505 - RNA, 23 nt, Artificial Sequence
  RNA Oligomer
uagcaggcauauuacucguauaa

SEQ ID NO: 61506 - RNA, 23 nt, Artificial Sequence
  RNA Oligomer
guacuaauguaguuccacuguca

SEQ ID NO: 61507 - RNA, 23 nt, Artificial Sequence
  RNA Oligomer
uacuaauguaguuccacugucaa

SEQ ID NO: 61508 - RNA, 23 nt, Artificial Sequence
  RNA Oligomer
acuaauguaguuccacugucaag

SEQ ID NO: 61509 - RNA, 23 nt, Artificial Sequence
  RNA Oligomer
cuaauguaguuccacugucaagu

SEQ ID NO: 61510 - RNA, 23 nt, Artificial Sequence
  RNA Oligomer
uaauguaguuccacugucaaguc

SEQ ID NO: 61511 - RNA, 23 nt, Artificial Sequence
  RNA Oligomer
gauagacuauuuguuugacaugg

SEQ ID NO: 61512 - RNA, 23 nt, Artificial Sequence
  RNA Oligomer
auagacuauuuguuugacauggc

SEQ ID NO: 61513 - RNA, 23 nt, Artificial Sequence
  RNA Oligomer
uagacuauuuguuugacauggca

SEQ ID NO: 61514 - RNA, 23 nt, Artificial Sequence
  RNA Oligomer
agacuauuuguuugacauggcac

SEQ ID NO: 61515 - RNA, 23 nt, Artificial Sequence
  RNA Oligomer
gacuauuuguuugacauggcaca

SEQ ID NO: 61516 - RNA, 23 nt, Artificial Sequence
  RNA Oligomer
acuauuuguuugacauggcacaa

SEQ ID NO: 61517 - RNA, 23 nt, Artificial Sequence
  RNA Oligomer
gcucuaaucauaguugggucugg

SEQ ID NO: 61518 - RNA, 23 nt, Artificial Sequence
  RNA Oligomer
cucuaaucauaguugggucuggg

SEQ ID NO: 61519 - RNA, 23 nt, Artificial Sequence
  RNA Oligomer
ucuaaucauaguugggucugggc

SEQ ID NO: 61520 - RNA, 23 nt, Artificial Sequence
  RNA Oligomer
cuaaucauaguugggucugggcc

SEQ ID NO: 61521 - RNA, 23 nt, Artificial Sequence
  RNA Oligomer
uaaucauaguugggucugggcca

SEQ ID NO: 61522 - RNA, 23 nt, Artificial Sequence
  RNA Oligomer
aguuaaugucucucacucucugg

SEQ ID NO: 61523 - RNA, 23 nt, Artificial Sequence
  RNA Oligomer
gaugaacaucauguucuucuuca

SEQ ID NO: 61524 - RNA, 23 nt, Artificial Sequence
  RNA Oligomer
augaacaucauguucuucuucau

SEQ ID NO: 61525 - RNA, 23 nt, Artificial Sequence
  RNA Oligomer
ugaacaucauguucuucuucaug

SEQ ID NO: 61526 - RNA, 23 nt, Artificial Sequence
  RNA Oligomer
gaacaucauguucuucuucauga

SEQ ID NO: 61527 - RNA, 23 nt, Artificial Sequence
  RNA Oligomer
aacaucauguucuucuucaugac

SEQ ID NO: 61528 - RNA, 23 nt, Artificial Sequence
  RNA Oligomer
guacauacuccacagaauuuagc

SEQ ID NO: 61529 - RNA, 23 nt, Artificial Sequence
  RNA Oligomer
uacauacuccacagaauuuagcu

SEQ ID NO: 61530 - RNA, 23 nt, Artificial Sequence
  RNA Oligomer
acauacuccacagaauuuagcuc

SEQ ID NO: 61531 - RNA, 23 nt, Artificial Sequence
  RNA Oligomer
cauacuccacagaauuuagcucg

SEQ ID NO: 61532 - RNA, 23 nt, Artificial Sequence
  RNA Oligomer
auacuccacagaauuuagcucgg

SEQ ID NO: 61533 - RNA, 23 nt, Artificial Sequence
  RNA Oligomer
uacuccacagaauuuagcucggu

SEQ ID NO: 61534 - RNA, 23 nt, Artificial Sequence
  RNA Oligomer
acuccacagaauuuagcucggua

SEQ ID NO: 61535 - RNA, 23 nt, Artificial Sequence
  RNA Oligomer
cuccacagaauuuagcucgguau

SEQ ID NO: 61536 - RNA, 23 nt, Artificial Sequence
  RNA Oligomer
uuccuaccuagaaaucagccugc

SEQ ID NO: 61537 - RNA, 23 nt, Artificial Sequence
  RNA Oligomer
uccuaccuagaaaucagccugcc

SEQ ID NO: 61538 - RNA, 23 nt, Artificial Sequence
  RNA Oligomer
ccuaccuagaaaucagccugcca

SEQ ID NO: 61539 - RNA, 23 nt, Artificial Sequence
  RNA Oligomer
cuaccuagaaaucagccugccaa

SEQ ID NO: 61540 - RNA, 23 nt, Artificial Sequence
  RNA Oligomer
uaccuagaaaucagccugccaag

SEQ ID NO: 61541 - RNA, 23 nt, Artificial Sequence
  RNA Oligomer
aagcuuuacauucuaccuauggu

SEQ ID NO: 61542 - RNA, 23 nt, Artificial Sequence
  RNA Oligomer
agcuuuacauucuaccuauggug

SEQ ID NO: 61543 - RNA, 23 nt, Artificial Sequence
  RNA Oligomer
gcuuuacauucuaccuauggugu

SEQ ID NO: 61544 - RNA, 23 nt, Artificial Sequence
  RNA Oligomer
cuuuacauucuaccuaugguguu

SEQ ID NO: 61545 - RNA, 23 nt, Artificial Sequence
  RNA Oligomer
uuuacauucuaccuaugguguuc

SEQ ID NO: 61546 - RNA, 23 nt, Artificial Sequence
  RNA Oligomer
uaccuaugguguucagaaauuga

SEQ ID NO: 61547 - RNA, 23 nt, Artificial Sequence
  RNA Oligomer
aauugaggcuaacauugaaauau

SEQ ID NO: 61548 - RNA, 23 nt, Artificial Sequence
  RNA Oligomer
aaaauaaaaaggcacaaacaacu

SEQ ID NO: 61549 - RNA, 23 nt, Artificial Sequence
  RNA Oligomer
aaauaaaaaggcacaaacaacuu

SEQ ID NO: 61550 - RNA, 23 nt, Artificial Sequence
  RNA Oligomer
aauaaaaaggcacaaacaacuuu

SEQ ID NO: 61551 - RNA, 23 nt, Artificial Sequence
  RNA Oligomer
auaaaaaggcacaaacaacuuua

SEQ ID NO: 61552 - RNA, 23 nt, Artificial Sequence
  RNA Oligomer
uaaaaaggcacaaacaacuuuaa

SEQ ID NO: 61553 - RNA, 23 nt, Artificial Sequence
  RNA Oligomer
agcacgcuaaaauuuuccuucuc

SEQ ID NO: 61554 - RNA, 23 nt, Artificial Sequence
  RNA Oligomer
ucaauuacacuucaaauagcagg

SEQ ID NO: 61555 - RNA, 23 nt, Artificial Sequence
  RNA Oligomer
aauauacauucuggugcugugua

SEQ ID NO: 61556 - RNA, 23 nt, Artificial Sequence
  RNA Oligomer
auauacauucuggugcuguguac

SEQ ID NO: 61557 - RNA, 23 nt, Artificial Sequence
  RNA Oligomer
uauacauucuggugcuguguacu

SEQ ID NO: 61558 - RNA, 23 nt, Artificial Sequence
  RNA Oligomer
uuccagucuaaugaguuaauguc

SEQ ID NO: 61559 - RNA, 23 nt, Artificial Sequence
  RNA Oligomer
uccagucuaaugaguuaaugucu

SEQ ID NO: 61560 - RNA, 23 nt, Artificial Sequence
  RNA Oligomer
ccagucuaaugaguuaaugucuc

SEQ ID NO: 61561 - RNA, 23 nt, Artificial Sequence
  RNA Oligomer
cagucuaaugaguuaaugucucu

SEQ ID NO: 61562 - RNA, 23 nt, Artificial Sequence
  RNA Oligomer
agucuaaugaguuaaugucucuc

SEQ ID NO: 61563 - RNA, 23 nt, Artificial Sequence
  RNA Oligomer
ugaguuaaugucucucacucucu

SEQ ID NO: 61564 - RNA, 23 nt, Artificial Sequence
  RNA Oligomer
gaguuaaugucucucacucucug

SEQ ID NO: 61565 - RNA, 23 nt, Artificial Sequence
  RNA Oligomer
cauguucuucuucaugaccucgc

SEQ ID NO: 61566 - RNA, 23 nt, Artificial Sequence
  RNA Oligomer
auguucuucuucaugaccucgcc

SEQ ID NO: 61567 - RNA, 23 nt, Artificial Sequence
  RNA Oligomer
uguucuucuucaugaccucgccg

SEQ ID NO: 61568 - RNA, 23 nt, Artificial Sequence
  RNA Oligomer
guucuucuucaugaccucgccgu

SEQ ID NO: 61569 - RNA, 23 nt, Artificial Sequence
  RNA Oligomer
uucuucuucaugaccucgccguc

SEQ ID NO: 61570 - RNA, 23 nt, Artificial Sequence
  RNA Oligomer
ucagcuauauagagucacucagu

SEQ ID NO: 61571 - RNA, 23 nt, Artificial Sequence
  RNA Oligomer
cagcuauauagagucacucaguu

SEQ ID NO: 61572 - RNA, 23 nt, Artificial Sequence
  RNA Oligomer
uuuaauaaaggccauuuguucau

SEQ ID NO: 61573 - RNA, 23 nt, Artificial Sequence
  RNA Oligomer
uuaauaaaggccauuuguucauu

SEQ ID NO: 61574 - RNA, 23 nt, Artificial Sequence
  RNA Oligomer
uaauaaaggccauuuguucauua

SEQ ID NO: 61575 - RNA, 23 nt, Artificial Sequence
  RNA Oligomer
aauaaaggccauuuguucauuaa

SEQ ID NO: 61576 - RNA, 23 nt, Artificial Sequence
  RNA Oligomer
auaaaggccauuuguucauuaaa

SEQ ID NO: 61577 - RNA, 23 nt, Artificial Sequence
  RNA Oligomer
ugcccuucuuaauguucucuucc

SEQ ID NO: 61578 - RNA, 23 nt, Artificial Sequence
  RNA Oligomer
cuaccuaugguguucagaaauug

SEQ ID NO: 61579 - RNA, 23 nt, Artificial Sequence
  RNA Oligomer
auugaggcuaacauugaaauauc

SEQ ID NO: 61580 - RNA, 23 nt, Artificial Sequence
  RNA Oligomer
gucucuugauggcuggagaaugc

SEQ ID NO: 61581 - RNA, 23 nt, Artificial Sequence
  RNA Oligomer
ucucuugauggcuggagaaugca

SEQ ID NO: 61582 - RNA, 23 nt, Artificial Sequence
  RNA Oligomer
cucuugauggcuggagaaugcac

SEQ ID NO: 61583 - RNA, 23 nt, Artificial Sequence
  RNA Oligomer
ucuugauggcuggagaaugcaca

SEQ ID NO: 61584 - RNA, 23 nt, Artificial Sequence
  RNA Oligomer
cuugauggcuggagaaugcacau

SEQ ID NO: 61585 - RNA, 23 nt, Artificial Sequence
  RNA Oligomer
ucagugagcacgcuaaaauuuuc

SEQ ID NO: 61586 - RNA, 23 nt, Artificial Sequence
  RNA Oligomer
gcacgcuaaaauuuuccuucuca

SEQ ID NO: 61587 - RNA, 23 nt, Artificial Sequence
  RNA Oligomer
uuacucguauaagaugcuaucug

SEQ ID NO: 61588 - RNA, 23 nt, Artificial Sequence
  RNA Oligomer
cugucaagucuuaacauucuuca

SEQ ID NO: 61589 - RNA, 23 nt, Artificial Sequence
  RNA Oligomer
ugucaagucuuaacauucuucaa

SEQ ID NO: 61590 - RNA, 23 nt, Artificial Sequence
  RNA Oligomer
gucaagucuuaacauucuucaaa

SEQ ID NO: 61591 - RNA, 23 nt, Artificial Sequence
  RNA Oligomer
ucaagucuuaacauucuucaaac

SEQ ID NO: 61592 - RNA, 23 nt, Artificial Sequence
  RNA Oligomer
caagucuuaacauucuucaaacc

SEQ ID NO: 61593 - RNA, 23 nt, Artificial Sequence
  RNA Oligomer
aaucauaguugggucugggccaa

SEQ ID NO: 61594 - RNA, 23 nt, Artificial Sequence
  RNA Oligomer
gugaaucaguucaaguuccaguc

SEQ ID NO: 61595 - RNA, 23 nt, Artificial Sequence
  RNA Oligomer
ugaaucaguucaaguuccagucu

SEQ ID NO: 61596 - RNA, 23 nt, Artificial Sequence
  RNA Oligomer
gaaucaguucaaguuccagucua

SEQ ID NO: 61597 - RNA, 23 nt, Artificial Sequence
  RNA Oligomer
aaucaguucaaguuccagucuaa

SEQ ID NO: 61598 - RNA, 23 nt, Artificial Sequence
  RNA Oligomer
aucaguucaaguuccagucuaau

SEQ ID NO: 61599 - RNA, 23 nt, Artificial Sequence
  RNA Oligomer
gucuaaugaguuaaugucucuca

SEQ ID NO: 61600 - RNA, 23 nt, Artificial Sequence
  RNA Oligomer
ugucuccguacaucuuccuguag

SEQ ID NO: 61601 - RNA, 23 nt, Artificial Sequence
  RNA Oligomer
gucuccguacaucuuccuguagu

SEQ ID NO: 61602 - RNA, 23 nt, Artificial Sequence
  RNA Oligomer
ucuccguacaucuuccuguagua

SEQ ID NO: 61603 - RNA, 23 nt, Artificial Sequence
  RNA Oligomer
uccacagaauuuagcucgguaug

SEQ ID NO: 61604 - RNA, 23 nt, Artificial Sequence
  RNA Oligomer
gaauuuagcucgguaugucuuca

SEQ ID NO: 61605 - RNA, 23 nt, Artificial Sequence
  RNA Oligomer
aauuuagcucgguaugucuucau

SEQ ID NO: 61606 - RNA, 23 nt, Artificial Sequence
  RNA Oligomer
auuuagcucgguaugucuucaug

SEQ ID NO: 61607 - RNA, 23 nt, Artificial Sequence
  RNA Oligomer
uuuagcucgguaugucuucaugc

SEQ ID NO: 61608 - RNA, 23 nt, Artificial Sequence
  RNA Oligomer
uuagcucgguaugucuucaugcu

SEQ ID NO: 61609 - RNA, 23 nt, Artificial Sequence
  RNA Oligomer
ccagaaagcucaaacuugauagg

SEQ ID NO: 61610 - RNA, 23 nt, Artificial Sequence
  RNA Oligomer
cagaaagcucaaacuugauaggc

SEQ ID NO: 61611 - RNA, 23 nt, Artificial Sequence
  RNA Oligomer
agaaagcucaaacuugauaggcu

SEQ ID NO: 61612 - RNA, 23 nt, Artificial Sequence
  RNA Oligomer
gaaagcucaaacuugauaggcuu

SEQ ID NO: 61613 - RNA, 23 nt, Artificial Sequence
  RNA Oligomer
aaagcucaaacuugauaggcuug

SEQ ID NO: 61614 - RNA, 23 nt, Artificial Sequence
  RNA Oligomer
cuugauaggcuuggagauuuugg

SEQ ID NO: 61615 - RNA, 23 nt, Artificial Sequence
  RNA Oligomer
uugauaggcuuggagauuuuggg

SEQ ID NO: 61616 - RNA, 23 nt, Artificial Sequence
  RNA Oligomer
ugauaggcuuggagauuuuggga

SEQ ID NO: 61617 - RNA, 23 nt, Artificial Sequence
  RNA Oligomer
gauaggcuuggagauuuugggag

SEQ ID NO: 61618 - RNA, 23 nt, Artificial Sequence
  RNA Oligomer
auaggcuuggagauuuugggagu

SEQ ID NO: 61619 - RNA, 23 nt, Artificial Sequence
  RNA Oligomer
gaaaaacagucauaucaaaguag

SEQ ID NO: 61620 - RNA, 23 nt, Artificial Sequence
  RNA Oligomer
aaaaacagucauaucaaaguaga

SEQ ID NO: 61621 - RNA, 23 nt, Artificial Sequence
  RNA Oligomer
aaaacagucauaucaaaguagaa

SEQ ID NO: 61622 - RNA, 23 nt, Artificial Sequence
  RNA Oligomer
aaacagucauaucaaaguagaaa

SEQ ID NO: 61623 - RNA, 23 nt, Artificial Sequence
  RNA Oligomer
aacagucauaucaaaguagaaac

SEQ ID NO: 61624 - RNA, 23 nt, Artificial Sequence
  RNA Oligomer
ccauauaaguauccauuucaugc

SEQ ID NO: 61625 - RNA, 23 nt, Artificial Sequence
  RNA Oligomer
cauauaaguauccauuucaugcu

SEQ ID NO: 61626 - RNA, 23 nt, Artificial Sequence
  RNA Oligomer
auauaaguauccauuucaugcuu

SEQ ID NO: 61627 - RNA, 23 nt, Artificial Sequence
  RNA Oligomer
uauaaguauccauuucaugcuuu

SEQ ID NO: 61628 - RNA, 23 nt, Artificial Sequence
  RNA Oligomer
auaaguauccauuucaugcuuug

SEQ ID NO: 61629 - RNA, 23 nt, Artificial Sequence
  RNA Oligomer
uuugaacgaucagacaagcuuua

SEQ ID NO: 61630 - RNA, 23 nt, Artificial Sequence
  RNA Oligomer
uugaacgaucagacaagcuuuac

SEQ ID NO: 61631 - RNA, 23 nt, Artificial Sequence
  RNA Oligomer
ugaacgaucagacaagcuuuaca

SEQ ID NO: 61632 - RNA, 23 nt, Artificial Sequence
  RNA Oligomer
gaacgaucagacaagcuuuacau

SEQ ID NO: 61633 - RNA, 23 nt, Artificial Sequence
  RNA Oligomer
aacgaucagacaagcuuuacauu

SEQ ID NO: 61634 - RNA, 23 nt, Artificial Sequence
  RNA Oligomer
cgaucagacaagcuuuacauucu

SEQ ID NO: 61635 - RNA, 23 nt, Artificial Sequence
  RNA Oligomer
gaucagacaagcuuuacauucua

SEQ ID NO: 61636 - RNA, 23 nt, Artificial Sequence
  RNA Oligomer
aucagacaagcuuuacauucuac

SEQ ID NO: 61637 - RNA, 23 nt, Artificial Sequence
  RNA Oligomer
ucagacaagcuuuacauucuacc

SEQ ID NO: 61638 - RNA, 23 nt, Artificial Sequence
  RNA Oligomer
cagacaagcuuuacauucuaccu

SEQ ID NO: 61639 - RNA, 23 nt, Artificial Sequence
  RNA Oligomer
agacaagcuuuacauucuaccua

SEQ ID NO: 61640 - RNA, 23 nt, Artificial Sequence
  RNA Oligomer
gacaagcuuuacauucuaccuau

SEQ ID NO: 61641 - RNA, 23 nt, Artificial Sequence
  RNA Oligomer
acaagcuuuacauucuaccuaug

SEQ ID NO: 61642 - RNA, 23 nt, Artificial Sequence
  RNA Oligomer
caagcuuuacauucuaccuaugg

SEQ ID NO: 61643 - RNA, 23 nt, Artificial Sequence
  RNA Oligomer
uaauguucucuuccaggucagcu

SEQ ID NO: 61644 - RNA, 23 nt, Artificial Sequence
  RNA Oligomer
aauguucucuuccaggucagcuu

SEQ ID NO: 61645 - RNA, 23 nt, Artificial Sequence
  RNA Oligomer
ugguguucagaaauugaggcuaa

SEQ ID NO: 61646 - RNA, 23 nt, Artificial Sequence
  RNA Oligomer
gguguucagaaauugaggcuaac

SEQ ID NO: 61647 - RNA, 23 nt, Artificial Sequence
  RNA Oligomer
aaaaaggcacaaacaacuuuaaa

SEQ ID NO: 61648 - RNA, 23 nt, Artificial Sequence
  RNA Oligomer
aaaaggcacaaacaacuuuaaau

SEQ ID NO: 61649 - RNA, 23 nt, Artificial Sequence
  RNA Oligomer
acgcuaaaauuuuccuucucaau

SEQ ID NO: 61650 - RNA, 23 nt, Artificial Sequence
  RNA Oligomer
ucguauaagaugcuaucugauga

SEQ ID NO: 61651 - RNA, 23 nt, Artificial Sequence
  RNA Oligomer
cguauaagaugcuaucugaugau

SEQ ID NO: 61652 - RNA, 23 nt, Artificial Sequence
  RNA Oligomer
guauaagaugcuaucugaugaua

SEQ ID NO: 61653 - RNA, 23 nt, Artificial Sequence
  RNA Oligomer
uauaagaugcuaucugaugauac

SEQ ID NO: 61654 - RNA, 23 nt, Artificial Sequence
  RNA Oligomer
auaagaugcuaucugaugauacu

SEQ ID NO: 61655 - RNA, 23 nt, Artificial Sequence
  RNA Oligomer
ugcuacugaaaucauuuuuacgg

SEQ ID NO: 61656 - RNA, 23 nt, Artificial Sequence
  RNA Oligomer
gcuacugaaaucauuuuuacgga

SEQ ID NO: 61657 - RNA, 23 nt, Artificial Sequence
  RNA Oligomer
cuacugaaaucauuuuuacggaa

SEQ ID NO: 61658 - RNA, 23 nt, Artificial Sequence
  RNA Oligomer
uacugaaaucauuuuuacggaaa

SEQ ID NO: 61659 - RNA, 23 nt, Artificial Sequence
  RNA Oligomer
acugaaaucauuuuuacggaaaa

SEQ ID NO: 61660 - RNA, 23 nt, Artificial Sequence
  RNA Oligomer
augaguuaaugucucucacucuc

SEQ ID NO: 61661 - RNA, 23 nt, Artificial Sequence
  RNA Oligomer
aacgugucuuccagucgguaagc

SEQ ID NO: 61662 - RNA, 23 nt, Artificial Sequence
  RNA Oligomer
acagaauuuagcucgguaugucu

SEQ ID NO: 61663 - RNA, 23 nt, Artificial Sequence
  RNA Oligomer
cagaauuuagcucgguaugucuu

SEQ ID NO: 61664 - RNA, 23 nt, Artificial Sequence
  RNA Oligomer
agaauuuagcucgguaugucuuc

SEQ ID NO: 61665 - RNA, 23 nt, Artificial Sequence
  RNA Oligomer
gccagaaagcucaaacuugauag

SEQ ID NO: 61666 - RNA, 23 nt, Artificial Sequence
  RNA Oligomer
aagcucaaacuugauaggcuugg

SEQ ID NO: 61667 - RNA, 23 nt, Artificial Sequence
  RNA Oligomer
aggugcaaacauguaacuuuugg

SEQ ID NO: 61668 - RNA, 23 nt, Artificial Sequence
  RNA Oligomer
ggugcaaacauguaacuuuuggu

SEQ ID NO: 61669 - RNA, 23 nt, Artificial Sequence
  RNA Oligomer
aacauguaacuuuuggucacacu

SEQ ID NO: 61670 - RNA, 23 nt, Artificial Sequence
  RNA Oligomer
cacucucaacaaauaaacugucc

SEQ ID NO: 61671 - RNA, 23 nt, Artificial Sequence
  RNA Oligomer
acucucaacaaauaaacuguccg

SEQ ID NO: 61672 - RNA, 23 nt, Artificial Sequence
  RNA Oligomer
cucucaacaaauaaacuguccga

SEQ ID NO: 61673 - RNA, 23 nt, Artificial Sequence
  RNA Oligomer
ucucaacaaauaaacuguccgaa

SEQ ID NO: 61674 - RNA, 23 nt, Artificial Sequence
  RNA Oligomer
cucaacaaauaaacuguccgaaa

SEQ ID NO: 61675 - RNA, 23 nt, Artificial Sequence
  RNA Oligomer
gucacucaguuuuuaauaaaggc

SEQ ID NO: 61676 - RNA, 23 nt, Artificial Sequence
  RNA Oligomer
ucacucaguuuuuaauaaaggcc

SEQ ID NO: 61677 - RNA, 23 nt, Artificial Sequence
  RNA Oligomer
cacucaguuuuuaauaaaggcca

SEQ ID NO: 61678 - RNA, 23 nt, Artificial Sequence
  RNA Oligomer
acucaguuuuuaauaaaggccau

SEQ ID NO: 61679 - RNA, 23 nt, Artificial Sequence
  RNA Oligomer
cucaguuuuuaauaaaggccauu

SEQ ID NO: 61680 - RNA, 23 nt, Artificial Sequence
  RNA Oligomer
aaaaauaaaaaggcacaaacaac

SEQ ID NO: 61681 - RNA, 23 nt, Artificial Sequence
  RNA Oligomer
aaaggcacaaacaacuuuaaauu

SEQ ID NO: 61682 - RNA, 23 nt, Artificial Sequence
  RNA Oligomer
acagugucauucgaaucagaaug

SEQ ID NO: 61683 - RNA, 23 nt, Artificial Sequence
  RNA Oligomer
gagucugcuguucugacuuaagg

SEQ ID NO: 61684 - RNA, 23 nt, Artificial Sequence
  RNA Oligomer
agucugcuguucugacuuaagga

SEQ ID NO: 61685 - RNA, 23 nt, Artificial Sequence
  RNA Oligomer
gucugcuguucugacuuaaggaa

SEQ ID NO: 61686 - RNA, 23 nt, Artificial Sequence
  RNA Oligomer
ucugcuguucugacuuaaggaac

SEQ ID NO: 61687 - RNA, 23 nt, Artificial Sequence
  RNA Oligomer
cugcuguucugacuuaaggaaca

SEQ ID NO: 61688 - RNA, 23 nt, Artificial Sequence
  RNA Oligomer
uucaaauagcaggcauauuacuc

SEQ ID NO: 61689 - RNA, 23 nt, Artificial Sequence
  RNA Oligomer
uacucguauaagaugcuaucuga

SEQ ID NO: 61690 - RNA, 23 nt, Artificial Sequence
  RNA Oligomer
acugucaagucuuaacauucuuc

SEQ ID NO: 61691 - RNA, 23 nt, Artificial Sequence
  RNA Oligomer
gauuuaaauaacuugugcuacug

SEQ ID NO: 61692 - RNA, 23 nt, Artificial Sequence
  RNA Oligomer
auuuaaauaacuugugcuacuga

SEQ ID NO: 61693 - RNA, 23 nt, Artificial Sequence
  RNA Oligomer
uuuaaauaacuugugcuacugaa

SEQ ID NO: 61694 - RNA, 23 nt, Artificial Sequence
  RNA Oligomer
uuaaauaacuugugcuacugaaa

SEQ ID NO: 61695 - RNA, 23 nt, Artificial Sequence
  RNA Oligomer
uaaauaacuugugcuacugaaau

SEQ ID NO: 61696 - RNA, 23 nt, Artificial Sequence
  RNA Oligomer
ugugaaucaguucaaguuccagu

SEQ ID NO: 61697 - RNA, 23 nt, Artificial Sequence
  RNA Oligomer
caaguuccagucuaaugaguuaa

SEQ ID NO: 61698 - RNA, 23 nt, Artificial Sequence
  RNA Oligomer
aaguuccagucuaaugaguuaau

SEQ ID NO: 61699 - RNA, 23 nt, Artificial Sequence
  RNA Oligomer
aguuccagucuaaugaguuaaug

SEQ ID NO: 61700 - RNA, 23 nt, Artificial Sequence
  RNA Oligomer
guuccagucuaaugaguuaaugu

SEQ ID NO: 61701 - RNA, 23 nt, Artificial Sequence
  RNA Oligomer
gggccaaacgugucuuccagucg

SEQ ID NO: 61702 - RNA, 23 nt, Artificial Sequence
  RNA Oligomer
cacagaauuuagcucgguauguc

SEQ ID NO: 61703 - RNA, 23 nt, Artificial Sequence
  RNA Oligomer
auguaacuuuuggucacacucuc

SEQ ID NO: 61704 - RNA, 23 nt, Artificial Sequence
  RNA Oligomer
uguaacuuuuggucacacucuca

SEQ ID NO: 61705 - RNA, 23 nt, Artificial Sequence
  RNA Oligomer
guaacuuuuggucacacucucaa

SEQ ID NO: 61706 - RNA, 23 nt, Artificial Sequence
  RNA Oligomer
uaacuuuuggucacacucucaac

SEQ ID NO: 61707 - RNA, 23 nt, Artificial Sequence
  RNA Oligomer
auguucucuuccaggucagcuuc

SEQ ID NO: 61708 - RNA, 23 nt, Artificial Sequence
  RNA Oligomer
uucucaauuacacuucaaauagc

SEQ ID NO: 61709 - RNA, 23 nt, Artificial Sequence
  RNA Oligomer
ucucaauuacacuucaaauagca

SEQ ID NO: 61710 - RNA, 23 nt, Artificial Sequence
  RNA Oligomer
cucaauuacacuucaaauagcag

SEQ ID NO: 61711 - RNA, 23 nt, Artificial Sequence
  RNA Oligomer
uguacuaauguaguuccacuguc

SEQ ID NO: 61712 - RNA, 23 nt, Artificial Sequence
  RNA Oligomer
ccacugucaagucuuaacauucu

SEQ ID NO: 61713 - RNA, 23 nt, Artificial Sequence
  RNA Oligomer
cacugucaagucuuaacauucuu

SEQ ID NO: 61714 - RNA, 23 nt, Artificial Sequence
  RNA Oligomer
cggaaaaaugagaugugaaucag

SEQ ID NO: 61715 - RNA, 23 nt, Artificial Sequence
  RNA Oligomer
ggaaaaaugagaugugaaucagu

SEQ ID NO: 61716 - RNA, 23 nt, Artificial Sequence
  RNA Oligomer
gaaaaaugagaugugaaucaguu

SEQ ID NO: 61717 - RNA, 23 nt, Artificial Sequence
  RNA Oligomer
aaaaaugagaugugaaucaguuc

SEQ ID NO: 61718 - RNA, 23 nt, Artificial Sequence
  RNA Oligomer
aaaaugagaugugaaucaguuca

SEQ ID NO: 61719 - RNA, 23 nt, Artificial Sequence
  RNA Oligomer
ucuucuucaugaccucgccguca

SEQ ID NO: 61720 - RNA, 23 nt, Artificial Sequence
  RNA Oligomer
cuucuucaugaccucgccgucag

SEQ ID NO: 61721 - RNA, 23 nt, Artificial Sequence
  RNA Oligomer
uucuucaugaccucgccgucagg

SEQ ID NO: 61722 - RNA, 23 nt, Artificial Sequence
  RNA Oligomer
uagcucgguaugucuucaugcug

SEQ ID NO: 61723 - RNA, 23 nt, Artificial Sequence
  RNA Oligomer
gcucaaacuugauaggcuuggag

SEQ ID NO: 61724 - RNA, 23 nt, Artificial Sequence
  RNA Oligomer
cucaaacuugauaggcuuggaga

SEQ ID NO: 61725 - RNA, 23 nt, Artificial Sequence
  RNA Oligomer
ucaaacuugauaggcuuggagau

SEQ ID NO: 61726 - RNA, 23 nt, Artificial Sequence
  RNA Oligomer
caaacuugauaggcuuggagauu

SEQ ID NO: 61727 - RNA, 23 nt, Artificial Sequence
  RNA Oligomer
aaacuugauaggcuuggagauuu

SEQ ID NO: 61728 - RNA, 23 nt, Artificial Sequence
  RNA Oligomer
aggcuuggagauuuugggaguac

SEQ ID NO: 61729 - RNA, 23 nt, Artificial Sequence
  RNA Oligomer
ggcuuggagauuuugggaguacg

SEQ ID NO: 61730 - RNA, 23 nt, Artificial Sequence
  RNA Oligomer
gcuuggagauuuugggaguacgg

SEQ ID NO: 61731 - RNA, 23 nt, Artificial Sequence
  RNA Oligomer
cuuggagauuuugggaguacgga

SEQ ID NO: 61732 - RNA, 23 nt, Artificial Sequence
  RNA Oligomer
uuggagauuuugggaguacggau

SEQ ID NO: 61733 - RNA, 23 nt, Artificial Sequence
  RNA Oligomer
cacacucucaacaaauaaacugu

SEQ ID NO: 61734 - RNA, 23 nt, Artificial Sequence
  RNA Oligomer
acacucucaacaaauaaacuguc

SEQ ID NO: 61735 - RNA, 23 nt, Artificial Sequence
  RNA Oligomer
ucaacaaauaaacuguccgaaaa

SEQ ID NO: 61736 - RNA, 23 nt, Artificial Sequence
  RNA Oligomer
uaaaggccauuuguucauuaaaa

SEQ ID NO: 61737 - RNA, 23 nt, Artificial Sequence
  RNA Oligomer
aaaggccauuuguucauuaaaag

SEQ ID NO: 61738 - RNA, 23 nt, Artificial Sequence
  RNA Oligomer
aaggccauuuguucauuaaaagu

SEQ ID NO: 61739 - RNA, 23 nt, Artificial Sequence
  RNA Oligomer
acauuuccuaccuagaaaucagc

SEQ ID NO: 61740 - RNA, 23 nt, Artificial Sequence
  RNA Oligomer
cauuuccuaccuagaaaucagcc

SEQ ID NO: 61741 - RNA, 23 nt, Artificial Sequence
  RNA Oligomer
auuuccuaccuagaaaucagccu

SEQ ID NO: 61742 - RNA, 23 nt, Artificial Sequence
  RNA Oligomer
uuuccuaccuagaaaucagccug

SEQ ID NO: 61743 - RNA, 23 nt, Artificial Sequence
  RNA Oligomer
ccuccccuuugcaaacaaucugu

SEQ ID NO: 61744 - RNA, 23 nt, Artificial Sequence
  RNA Oligomer
cuccccuuugcaaacaaucuguu

SEQ ID NO: 61745 - RNA, 23 nt, Artificial Sequence
  RNA Oligomer
uccccuuugcaaacaaucuguuu

SEQ ID NO: 61746 - RNA, 23 nt, Artificial Sequence
  RNA Oligomer
ccccuuugcaaacaaucuguuuu

SEQ ID NO: 61747 - RNA, 23 nt, Artificial Sequence
  RNA Oligomer
cccuuugcaaacaaucuguuuug

SEQ ID NO: 61748 - RNA, 23 nt, Artificial Sequence
  RNA Oligomer
ccgauuccugaacagugucauuc

SEQ ID NO: 61749 - RNA, 23 nt, Artificial Sequence
  RNA Oligomer
cgauuccugaacagugucauucg

SEQ ID NO: 61750 - RNA, 23 nt, Artificial Sequence
  RNA Oligomer
gauuccugaacagugucauucga

SEQ ID NO: 61751 - RNA, 23 nt, Artificial Sequence
  RNA Oligomer
auuccugaacagugucauucgaa

SEQ ID NO: 61752 - RNA, 23 nt, Artificial Sequence
  RNA Oligomer
uuccugaacagugucauucgaau

SEQ ID NO: 61753 - RNA, 23 nt, Artificial Sequence
  RNA Oligomer
uaagaugcuaucugaugauacua

SEQ ID NO: 61754 - RNA, 23 nt, Artificial Sequence
  RNA Oligomer
uaucugaugauacuaaccuuucu

SEQ ID NO: 61755 - RNA, 23 nt, Artificial Sequence
  RNA Oligomer
aucugaugauacuaaccuuucug

SEQ ID NO: 61756 - RNA, 23 nt, Artificial Sequence
  RNA Oligomer
aagccacaccuuaauauacauuc

SEQ ID NO: 61757 - RNA, 23 nt, Artificial Sequence
  RNA Oligomer
agccacaccuuaauauacauucu

SEQ ID NO: 61758 - RNA, 23 nt, Artificial Sequence
  RNA Oligomer
gccacaccuuaauauacauucug

SEQ ID NO: 61759 - RNA, 23 nt, Artificial Sequence
  RNA Oligomer
guguacuaauguaguuccacugu

SEQ ID NO: 61760 - RNA, 23 nt, Artificial Sequence
  RNA Oligomer
aucauaguugggucugggccaaa

SEQ ID NO: 61761 - RNA, 23 nt, Artificial Sequence
  RNA Oligomer
caguucaaguuccagucuaauga

SEQ ID NO: 61762 - RNA, 23 nt, Artificial Sequence
  RNA Oligomer
aguucaaguuccagucuaaugag

SEQ ID NO: 61763 - RNA, 23 nt, Artificial Sequence
  RNA Oligomer
guucaaguuccagucuaaugagu

SEQ ID NO: 61764 - RNA, 23 nt, Artificial Sequence
  RNA Oligomer
uucaaguuccagucuaaugaguu

SEQ ID NO: 61765 - RNA, 23 nt, Artificial Sequence
  RNA Oligomer
ucaaguuccagucuaaugaguua

SEQ ID NO: 61766 - RNA, 23 nt, Artificial Sequence
  RNA Oligomer
aacuugauaggcuuggagauuuu

SEQ ID NO: 61767 - RNA, 23 nt, Artificial Sequence
  RNA Oligomer
acuugauaggcuuggagauuuug

SEQ ID NO: 61768 - RNA, 23 nt, Artificial Sequence
  RNA Oligomer
cauguaacuuuuggucacacucu

SEQ ID NO: 61769 - RNA, 23 nt, Artificial Sequence
  RNA Oligomer
ucacacucucaacaaauaaacug

SEQ ID NO: 61770 - RNA, 23 nt, Artificial Sequence
  RNA Oligomer
aggcuaccacauuuccuaccuag

SEQ ID NO: 61771 - RNA, 23 nt, Artificial Sequence
  RNA Oligomer
ggcuaccacauuuccuaccuaga

SEQ ID NO: 61772 - RNA, 23 nt, Artificial Sequence
  RNA Oligomer
gcuaccacauuuccuaccuagaa

SEQ ID NO: 61773 - RNA, 23 nt, Artificial Sequence
  RNA Oligomer
cuaccacauuuccuaccuagaaa

SEQ ID NO: 61774 - RNA, 23 nt, Artificial Sequence
  RNA Oligomer
uaccacauuuccuaccuagaaau

SEQ ID NO: 61775 - RNA, 23 nt, Artificial Sequence
  RNA Oligomer
cacauuuccuaccuagaaaucag

SEQ ID NO: 61776 - RNA, 23 nt, Artificial Sequence
  RNA Oligomer
accuagaaaucagccugccaagg

SEQ ID NO: 61777 - RNA, 23 nt, Artificial Sequence
  RNA Oligomer
ggacugucauucuaucugagcag

SEQ ID NO: 61778 - RNA, 23 nt, Artificial Sequence
  RNA Oligomer
gacugucauucuaucugagcaga

SEQ ID NO: 61779 - RNA, 23 nt, Artificial Sequence
  RNA Oligomer
acugucauucuaucugagcagaa

SEQ ID NO: 61780 - RNA, 23 nt, Artificial Sequence
  RNA Oligomer
cugucauucuaucugagcagaau

SEQ ID NO: 61781 - RNA, 23 nt, Artificial Sequence
  RNA Oligomer
ugucauucuaucugagcagaauu

SEQ ID NO: 61782 - RNA, 23 nt, Artificial Sequence
  RNA Oligomer
aaggcacaaacaacuuuaaauua

SEQ ID NO: 61783 - RNA, 23 nt, Artificial Sequence
  RNA Oligomer
aaaauuuuccuucucaauuacac

SEQ ID NO: 61784 - RNA, 23 nt, Artificial Sequence
  RNA Oligomer
aaauuuuccuucucaauuacacu

SEQ ID NO: 61785 - RNA, 23 nt, Artificial Sequence
  RNA Oligomer
aauuuuccuucucaauuacacuu

SEQ ID NO: 61786 - RNA, 23 nt, Artificial Sequence
  RNA Oligomer
acucguauaagaugcuaucugau

SEQ ID NO: 61787 - RNA, 23 nt, Artificial Sequence
  RNA Oligomer
cucguauaagaugcuaucugaug

SEQ ID NO: 61788 - RNA, 23 nt, Artificial Sequence
  RNA Oligomer
aagucuuaacauucuucaaacca

SEQ ID NO: 61789 - RNA, 23 nt, Artificial Sequence
  RNA Oligomer
agucuuaacauucuucaaaccag

SEQ ID NO: 61790 - RNA, 23 nt, Artificial Sequence
  RNA Oligomer
gucuuaacauucuucaaaccagu

SEQ ID NO: 61791 - RNA, 23 nt, Artificial Sequence
  RNA Oligomer
ucuuaacauucuucaaaccagug

SEQ ID NO: 61792 - RNA, 23 nt, Artificial Sequence
  RNA Oligomer
aacauucuucaaaccagugucug

SEQ ID NO: 61793 - RNA, 23 nt, Artificial Sequence
  RNA Oligomer
acauucuucaaaccagugucugg

SEQ ID NO: 61794 - RNA, 23 nt, Artificial Sequence
  RNA Oligomer
cauucuucaaaccagugucuggg

SEQ ID NO: 61795 - RNA, 23 nt, Artificial Sequence
  RNA Oligomer
auucuucaaaccagugucugggg

SEQ ID NO: 61796 - RNA, 23 nt, Artificial Sequence
  RNA Oligomer
uucuucaaaccagugucuggggu

SEQ ID NO: 61797 - RNA, 23 nt, Artificial Sequence
  RNA Oligomer
uguuuugaauugggugggaaucu

SEQ ID NO: 61798 - RNA, 23 nt, Artificial Sequence
  RNA Oligomer
aaauaacuugugcuacugaaauc

SEQ ID NO: 61799 - RNA, 23 nt, Artificial Sequence
  RNA Oligomer
aauaacuugugcuacugaaauca

SEQ ID NO: 61800 - RNA, 23 nt, Artificial Sequence
  RNA Oligomer
auaacuugugcuacugaaaucau

SEQ ID NO: 61801 - RNA, 23 nt, Artificial Sequence
  RNA Oligomer
uaacuugugcuacugaaaucauu

SEQ ID NO: 61802 - RNA, 23 nt, Artificial Sequence
  RNA Oligomer
aacuugugcuacugaaaucauuu

SEQ ID NO: 61803 - RNA, 23 nt, Artificial Sequence
  RNA Oligomer
acuugugcuacugaaaucauuuu

SEQ ID NO: 61804 - RNA, 23 nt, Artificial Sequence
  RNA Oligomer
guaguacagcgauucaaagaugu

SEQ ID NO: 61805 - RNA, 23 nt, Artificial Sequence
  RNA Oligomer
uaguacagcgauucaaagauguc

SEQ ID NO: 61806 - RNA, 23 nt, Artificial Sequence
  RNA Oligomer
aguacagcgauucaaagauguca

SEQ ID NO: 61807 - RNA, 23 nt, Artificial Sequence
  RNA Oligomer
guacagcgauucaaagaugucau

SEQ ID NO: 61808 - RNA, 23 nt, Artificial Sequence
  RNA Oligomer
uacagcgauucaaagaugucauu

SEQ ID NO: 61809 - RNA, 23 nt, Artificial Sequence
  RNA Oligomer
cgguacauacuccacagaauuua

SEQ ID NO: 61810 - RNA, 23 nt, Artificial Sequence
  RNA Oligomer
gguacauacuccacagaauuuag

SEQ ID NO: 61811 - RNA, 23 nt, Artificial Sequence
  RNA Oligomer
acauguaacuuuuggucacacuc

SEQ ID NO: 61812 - RNA, 23 nt, Artificial Sequence
  RNA Oligomer
caacaaauaaacuguccgaaaaa

SEQ ID NO: 61813 - RNA, 23 nt, Artificial Sequence
  RNA Oligomer
guagaaacaaaugcuuccaggug

SEQ ID NO: 61814 - RNA, 23 nt, Artificial Sequence
  RNA Oligomer
uagaaacaaaugcuuccagguga

SEQ ID NO: 61815 - RNA, 23 nt, Artificial Sequence
  RNA Oligomer
agaaacaaaugcuuccaggugaa

SEQ ID NO: 61816 - RNA, 23 nt, Artificial Sequence
  RNA Oligomer
gaaacaaaugcuuccaggugaaa

SEQ ID NO: 61817 - RNA, 23 nt, Artificial Sequence
  RNA Oligomer
aaacaaaugcuuccaggugaaaa

SEQ ID NO: 61818 - RNA, 23 nt, Artificial Sequence
  RNA Oligomer
ccacauuuccuaccuagaaauca

SEQ ID NO: 61819 - RNA, 23 nt, Artificial Sequence
  RNA Oligomer
uuuuaaaaaaucuggcuuguuac

SEQ ID NO: 61820 - RNA, 23 nt, Artificial Sequence
  RNA Oligomer
uuuaaaaaaucuggcuuguuaca

SEQ ID NO: 61821 - RNA, 23 nt, Artificial Sequence
  RNA Oligomer
uuaaaaaaucuggcuuguuacag

SEQ ID NO: 61822 - RNA, 23 nt, Artificial Sequence
  RNA Oligomer
uaaaaaaucuggcuuguuacagg

SEQ ID NO: 61823 - RNA, 23 nt, Artificial Sequence
  RNA Oligomer
aaaaaaucuggcuuguuacaggc

SEQ ID NO: 61824 - RNA, 23 nt, Artificial Sequence
  RNA Oligomer
uccugaacagugucauucgaauc

SEQ ID NO: 61825 - RNA, 23 nt, Artificial Sequence
  RNA Oligomer
gaagucacagaagaggcccuugu

SEQ ID NO: 61826 - RNA, 23 nt, Artificial Sequence
  RNA Oligomer
aagucacagaagaggcccuugug

SEQ ID NO: 61827 - RNA, 23 nt, Artificial Sequence
  RNA Oligomer
agucacagaagaggcccuugugc

SEQ ID NO: 61828 - RNA, 23 nt, Artificial Sequence
  RNA Oligomer
gucacagaagaggcccuugugcg

SEQ ID NO: 61829 - RNA, 23 nt, Artificial Sequence
  RNA Oligomer
ucacagaagaggcccuugugcgg

SEQ ID NO: 61830 - RNA, 23 nt, Artificial Sequence
  RNA Oligomer
ucucucacucucuggcuucaugc

SEQ ID NO: 61831 - RNA, 23 nt, Artificial Sequence
  RNA Oligomer
cucucacucucuggcuucaugcc

SEQ ID NO: 61832 - RNA, 23 nt, Artificial Sequence
  RNA Oligomer
ucucacucucuggcuucaugcca

SEQ ID NO: 61833 - RNA, 23 nt, Artificial Sequence
  RNA Oligomer
cucacucucuggcuucaugccau

SEQ ID NO: 61834 - RNA, 23 nt, Artificial Sequence
  RNA Oligomer
ucacucucuggcuucaugccaug

SEQ ID NO: 61835 - RNA, 23 nt, Artificial Sequence
  RNA Oligomer
cuggcuucaugccaugucuccgu

SEQ ID NO: 61836 - RNA, 23 nt, Artificial Sequence
  RNA Oligomer
uggcuucaugccaugucuccgua

SEQ ID NO: 61837 - RNA, 23 nt, Artificial Sequence
  RNA Oligomer
ggcuucaugccaugucuccguac

SEQ ID NO: 61838 - RNA, 23 nt, Artificial Sequence
  RNA Oligomer
gcuucaugccaugucuccguaca

SEQ ID NO: 61839 - RNA, 23 nt, Artificial Sequence
  RNA Oligomer
cuucaugccaugucuccguacau

SEQ ID NO: 61840 - RNA, 23 nt, Artificial Sequence
  RNA Oligomer
uauuuucaacuagaaaggugcaa

SEQ ID NO: 61841 - RNA, 23 nt, Artificial Sequence
  RNA Oligomer
auuuucaacuagaaaggugcaaa

SEQ ID NO: 61842 - RNA, 23 nt, Artificial Sequence
  RNA Oligomer
uuuucaacuagaaaggugcaaac

SEQ ID NO: 61843 - RNA, 23 nt, Artificial Sequence
  RNA Oligomer
uuucaacuagaaaggugcaaaca

SEQ ID NO: 61844 - RNA, 23 nt, Artificial Sequence
  RNA Oligomer
uucaacuagaaaggugcaaacau

SEQ ID NO: 61845 - RNA, 23 nt, Artificial Sequence
  RNA Oligomer
caacuagaaaggugcaaacaugu

SEQ ID NO: 61846 - RNA, 23 nt, Artificial Sequence
  RNA Oligomer
aacuagaaaggugcaaacaugua

SEQ ID NO: 61847 - RNA, 23 nt, Artificial Sequence
  RNA Oligomer
acuagaaaggugcaaacauguaa

SEQ ID NO: 61848 - RNA, 23 nt, Artificial Sequence
  RNA Oligomer
cuagaaaggugcaaacauguaac

SEQ ID NO: 61849 - RNA, 23 nt, Artificial Sequence
  RNA Oligomer
uagaaaggugcaaacauguaacu

SEQ ID NO: 61850 - RNA, 23 nt, Artificial Sequence
  RNA Oligomer
acuuuuggucacacucucaacaa

SEQ ID NO: 61851 - RNA, 23 nt, Artificial Sequence
  RNA Oligomer
cuuuuggucacacucucaacaaa

SEQ ID NO: 61852 - RNA, 23 nt, Artificial Sequence
  RNA Oligomer
uuuuggucacacucucaacaaau

SEQ ID NO: 61853 - RNA, 23 nt, Artificial Sequence
  RNA Oligomer
uuuggucacacucucaacaaaua

SEQ ID NO: 61854 - RNA, 23 nt, Artificial Sequence
  RNA Oligomer
aacaaauaaacuguccgaaaaac

SEQ ID NO: 61855 - RNA, 23 nt, Artificial Sequence
  RNA Oligomer
acagucauaucaaaguagaaaca

SEQ ID NO: 61856 - RNA, 23 nt, Artificial Sequence
  RNA Oligomer
cagucauaucaaaguagaaacaa

SEQ ID NO: 61857 - RNA, 23 nt, Artificial Sequence
  RNA Oligomer
agucauaucaaaguagaaacaaa

SEQ ID NO: 61858 - RNA, 23 nt, Artificial Sequence
  RNA Oligomer
gucauaucaaaguagaaacaaau

SEQ ID NO: 61859 - RNA, 23 nt, Artificial Sequence
  RNA Oligomer
cggacugucauucuaucugagca

SEQ ID NO: 61860 - RNA, 23 nt, Artificial Sequence
  RNA Oligomer
gcccuucuuaauguucucuucca

SEQ ID NO: 61861 - RNA, 23 nt, Artificial Sequence
  RNA Oligomer
cccuucuuaauguucucuuccag

SEQ ID NO: 61862 - RNA, 23 nt, Artificial Sequence
  RNA Oligomer
ccuucuuaauguucucuuccagg

SEQ ID NO: 61863 - RNA, 23 nt, Artificial Sequence
  RNA Oligomer
uaaguauccauuucaugcuuuga

SEQ ID NO: 61864 - RNA, 23 nt, Artificial Sequence
  RNA Oligomer
aaguauccauuucaugcuuugaa

SEQ ID NO: 61865 - RNA, 23 nt, Artificial Sequence
  RNA Oligomer
aguauccauuucaugcuuugaac

SEQ ID NO: 61866 - RNA, 23 nt, Artificial Sequence
  RNA Oligomer
guauccauuucaugcuuugaacg

SEQ ID NO: 61867 - RNA, 23 nt, Artificial Sequence
  RNA Oligomer
ggauuccgauuccugaacagugu

SEQ ID NO: 61868 - RNA, 23 nt, Artificial Sequence
  RNA Oligomer
gauuccgauuccugaacaguguc

SEQ ID NO: 61869 - RNA, 23 nt, Artificial Sequence
  RNA Oligomer
auuccgauuccugaacaguguca

SEQ ID NO: 61870 - RNA, 23 nt, Artificial Sequence
  RNA Oligomer
uuccgauuccugaacagugucau

SEQ ID NO: 61871 - RNA, 23 nt, Artificial Sequence
  RNA Oligomer
uccgauuccugaacagugucauu

SEQ ID NO: 61872 - RNA, 23 nt, Artificial Sequence
  RNA Oligomer
acuucaaauagcaggcauauuac

SEQ ID NO: 61873 - RNA, 23 nt, Artificial Sequence
  RNA Oligomer
cuucaaauagcaggcauauuacu

SEQ ID NO: 61874 - RNA, 23 nt, Artificial Sequence
  RNA Oligomer
guacaucuuccuguaguacagcg

SEQ ID NO: 61875 - RNA, 23 nt, Artificial Sequence
  RNA Oligomer
uacaucuuccuguaguacagcga

SEQ ID NO: 61876 - RNA, 23 nt, Artificial Sequence
  RNA Oligomer
acaucuuccuguaguacagcgau

SEQ ID NO: 61877 - RNA, 23 nt, Artificial Sequence
  RNA Oligomer
caucuuccuguaguacagcgauu

SEQ ID NO: 61878 - RNA, 23 nt, Artificial Sequence
  RNA Oligomer
aucuuccuguaguacagcgauuc

SEQ ID NO: 61879 - RNA, 23 nt, Artificial Sequence
  RNA Oligomer
uauccauuucaugcuuugaacga

SEQ ID NO: 61880 - RNA, 23 nt, Artificial Sequence
  RNA Oligomer
uguucucuuccaggucagcuucg

SEQ ID NO: 61881 - RNA, 23 nt, Artificial Sequence
  RNA Oligomer
guucucuuccaggucagcuucgc

SEQ ID NO: 61882 - RNA, 23 nt, Artificial Sequence
  RNA Oligomer
uucucuuccaggucagcuucgca

SEQ ID NO: 61883 - RNA, 23 nt, Artificial Sequence
  RNA Oligomer
uucagaaauugaggcuaacauug

SEQ ID NO: 61884 - RNA, 23 nt, Artificial Sequence
  RNA Oligomer
uugaggcuaacauugaaauauca

SEQ ID NO: 61885 - RNA, 23 nt, Artificial Sequence
  RNA Oligomer
acgaucagacaagcuuuacauuc

SEQ ID NO: 61886 - RNA, 23 nt, Artificial Sequence
  RNA Oligomer
agucacucaguuuuuaauaaagg

SEQ ID NO: 61887 - RNA, 23 nt, Artificial Sequence
  RNA Oligomer
gcagaauuuccauauaaguaucc

SEQ ID NO: 61888 - RNA, 23 nt, Artificial Sequence
  RNA Oligomer
cagaauuuccauauaaguaucca

SEQ ID NO: 61889 - RNA, 23 nt, Artificial Sequence
  RNA Oligomer
uuccacugucaagucuuaacauu

SEQ ID NO: 61890 - RNA, 23 nt, Artificial Sequence
  RNA Oligomer
cagauuuaaauaacuugugcuac

SEQ ID NO: 61891 - RNA, 23 nt, Artificial Sequence
  RNA Oligomer
ugugcuacugaaaucauuuuuac

SEQ ID NO: 61892 - RNA, 23 nt, Artificial Sequence
  RNA Oligomer
augccaugucuccguacaucuuc

SEQ ID NO: 61893 - RNA, 23 nt, Artificial Sequence
  RNA Oligomer
cuucucaauuacacuucaaauag

SEQ ID NO: 61894 - RNA, 23 nt, Artificial Sequence
  RNA Oligomer
uucaugccaugucuccguacauc

SEQ ID NO: 61895 - RNA, 23 nt, Artificial Sequence
  RNA Oligomer
uccauauaaguauccauuucaug

SEQ ID NO: 61896 - RNA, 23 nt, Artificial Sequence
  RNA Oligomer
uacauucuaccuaugguguucag

SEQ ID NO: 61897 - RNA, 23 nt, Artificial Sequence
  RNA Oligomer
acauucuaccuaugguguucaga

SEQ ID NO: 61898 - RNA, 23 nt, Artificial Sequence
  RNA Oligomer
uaacauucuucaaaccagugucu

SEQ ID NO: 61899 - RNA, 23 nt, Artificial Sequence
  RNA Oligomer
gaugcuaucugaugauacuaacc

SEQ ID NO: 61900 - RNA, 23 nt, Artificial Sequence
  RNA Oligomer
gugcuguguacuaauguaguucc

SEQ ID NO: 61901 - RNA, 23 nt, Artificial Sequence
  RNA Oligomer
cuuaacauucuucaaaccagugu

SEQ ID NO: 61902 - RNA, 23 nt, Artificial Sequence
  RNA Oligomer
aaugagaugugaaucaguucaag

SEQ ID NO: 61903 - RNA, 23 nt, Artificial Sequence
  RNA Oligomer
auggcaggcacaggucuugauga

SEQ ID NO: 61904 - RNA, 23 nt, Artificial Sequence
  RNA Oligomer
uuuauuuucaacuagaaaggugc

SEQ ID NO: 61905 - RNA, 23 nt, Artificial Sequence
  RNA Oligomer
uuugacauggcacaauguuuuga

SEQ ID NO: 61906 - RNA, 23 nt, Artificial Sequence
  RNA Oligomer
auucuggugcuguguacuaaugu

SEQ ID NO: 61907 - RNA, 23 nt, Artificial Sequence
  RNA Oligomer
agaugugaaucaguucaaguucc

SEQ ID NO: 61908 - RNA, 23 nt, Artificial Sequence
  RNA Oligomer
uaaugaguuaaugucucucacuc

SEQ ID NO: 61909 - RNA, 23 nt, Artificial Sequence
  RNA Oligomer
cuuuauuuucaacuagaaaggug

SEQ ID NO: 61910 - RNA, 23 nt, Artificial Sequence
  RNA Oligomer
uuauuuucaacuagaaaggugca

SEQ ID NO: 61911 - RNA, 23 nt, Artificial Sequence
  RNA Oligomer
uaaaagugaggcuaccacauuuc

SEQ ID NO: 61912 - RNA, 23 nt, Artificial Sequence
  RNA Oligomer
uuugcaaacaaucuguuuugacg

SEQ ID NO: 61913 - RNA, 23 nt, Artificial Sequence
  RNA Oligomer
uucuggugcuguguacuaaugua

SEQ ID NO: 61914 - RNA, 23 nt, Artificial Sequence
  RNA Oligomer
uuaacauucuucaaaccaguguc

SEQ ID NO: 61915 - RNA, 23 nt, Artificial Sequence
  RNA Oligomer
aaaagugaggcuaccacauuucc

SEQ ID NO: 61916 - RNA, 23 nt, Artificial Sequence
  RNA Oligomer
auuuguuugacauggcacaaugu

SEQ ID NO: 61917 - RNA, 23 nt, Artificial Sequence
  RNA Oligomer
auggcacaauguuuugaauuggg

SEQ ID NO: 61918 - RNA, 23 nt, Artificial Sequence
  RNA Oligomer
augagaugugaaucaguucaagu

SEQ ID NO: 61919 - RNA, 23 nt, Artificial Sequence
  RNA Oligomer
ucuuccuguaguacagcgauuca

SEQ ID NO: 61920 - RNA, 23 nt, Artificial Sequence
  RNA Oligomer
cauuuguucauuaaaagugaggc

SEQ ID NO: 61921 - RNA, 23 nt, Artificial Sequence
  RNA Oligomer
uuacauucuaccuaugguguuca

SEQ ID NO: 61922 - RNA, 23 nt, Artificial Sequence
  RNA Oligomer
uuguuacaggcaaauucacuugc

SEQ ID NO: 61923 - RNA, 23 nt, Artificial Sequence
  RNA Oligomer
agugucauucgaaucagaauguc

SEQ ID NO: 61924 - RNA, 23 nt, Artificial Sequence
  RNA Oligomer
ccuaaagccacaccuuaauauac

SEQ ID NO: 61925 - RNA, 23 nt, Artificial Sequence
  RNA Oligomer
aaugaguuaaugucucucacucu

SEQ ID NO: 61926 - RNA, 23 nt, Artificial Sequence
  RNA Oligomer
acaucauguucuucuucaugacc

SEQ ID NO: 61927 - RNA, 23 nt, Artificial Sequence
  RNA Oligomer
caguuuuuaauaaaggccauuug

SEQ ID NO: 61928 - RNA, 23 nt, Artificial Sequence
  RNA Oligomer
auuuguucauuaaaagugaggcu

SEQ ID NO: 61929 - RNA, 23 nt, Artificial Sequence
  RNA Oligomer
aaagugaggcuaccacauuuccu

SEQ ID NO: 61930 - RNA, 23 nt, Artificial Sequence
  RNA Oligomer
cuuugcaaacaaucuguuuugac

SEQ ID NO: 61931 - RNA, 23 nt, Artificial Sequence
  RNA Oligomer
gaguacggaugcacuuuuugccc

SEQ ID NO: 61932 - RNA, 23 nt, Artificial Sequence
  RNA Oligomer
aauucacuugccacaagcugucc

SEQ ID NO: 61933 - RNA, 23 nt, Artificial Sequence
  RNA Oligomer
auucacuugccacaagcugucca

SEQ ID NO: 61934 - RNA, 23 nt, Artificial Sequence
  RNA Oligomer
cuaaucgacaggauuccgauucc

SEQ ID NO: 61935 - RNA, 23 nt, Artificial Sequence
  RNA Oligomer
acuuaaggaacaacuugacucag

SEQ ID NO: 61936 - RNA, 23 nt, Artificial Sequence
  RNA Oligomer
aacuugacucagucucuugaugg

SEQ ID NO: 61937 - RNA, 23 nt, Artificial Sequence
  RNA Oligomer
augugaaucaguucaaguuccag

SEQ ID NO: 61938 - RNA, 23 nt, Artificial Sequence
  RNA Oligomer
cuaaugaguuaaugucucucacu

SEQ ID NO: 61939 - RNA, 23 nt, Artificial Sequence
  RNA Oligomer
cuccguacaucuuccuguaguac

SEQ ID NO: 61940 - RNA, 23 nt, Artificial Sequence
  RNA Oligomer
aaagaugucauugucuccgggac

SEQ ID NO: 61941 - RNA, 23 nt, Artificial Sequence
  RNA Oligomer
uuguucauuaaaagugaggcuac

SEQ ID NO: 61942 - RNA, 23 nt, Artificial Sequence
  RNA Oligomer
auuuugggaguacggaugcacuu

SEQ ID NO: 61943 - RNA, 23 nt, Artificial Sequence
  RNA Oligomer
uuacaggcaaauucacuugccac

SEQ ID NO: 61944 - RNA, 23 nt, Artificial Sequence
  RNA Oligomer
cagucuaaucgacaggauuccga

SEQ ID NO: 61945 - RNA, 23 nt, Artificial Sequence
  RNA Oligomer
guucugacuuaaggaacaacuug

SEQ ID NO: 61946 - RNA, 23 nt, Artificial Sequence
  RNA Oligomer
augcuaucugaugauacuaaccu

SEQ ID NO: 61947 - RNA, 23 nt, Artificial Sequence
  RNA Oligomer
aaggugcaaacauguaacuuuug

SEQ ID NO: 61948 - RNA, 23 nt, Artificial Sequence
  RNA Oligomer
uguuacaggcaaauucacuugcc

SEQ ID NO: 61949 - RNA, 23 nt, Artificial Sequence
  RNA Oligomer
gugucauucgaaucagaauguca

SEQ ID NO: 61950 - RNA, 23 nt, Artificial Sequence
  RNA Oligomer
guugauagacuauuuguuugaca

SEQ ID NO: 61951 - RNA, 23 nt, Artificial Sequence
  RNA Oligomer
uugucauugguaacccgggugga

SEQ ID NO: 61952 - RNA, 23 nt, Artificial Sequence
  RNA Oligomer
uuuguuugacauggcacaauguu

SEQ ID NO: 61953 - RNA, 23 nt, Artificial Sequence
  RNA Oligomer
auaguugggucugggccaaacgu

SEQ ID NO: 61954 - RNA, 23 nt, Artificial Sequence
  RNA Oligomer
ucgguaugucuucaugcuggugc

SEQ ID NO: 61955 - RNA, 23 nt, Artificial Sequence
  RNA Oligomer
auaaacuguccgaaaaacaguca

SEQ ID NO: 61956 - RNA, 23 nt, Artificial Sequence
  RNA Oligomer
uuugacggacugucauucuaucu

SEQ ID NO: 61957 - RNA, 23 nt, Artificial Sequence
  RNA Oligomer
cauuucaugcuuugaacgaucag

SEQ ID NO: 61958 - RNA, 23 nt, Artificial Sequence
  RNA Oligomer
auuucaugcuuugaacgaucaga

SEQ ID NO: 61959 - RNA, 23 nt, Artificial Sequence
  RNA Oligomer
uaaucgacaggauuccgauuccu

SEQ ID NO: 61960 - RNA, 23 nt, Artificial Sequence
  RNA Oligomer
ugacuuaaggaacaacuugacuc

SEQ ID NO: 61961 - RNA, 23 nt, Artificial Sequence
  RNA Oligomer
acuugacucagucucuugauggc

SEQ ID NO: 61962 - RNA, 23 nt, Artificial Sequence
  RNA Oligomer
aagaugcuaucugaugauacuaa

SEQ ID NO: 61963 - RNA, 23 nt, Artificial Sequence
  RNA Oligomer
gauacuaaccuuucugcugguac

SEQ ID NO: 61964 - RNA, 23 nt, Artificial Sequence
  RNA Oligomer
ugcuguguacuaauguaguucca

SEQ ID NO: 61965 - RNA, 23 nt, Artificial Sequence
  RNA Oligomer
uuugaauugggugggaaucuuuu

SEQ ID NO: 61966 - RNA, 23 nt, Artificial Sequence
  RNA Oligomer
ucuaaugaguuaaugucucucac

SEQ ID NO: 61967 - RNA, 23 nt, Artificial Sequence
  RNA Oligomer
acaggucuugaugaacaucaugu

SEQ ID NO: 61968 - RNA, 23 nt, Artificial Sequence
  RNA Oligomer
ucuugaugaacaucauguucuuc

SEQ ID NO: 61969 - RNA, 23 nt, Artificial Sequence
  RNA Oligomer
cuugaugaacaucauguucuucu

SEQ ID NO: 61970 - RNA, 23 nt, Artificial Sequence
  RNA Oligomer
ugaugaacaucauguucuucuuc

SEQ ID NO: 61971 - RNA, 23 nt, Artificial Sequence
  RNA Oligomer
agcucgguaugucuucaugcugg

SEQ ID NO: 61972 - RNA, 23 nt, Artificial Sequence
  RNA Oligomer
ugcagccagaaagcucaaacuug

SEQ ID NO: 61973 - RNA, 23 nt, Artificial Sequence
  RNA Oligomer
agaaaucagccugccaaggacac

SEQ ID NO: 61974 - RNA, 23 nt, Artificial Sequence
  RNA Oligomer
aaaucagccugccaaggacacug

SEQ ID NO: 61975 - RNA, 23 nt, Artificial Sequence
  RNA Oligomer
uugcaaacaaucuguuuugacgg

SEQ ID NO: 61976 - RNA, 23 nt, Artificial Sequence
  RNA Oligomer
cauucuaucugagcagaauuucc

SEQ ID NO: 61977 - RNA, 23 nt, Artificial Sequence
  RNA Oligomer
aguacggaugcacuuuuugcccu

SEQ ID NO: 61978 - RNA, 23 nt, Artificial Sequence
  RNA Oligomer
aaaaucuggcuuguuacaggcaa

SEQ ID NO: 61979 - RNA, 23 nt, Artificial Sequence
  RNA Oligomer
uggcuuguuacaggcaaauucac

SEQ ID NO: 61980 - RNA, 23 nt, Artificial Sequence
  RNA Oligomer
aaauucacuugccacaagcuguc

SEQ ID NO: 61981 - RNA, 23 nt, Artificial Sequence
  RNA Oligomer
aagcuguccagucuaaucgacag

SEQ ID NO: 61982 - RNA, 23 nt, Artificial Sequence
  RNA Oligomer
aucgacaggauuccgauuccuga

SEQ ID NO: 61983 - RNA, 23 nt, Artificial Sequence
  RNA Oligomer
gcaaaaugaaagagaacaugaaa

SEQ ID NO: 61984 - RNA, 23 nt, Artificial Sequence
  RNA Oligomer
agcaaaaugaaagagaacaugaa

SEQ ID NO: 61985 - RNA, 23 nt, Artificial Sequence
  RNA Oligomer
uagcaaaaugaaagagaacauga

SEQ ID NO: 61986 - RNA, 23 nt, Artificial Sequence
  RNA Oligomer
auagcaaaaugaaagagaacaug

SEQ ID NO: 61987 - RNA, 23 nt, Artificial Sequence
  RNA Oligomer
uauagcaaaaugaaagagaacau

SEQ ID NO: 61988 - RNA, 23 nt, Artificial Sequence
  RNA Oligomer
ccaaguaaguccaacgaaagcca

SEQ ID NO: 61989 - RNA, 23 nt, Artificial Sequence
  RNA Oligomer
uccaaguaaguccaacgaaagcc

SEQ ID NO: 61990 - RNA, 23 nt, Artificial Sequence
  RNA Oligomer
uuccaaguaaguccaacgaaagc

SEQ ID NO: 61991 - RNA, 23 nt, Artificial Sequence
  RNA Oligomer
cuuccaaguaaguccaacgaaag

SEQ ID NO: 61992 - RNA, 23 nt, Artificial Sequence
  RNA Oligomer
ccuuccaaguaaguccaacgaaa

SEQ ID NO: 61993 - RNA, 23 nt, Artificial Sequence
  RNA Oligomer
gcaaacuaucacuguauuuuaau

SEQ ID NO: 61994 - RNA, 23 nt, Artificial Sequence
  RNA Oligomer
ugcaaacuaucacuguauuuuaa

SEQ ID NO: 61995 - RNA, 23 nt, Artificial Sequence
  RNA Oligomer
augcaaacuaucacuguauuuua

SEQ ID NO: 61996 - RNA, 23 nt, Artificial Sequence
  RNA Oligomer
aaugcaaacuaucacuguauuuu

SEQ ID NO: 61997 - RNA, 23 nt, Artificial Sequence
  RNA Oligomer
aaaugcaaacuaucacuguauuu

SEQ ID NO: 61998 - RNA, 23 nt, Artificial Sequence
  RNA Oligomer
cuaaaagcuucaggguuaugucu

SEQ ID NO: 61999 - RNA, 23 nt, Artificial Sequence
  RNA Oligomer
acuaaaagcuucaggguuauguc

SEQ ID NO: 62000 - RNA, 23 nt, Artificial Sequence
  RNA Oligomer
aacuaaaagcuucaggguuaugu

SEQ ID NO: 62001 - RNA, 23 nt, Artificial Sequence
  RNA Oligomer
aaacuaaaagcuucaggguuaug

SEQ ID NO: 62002 - RNA, 23 nt, Artificial Sequence
  RNA Oligomer
uaaacuaaaagcuucaggguuau

SEQ ID NO: 62003 - RNA, 23 nt, Artificial Sequence
  RNA Oligomer
agaagauaaacaccugaaauuuc

SEQ ID NO: 62004 - RNA, 23 nt, Artificial Sequence
  RNA Oligomer
aagaagauaaacaccugaaauuu

SEQ ID NO: 62005 - RNA, 23 nt, Artificial Sequence
  RNA Oligomer
gaagaagauaaacaccugaaauu

SEQ ID NO: 62006 - RNA, 23 nt, Artificial Sequence
  RNA Oligomer
ggaagaagauaaacaccugaaau

SEQ ID NO: 62007 - RNA, 23 nt, Artificial Sequence
  RNA Oligomer
aggaagaagauaaacaccugaaa

SEQ ID NO: 62008 - RNA, 23 nt, Artificial Sequence
  RNA Oligomer
caccugaaauuucguauuucuca

SEQ ID NO: 62009 - RNA, 23 nt, Artificial Sequence
  RNA Oligomer
acaccugaaauuucguauuucuc

SEQ ID NO: 62010 - RNA, 23 nt, Artificial Sequence
  RNA Oligomer
aacaccugaaauuucguauuucu

SEQ ID NO: 62011 - RNA, 23 nt, Artificial Sequence
  RNA Oligomer
aaacaccugaaauuucguauuuc

SEQ ID NO: 62012 - RNA, 23 nt, Artificial Sequence
  RNA Oligomer
uaaacaccugaaauuucguauuu

SEQ ID NO: 62013 - RNA, 23 nt, Artificial Sequence
  RNA Oligomer
auaaacaccugaaauuucguauu

SEQ ID NO: 62014 - RNA, 23 nt, Artificial Sequence
  RNA Oligomer
cgacucugaugauguagaugaca

SEQ ID NO: 62015 - RNA, 23 nt, Artificial Sequence
  RNA Oligomer
acgacucugaugauguagaugac

SEQ ID NO: 62016 - RNA, 23 nt, Artificial Sequence
  RNA Oligomer
aacgacucugaugauguagauga

SEQ ID NO: 62017 - RNA, 23 nt, Artificial Sequence
  RNA Oligomer
gaacgacucugaugauguagaug

SEQ ID NO: 62018 - RNA, 23 nt, Artificial Sequence
  RNA Oligomer
cgaacgacucugaugauguagau

SEQ ID NO: 62019 - RNA, 23 nt, Artificial Sequence
  RNA Oligomer
guccagcaauuaauaaaacauaa

SEQ ID NO: 62020 - RNA, 23 nt, Artificial Sequence
  RNA Oligomer
uguccagcaauuaauaaaacaua

SEQ ID NO: 62021 - RNA, 23 nt, Artificial Sequence
  RNA Oligomer
uuguccagcaauuaauaaaacau

SEQ ID NO: 62022 - RNA, 23 nt, Artificial Sequence
  RNA Oligomer
guuguccagcaauuaauaaaaca

SEQ ID NO: 62023 - RNA, 23 nt, Artificial Sequence
  RNA Oligomer
gguuguccagcaauuaauaaaac

SEQ ID NO: 62024 - RNA, 23 nt, Artificial Sequence
  RNA Oligomer
uggugucaauugcuuauuuguuu

SEQ ID NO: 62025 - RNA, 23 nt, Artificial Sequence
  RNA Oligomer
guggugucaauugcuuauuuguu

SEQ ID NO: 62026 - RNA, 23 nt, Artificial Sequence
  RNA Oligomer
gguggugucaauugcuuauuugu

SEQ ID NO: 62027 - RNA, 23 nt, Artificial Sequence
  RNA Oligomer
ugguggugucaauugcuuauuug

SEQ ID NO: 62028 - RNA, 23 nt, Artificial Sequence
  RNA Oligomer
uugguggugucaauugcuuauuu

SEQ ID NO: 62029 - RNA, 23 nt, Artificial Sequence
  RNA Oligomer
guaaacuaaaagcuucaggguua

SEQ ID NO: 62030 - RNA, 23 nt, Artificial Sequence
  RNA Oligomer
gaaacucccuguaaacuaaaagc

SEQ ID NO: 62031 - RNA, 23 nt, Artificial Sequence
  RNA Oligomer
ggaaacucccuguaaacuaaaag

SEQ ID NO: 62032 - RNA, 23 nt, Artificial Sequence
  RNA Oligomer
uggaaacucccuguaaacuaaaa

SEQ ID NO: 62033 - RNA, 23 nt, Artificial Sequence
  RNA Oligomer
auggaaacucccuguaaacuaaa

SEQ ID NO: 62034 - RNA, 23 nt, Artificial Sequence
  RNA Oligomer
cauggaaacucccuguaaacuaa

SEQ ID NO: 62035 - RNA, 23 nt, Artificial Sequence
  RNA Oligomer
ucauggaaacucccuguaaacua

SEQ ID NO: 62036 - RNA, 23 nt, Artificial Sequence
  RNA Oligomer
gguugaauguguaucuauuugag

SEQ ID NO: 62037 - RNA, 23 nt, Artificial Sequence
  RNA Oligomer
ugguugaauguguaucuauuuga

SEQ ID NO: 62038 - RNA, 23 nt, Artificial Sequence
  RNA Oligomer
uugguugaauguguaucuauuug

SEQ ID NO: 62039 - RNA, 23 nt, Artificial Sequence
  RNA Oligomer
auugguugaauguguaucuauuu

SEQ ID NO: 62040 - RNA, 23 nt, Artificial Sequence
  RNA Oligomer
uauugguugaauguguaucuauu

SEQ ID NO: 62041 - RNA, 23 nt, Artificial Sequence
  RNA Oligomer
gaagauaaacaccugaaauuucg

SEQ ID NO: 62042 - RNA, 23 nt, Artificial Sequence
  RNA Oligomer
aaggaagaagauaaacaccugaa

SEQ ID NO: 62043 - RNA, 23 nt, Artificial Sequence
  RNA Oligomer
uaaggaagaagauaaacaccuga

SEQ ID NO: 62044 - RNA, 23 nt, Artificial Sequence
  RNA Oligomer
guaaggaagaagauaaacaccug

SEQ ID NO: 62045 - RNA, 23 nt, Artificial Sequence
  RNA Oligomer
ccaaaaguaaggaagaagauaaa

SEQ ID NO: 62046 - RNA, 23 nt, Artificial Sequence
  RNA Oligomer
cccaaaaguaaggaagaagauaa

SEQ ID NO: 62047 - RNA, 23 nt, Artificial Sequence
  RNA Oligomer
ccccaaaaguaaggaagaagaua

SEQ ID NO: 62048 - RNA, 23 nt, Artificial Sequence
  RNA Oligomer
accccaaaaguaaggaagaagau

SEQ ID NO: 62049 - RNA, 23 nt, Artificial Sequence
  RNA Oligomer
gaccccaaaaguaaggaagaaga

SEQ ID NO: 62050 - RNA, 23 nt, Artificial Sequence
  RNA Oligomer
ccaaugaugagagcaaugagcau

SEQ ID NO: 62051 - RNA, 23 nt, Artificial Sequence
  RNA Oligomer
gccaaugaugagagcaaugagca

SEQ ID NO: 62052 - RNA, 23 nt, Artificial Sequence
  RNA Oligomer
agccaaugaugagagcaaugagc

SEQ ID NO: 62053 - RNA, 23 nt, Artificial Sequence
  RNA Oligomer
aagccaaugaugagagcaaugag

SEQ ID NO: 62054 - RNA, 23 nt, Artificial Sequence
  RNA Oligomer
aaagccaaugaugagagcaauga

SEQ ID NO: 62055 - RNA, 23 nt, Artificial Sequence
  RNA Oligomer
ugauguagaugacacugaugauu

SEQ ID NO: 62056 - RNA, 23 nt, Artificial Sequence
  RNA Oligomer
augauguagaugacacugaugau

SEQ ID NO: 62057 - RNA, 23 nt, Artificial Sequence
  RNA Oligomer
gaugauguagaugacacugauga

SEQ ID NO: 62058 - RNA, 23 nt, Artificial Sequence
  RNA Oligomer
ugaugauguagaugacacugaug

SEQ ID NO: 62059 - RNA, 23 nt, Artificial Sequence
  RNA Oligomer
cugaugauguagaugacacugau

SEQ ID NO: 62060 - RNA, 23 nt, Artificial Sequence
  RNA Oligomer
agaauuugguggugucaauugcu

SEQ ID NO: 62061 - RNA, 23 nt, Artificial Sequence
  RNA Oligomer
aagaauuugguggugucaauugc

SEQ ID NO: 62062 - RNA, 23 nt, Artificial Sequence
  RNA Oligomer
uaagaauuugguggugucaauug

SEQ ID NO: 62063 - RNA, 23 nt, Artificial Sequence
  RNA Oligomer
auaagaauuugguggugucaauu

SEQ ID NO: 62064 - RNA, 23 nt, Artificial Sequence
  RNA Oligomer
aauaagaauuugguggugucaau

SEQ ID NO: 62065 - RNA, 23 nt, Artificial Sequence
  RNA Oligomer
ucccuguaaacuaaaagcuucag

SEQ ID NO: 62066 - RNA, 23 nt, Artificial Sequence
  RNA Oligomer
cucccuguaaacuaaaagcuuca

SEQ ID NO: 62067 - RNA, 23 nt, Artificial Sequence
  RNA Oligomer
acucccuguaaacuaaaagcuuc

SEQ ID NO: 62068 - RNA, 23 nt, Artificial Sequence
  RNA Oligomer
aacucccuguaaacuaaaagcuu

SEQ ID NO: 62069 - RNA, 23 nt, Artificial Sequence
  RNA Oligomer
aaacucccuguaaacuaaaagcu

SEQ ID NO: 62070 - RNA, 23 nt, Artificial Sequence
  RNA Oligomer
gcauuccgaugugauugauaguc

SEQ ID NO: 62071 - RNA, 23 nt, Artificial Sequence
  RNA Oligomer
agcauuccgaugugauugauagu

SEQ ID NO: 62072 - RNA, 23 nt, Artificial Sequence
  RNA Oligomer
gagcauuccgaugugauugauag

SEQ ID NO: 62073 - RNA, 23 nt, Artificial Sequence
  RNA Oligomer
ugagcauuccgaugugauugaua

SEQ ID NO: 62074 - RNA, 23 nt, Artificial Sequence
  RNA Oligomer
augagcauuccgaugugauugau

SEQ ID NO: 62075 - RNA, 23 nt, Artificial Sequence
  RNA Oligomer
ccagauuauauaagcggaaagcc

SEQ ID NO: 62076 - RNA, 23 nt, Artificial Sequence
  RNA Oligomer
uccagauuauauaagcggaaagc

SEQ ID NO: 62077 - RNA, 23 nt, Artificial Sequence
  RNA Oligomer
guccagauuauauaagcggaaag

SEQ ID NO: 62078 - RNA, 23 nt, Artificial Sequence
  RNA Oligomer
aguccagauuauauaagcggaaa

SEQ ID NO: 62079 - RNA, 23 nt, Artificial Sequence
  RNA Oligomer
caguccagauuauauaagcggaa

SEQ ID NO: 62080 - RNA, 23 nt, Artificial Sequence
  RNA Oligomer
ccaugagaauugcagugauuugc

SEQ ID NO: 62081 - RNA, 23 nt, Artificial Sequence
  RNA Oligomer
accaugagaauugcagugauuug

SEQ ID NO: 62082 - RNA, 23 nt, Artificial Sequence
  RNA Oligomer
uaccaugagaauugcagugauuu

SEQ ID NO: 62083 - RNA, 23 nt, Artificial Sequence
  RNA Oligomer
cuaccaugagaauugcagugauu

SEQ ID NO: 62084 - RNA, 23 nt, Artificial Sequence
  RNA Oligomer
acuaccaugagaauugcagugau

SEQ ID NO: 62085 - RNA, 23 nt, Artificial Sequence
  RNA Oligomer
ugaugaaucugaugaacugguca

SEQ ID NO: 62086 - RNA, 23 nt, Artificial Sequence
  RNA Oligomer
cugaugaaucugaugaacugguc

SEQ ID NO: 62087 - RNA, 23 nt, Artificial Sequence
  RNA Oligomer
ucugaugaaucugaugaacuggu

SEQ ID NO: 62088 - RNA, 23 nt, Artificial Sequence
  RNA Oligomer
uucugaugaaucugaugaacugg

SEQ ID NO: 62089 - RNA, 23 nt, Artificial Sequence
  RNA Oligomer
auucugaugaaucugaugaacug

SEQ ID NO: 62090 - RNA, 23 nt, Artificial Sequence
  RNA Oligomer
ggaugauauggaugaugaagaug

SEQ ID NO: 62091 - RNA, 23 nt, Artificial Sequence
  RNA Oligomer
uggaugauauggaugaugaagau

SEQ ID NO: 62092 - RNA, 23 nt, Artificial Sequence
  RNA Oligomer
auggaugauauggaugaugaaga

SEQ ID NO: 62093 - RNA, 23 nt, Artificial Sequence
  RNA Oligomer
cauggaugauauggaugaugaag

SEQ ID NO: 62094 - RNA, 23 nt, Artificial Sequence
  RNA Oligomer
acauggaugauauggaugaugaa

SEQ ID NO: 62095 - RNA, 23 nt, Artificial Sequence
  RNA Oligomer
gcagcagcauuuaaauucuggga

SEQ ID NO: 62096 - RNA, 23 nt, Artificial Sequence
  RNA Oligomer
ugcagcagcauuuaaauucuggg

SEQ ID NO: 62097 - RNA, 23 nt, Artificial Sequence
  RNA Oligomer
cugcagcagcauuuaaauucugg

SEQ ID NO: 62098 - RNA, 23 nt, Artificial Sequence
  RNA Oligomer
ucugcagcagcauuuaaauucug

SEQ ID NO: 62099 - RNA, 23 nt, Artificial Sequence
  RNA Oligomer
gucugcagcagcauuuaaauucu

SEQ ID NO: 62100 - RNA, 23 nt, Artificial Sequence
  RNA Oligomer
ugccauaccaguuaaacaggcug

SEQ ID NO: 62101 - RNA, 23 nt, Artificial Sequence
  RNA Oligomer
gugccauaccaguuaaacaggcu

SEQ ID NO: 62102 - RNA, 23 nt, Artificial Sequence
  RNA Oligomer
ugugccauaccaguuaaacaggc

SEQ ID NO: 62103 - RNA, 23 nt, Artificial Sequence
  RNA Oligomer
cugugccauaccaguuaaacagg

SEQ ID NO: 62104 - RNA, 23 nt, Artificial Sequence
  RNA Oligomer
ccugugccauaccaguuaaacag

SEQ ID NO: 62105 - RNA, 23 nt, Artificial Sequence
  RNA Oligomer
ucaggguuaugucuauguucauu

SEQ ID NO: 62106 - RNA, 23 nt, Artificial Sequence
  RNA Oligomer
uucaggguuaugucuauguucau

SEQ ID NO: 62107 - RNA, 23 nt, Artificial Sequence
  RNA Oligomer
cuucaggguuaugucuauguuca

SEQ ID NO: 62108 - RNA, 23 nt, Artificial Sequence
  RNA Oligomer
gcuucaggguuaugucuauguuc

SEQ ID NO: 62109 - RNA, 23 nt, Artificial Sequence
  RNA Oligomer
agcuucaggguuaugucuauguu

SEQ ID NO: 62110 - RNA, 23 nt, Artificial Sequence
  RNA Oligomer
aagcuucaggguuaugucuaugu

SEQ ID NO: 62111 - RNA, 23 nt, Artificial Sequence
  RNA Oligomer
aaagcuucaggguuaugucuaug

SEQ ID NO: 62112 - RNA, 23 nt, Artificial Sequence
  RNA Oligomer
aaaagcuucaggguuaugucuau

SEQ ID NO: 62113 - RNA, 23 nt, Artificial Sequence
  RNA Oligomer
ggucaaaaucuaagaaguuucgc

SEQ ID NO: 62114 - RNA, 23 nt, Artificial Sequence
  RNA Oligomer
aggucaaaaucuaagaaguuucg

SEQ ID NO: 62115 - RNA, 23 nt, Artificial Sequence
  RNA Oligomer
gaggucaaaaucuaagaaguuuc

SEQ ID NO: 62116 - RNA, 23 nt, Artificial Sequence
  RNA Oligomer
ugaggucaaaaucuaagaaguuu

SEQ ID NO: 62117 - RNA, 23 nt, Artificial Sequence
  RNA Oligomer
cugaggucaaaaucuaagaaguu

SEQ ID NO: 62118 - RNA, 23 nt, Artificial Sequence
  RNA Oligomer
ugaaucugaugaacuggucacug

SEQ ID NO: 62119 - RNA, 23 nt, Artificial Sequence
  RNA Oligomer
augaaucugaugaacuggucacu

SEQ ID NO: 62120 - RNA, 23 nt, Artificial Sequence
  RNA Oligomer
gaugaaucugaugaacuggucac

SEQ ID NO: 62121 - RNA, 23 nt, Artificial Sequence
  RNA Oligomer
uuugguggugucaauugcuuauu

SEQ ID NO: 62122 - RNA, 23 nt, Artificial Sequence
  RNA Oligomer
cccacuuaaaaagagaauauaac

SEQ ID NO: 62123 - RNA, 23 nt, Artificial Sequence
  RNA Oligomer
acccacuuaaaaagagaauauaa

SEQ ID NO: 62124 - RNA, 23 nt, Artificial Sequence
  RNA Oligomer
uacccacuuaaaaagagaauaua

SEQ ID NO: 62125 - RNA, 23 nt, Artificial Sequence
  RNA Oligomer
uuacccacuuaaaaagagaauau

SEQ ID NO: 62126 - RNA, 23 nt, Artificial Sequence
  RNA Oligomer
uuuacccacuuaaaaagagaaua

SEQ ID NO: 62127 - RNA, 23 nt, Artificial Sequence
  RNA Oligomer
gaagaaaugcaaacuaucacugu

SEQ ID NO: 62128 - RNA, 23 nt, Artificial Sequence
  RNA Oligomer
agaagaaaugcaaacuaucacug

SEQ ID NO: 62129 - RNA, 23 nt, Artificial Sequence
  RNA Oligomer
uagaagaaaugcaaacuaucacu

SEQ ID NO: 62130 - RNA, 23 nt, Artificial Sequence
  RNA Oligomer
auagaagaaaugcaaacuaucac

SEQ ID NO: 62131 - RNA, 23 nt, Artificial Sequence
  RNA Oligomer
uauagaagaaaugcaaacuauca

SEQ ID NO: 62132 - RNA, 23 nt, Artificial Sequence
  RNA Oligomer
ggguuaugucuauguucauucua

SEQ ID NO: 62133 - RNA, 23 nt, Artificial Sequence
  RNA Oligomer
aggguuaugucuauguucauucu

SEQ ID NO: 62134 - RNA, 23 nt, Artificial Sequence
  RNA Oligomer
caggguuaugucuauguucauuc

SEQ ID NO: 62135 - RNA, 23 nt, Artificial Sequence
  RNA Oligomer
cuauuugagucuggaaauaacua

SEQ ID NO: 62136 - RNA, 23 nt, Artificial Sequence
  RNA Oligomer
ucuauuugagucuggaaauaacu

SEQ ID NO: 62137 - RNA, 23 nt, Artificial Sequence
  RNA Oligomer
aucuauuugagucuggaaauaac

SEQ ID NO: 62138 - RNA, 23 nt, Artificial Sequence
  RNA Oligomer
uaucuauuugagucuggaaauaa

SEQ ID NO: 62139 - RNA, 23 nt, Artificial Sequence
  RNA Oligomer
guaucuauuugagucuggaaaua

SEQ ID NO: 62140 - RNA, 23 nt, Artificial Sequence
  RNA Oligomer
uuauagcaaaaugaaagagaaca

SEQ ID NO: 62141 - RNA, 23 nt, Artificial Sequence
  RNA Oligomer
gcaucuucugaggucaauuaaaa

SEQ ID NO: 62142 - RNA, 23 nt, Artificial Sequence
  RNA Oligomer
ugcaucuucugaggucaauuaaa

SEQ ID NO: 62143 - RNA, 23 nt, Artificial Sequence
  RNA Oligomer
gugcaucuucugaggucaauuaa

SEQ ID NO: 62144 - RNA, 23 nt, Artificial Sequence
  RNA Oligomer
agugcaucuucugaggucaauua

SEQ ID NO: 62145 - RNA, 23 nt, Artificial Sequence
  RNA Oligomer
uagugcaucuucugaggucaauu

SEQ ID NO: 62146 - RNA, 23 nt, Artificial Sequence
  RNA Oligomer
auagugcaucuucugaggucaau

SEQ ID NO: 62147 - RNA, 23 nt, Artificial Sequence
  RNA Oligomer
ccgaugugauugauagucaggaa

SEQ ID NO: 62148 - RNA, 23 nt, Artificial Sequence
  RNA Oligomer
uccgaugugauugauagucagga

SEQ ID NO: 62149 - RNA, 23 nt, Artificial Sequence
  RNA Oligomer
uuccgaugugauugauagucagg

SEQ ID NO: 62150 - RNA, 23 nt, Artificial Sequence
  RNA Oligomer
auuccgaugugauugauagucag

SEQ ID NO: 62151 - RNA, 23 nt, Artificial Sequence
  RNA Oligomer
cauuccgaugugauugauaguca

SEQ ID NO: 62152 - RNA, 23 nt, Artificial Sequence
  RNA Oligomer
ggaaagccaaugaugagagcaau

SEQ ID NO: 62153 - RNA, 23 nt, Artificial Sequence
  RNA Oligomer
cggaaagccaaugaugagagcaa

SEQ ID NO: 62154 - RNA, 23 nt, Artificial Sequence
  RNA Oligomer
gcggaaagccaaugaugagagca

SEQ ID NO: 62155 - RNA, 23 nt, Artificial Sequence
  RNA Oligomer
agcggaaagccaaugaugagagc

SEQ ID NO: 62156 - RNA, 23 nt, Artificial Sequence
  RNA Oligomer
aagcggaaagccaaugaugagag

SEQ ID NO: 62157 - RNA, 23 nt, Artificial Sequence
  RNA Oligomer
ggaguugaauggugcauacaagg

SEQ ID NO: 62158 - RNA, 23 nt, Artificial Sequence
  RNA Oligomer
aggaguugaauggugcauacaag

SEQ ID NO: 62159 - RNA, 23 nt, Artificial Sequence
  RNA Oligomer
gaggaguugaauggugcauacaa

SEQ ID NO: 62160 - RNA, 23 nt, Artificial Sequence
  RNA Oligomer
cgaggaguugaauggugcauaca

SEQ ID NO: 62161 - RNA, 23 nt, Artificial Sequence
  RNA Oligomer
gcgaggaguugaauggugcauac

SEQ ID NO: 62162 - RNA, 23 nt, Artificial Sequence
  RNA Oligomer
acugaggucaaaaucuaagaagu

SEQ ID NO: 62163 - RNA, 23 nt, Artificial Sequence
  RNA Oligomer
gacugaggucaaaaucuaagaag

SEQ ID NO: 62164 - RNA, 23 nt, Artificial Sequence
  RNA Oligomer
ggacugaggucaaaaucuaagaa

SEQ ID NO: 62165 - RNA, 23 nt, Artificial Sequence
  RNA Oligomer
cgaccaaggaaaacucacuacca

SEQ ID NO: 62166 - RNA, 23 nt, Artificial Sequence
  RNA Oligomer
ccgaccaaggaaaacucacuacc

SEQ ID NO: 62167 - RNA, 23 nt, Artificial Sequence
  RNA Oligomer
gccgaccaaggaaaacucacuac

SEQ ID NO: 62168 - RNA, 23 nt, Artificial Sequence
  RNA Oligomer
cgccgaccaaggaaaacucacua

SEQ ID NO: 62169 - RNA, 23 nt, Artificial Sequence
  RNA Oligomer
acgccgaccaaggaaaacucacu

SEQ ID NO: 62170 - RNA, 23 nt, Artificial Sequence
  RNA Oligomer
cauucugaugaaucugaugaacu

SEQ ID NO: 62171 - RNA, 23 nt, Artificial Sequence
  RNA Oligomer
ccauucugaugaaucugaugaac

SEQ ID NO: 62172 - RNA, 23 nt, Artificial Sequence
  RNA Oligomer
accauucugaugaaucugaugaa

SEQ ID NO: 62173 - RNA, 23 nt, Artificial Sequence
  RNA Oligomer
ucgaacgacucugaugauguaga

SEQ ID NO: 62174 - RNA, 23 nt, Artificial Sequence
  RNA Oligomer
cucgaacgacucugaugauguag

SEQ ID NO: 62175 - RNA, 23 nt, Artificial Sequence
  RNA Oligomer
acucgaacgacucugaugaugua

SEQ ID NO: 62176 - RNA, 23 nt, Artificial Sequence
  RNA Oligomer
ggcugauucuggaaguucugagg

SEQ ID NO: 62177 - RNA, 23 nt, Artificial Sequence
  RNA Oligomer
aggcugauucuggaaguucugag

SEQ ID NO: 62178 - RNA, 23 nt, Artificial Sequence
  RNA Oligomer
caggcugauucuggaaguucuga

SEQ ID NO: 62179 - RNA, 23 nt, Artificial Sequence
  RNA Oligomer
acaggcugauucuggaaguucug

SEQ ID NO: 62180 - RNA, 23 nt, Artificial Sequence
  RNA Oligomer
aacaggcugauucuggaaguucu

SEQ ID NO: 62181 - RNA, 23 nt, Artificial Sequence
  RNA Oligomer
ggugucaauugcuuauuuguuuu

SEQ ID NO: 62182 - RNA, 23 nt, Artificial Sequence
  RNA Oligomer
auuugguggugucaauugcuuau

SEQ ID NO: 62183 - RNA, 23 nt, Artificial Sequence
  RNA Oligomer
gguuaugucuauguucauucuau

SEQ ID NO: 62184 - RNA, 23 nt, Artificial Sequence
  RNA Oligomer
ggucaauuaaaaggagaaaaaau

SEQ ID NO: 62185 - RNA, 23 nt, Artificial Sequence
  RNA Oligomer
aggucaauuaaaaggagaaaaaa

SEQ ID NO: 62186 - RNA, 23 nt, Artificial Sequence
  RNA Oligomer
gaggucaauuaaaaggagaaaaa

SEQ ID NO: 62187 - RNA, 23 nt, Artificial Sequence
  RNA Oligomer
ugaggucaauuaaaaggagaaaa

SEQ ID NO: 62188 - RNA, 23 nt, Artificial Sequence
  RNA Oligomer
cugaggucaauuaaaaggagaaa

SEQ ID NO: 62189 - RNA, 23 nt, Artificial Sequence
  RNA Oligomer
caaaaguaaggaagaagauaaac

SEQ ID NO: 62190 - RNA, 23 nt, Artificial Sequence
  RNA Oligomer
cgaugugauugauagucaggaac

SEQ ID NO: 62191 - RNA, 23 nt, Artificial Sequence
  RNA Oligomer
gcaaugagcauuccgaugugauu

SEQ ID NO: 62192 - RNA, 23 nt, Artificial Sequence
  RNA Oligomer
agcaaugagcauuccgaugugau

SEQ ID NO: 62193 - RNA, 23 nt, Artificial Sequence
  RNA Oligomer
gagcaaugagcauuccgauguga

SEQ ID NO: 62194 - RNA, 23 nt, Artificial Sequence
  RNA Oligomer
agagcaaugagcauuccgaugug

SEQ ID NO: 62195 - RNA, 23 nt, Artificial Sequence
  RNA Oligomer
gagagcaaugagcauuccgaugu

SEQ ID NO: 62196 - RNA, 23 nt, Artificial Sequence
  RNA Oligomer
gcaguccagauuauauaagcgga

SEQ ID NO: 62197 - RNA, 23 nt, Artificial Sequence
  RNA Oligomer
agcaguccagauuauauaagcgg

SEQ ID NO: 62198 - RNA, 23 nt, Artificial Sequence
  RNA Oligomer
aagcaguccagauuauauaagcg

SEQ ID NO: 62199 - RNA, 23 nt, Artificial Sequence
  RNA Oligomer
caagcaguccagauuauauaagc

SEQ ID NO: 62200 - RNA, 23 nt, Artificial Sequence
  RNA Oligomer
acaagcaguccagauuauauaag

SEQ ID NO: 62201 - RNA, 23 nt, Artificial Sequence
  RNA Oligomer
ggacaguuaugaaacgagucagc

SEQ ID NO: 62202 - RNA, 23 nt, Artificial Sequence
  RNA Oligomer
aggacaguuaugaaacgagucag

SEQ ID NO: 62203 - RNA, 23 nt, Artificial Sequence
  RNA Oligomer
aaggacaguuaugaaacgaguca

SEQ ID NO: 62204 - RNA, 23 nt, Artificial Sequence
  RNA Oligomer
gaaggacaguuaugaaacgaguc

SEQ ID NO: 62205 - RNA, 23 nt, Artificial Sequence
  RNA Oligomer
ggaaggacaguuaugaaacgagu

SEQ ID NO: 62206 - RNA, 23 nt, Artificial Sequence
  RNA Oligomer
gggaaggacaguuaugaaacgag

SEQ ID NO: 62207 - RNA, 23 nt, Artificial Sequence
  RNA Oligomer
ugggaaggacaguuaugaaacga

SEQ ID NO: 62208 - RNA, 23 nt, Artificial Sequence
  RNA Oligomer
gugggaaggacaguuaugaaacg

SEQ ID NO: 62209 - RNA, 23 nt, Artificial Sequence
  RNA Oligomer
cgugggaaggacaguuaugaaac

SEQ ID NO: 62210 - RNA, 23 nt, Artificial Sequence
  RNA Oligomer
ccgugggaaggacaguuaugaaa

SEQ ID NO: 62211 - RNA, 23 nt, Artificial Sequence
  RNA Oligomer
gaccaaggaaaacucacuaccau

SEQ ID NO: 62212 - RNA, 23 nt, Artificial Sequence
  RNA Oligomer
guagaugacacugaugauucuca

SEQ ID NO: 62213 - RNA, 23 nt, Artificial Sequence
  RNA Oligomer
uguagaugacacugaugauucuc

SEQ ID NO: 62214 - RNA, 23 nt, Artificial Sequence
  RNA Oligomer
auguagaugacacugaugauucu

SEQ ID NO: 62215 - RNA, 23 nt, Artificial Sequence
  RNA Oligomer
gauguagaugacacugaugauuc

SEQ ID NO: 62216 - RNA, 23 nt, Artificial Sequence
  RNA Oligomer
ucugaugauguagaugacacuga

SEQ ID NO: 62217 - RNA, 23 nt, Artificial Sequence
  RNA Oligomer
cucugaugauguagaugacacug

SEQ ID NO: 62218 - RNA, 23 nt, Artificial Sequence
  RNA Oligomer
acucugaugauguagaugacacu

SEQ ID NO: 62219 - RNA, 23 nt, Artificial Sequence
  RNA Oligomer
cccuuccaaguaaguccaacgaa

SEQ ID NO: 62220 - RNA, 23 nt, Artificial Sequence
  RNA Oligomer
acauaaccuuuuuuacugccuaa

SEQ ID NO: 62221 - RNA, 23 nt, Artificial Sequence
  RNA Oligomer
aacauaaccuuuuuuacugccua

SEQ ID NO: 62222 - RNA, 23 nt, Artificial Sequence
  RNA Oligomer
aaacauaaccuuuuuuacugccu

SEQ ID NO: 62223 - RNA, 23 nt, Artificial Sequence
  RNA Oligomer
aaaacauaaccuuuuuuacugcc

SEQ ID NO: 62224 - RNA, 23 nt, Artificial Sequence
  RNA Oligomer
uaaaacauaaccuuuuuuacugc

SEQ ID NO: 62225 - RNA, 23 nt, Artificial Sequence
  RNA Oligomer
cgguuguccagcaauuaauaaaa

SEQ ID NO: 62226 - RNA, 23 nt, Artificial Sequence
  RNA Oligomer
acgguuguccagcaauuaauaaa

SEQ ID NO: 62227 - RNA, 23 nt, Artificial Sequence
  RNA Oligomer
cacgguuguccagcaauuaauaa

SEQ ID NO: 62228 - RNA, 23 nt, Artificial Sequence
  RNA Oligomer
ccacgguuguccagcaauuaaua

SEQ ID NO: 62229 - RNA, 23 nt, Artificial Sequence
  RNA Oligomer
cuauagaagaaaugcaaacuauc

SEQ ID NO: 62230 - RNA, 23 nt, Artificial Sequence
  RNA Oligomer
ucuauagaagaaaugcaaacuau

SEQ ID NO: 62231 - RNA, 23 nt, Artificial Sequence
  RNA Oligomer
uucuauagaagaaaugcaaacua

SEQ ID NO: 62232 - RNA, 23 nt, Artificial Sequence
  RNA Oligomer
auucuauagaagaaaugcaaacu

SEQ ID NO: 62233 - RNA, 23 nt, Artificial Sequence
  RNA Oligomer
cauucuauagaagaaaugcaaac

SEQ ID NO: 62234 - RNA, 23 nt, Artificial Sequence
  RNA Oligomer
guguaucuauuugagucuggaaa

SEQ ID NO: 62235 - RNA, 23 nt, Artificial Sequence
  RNA Oligomer
uguguaucuauuugagucuggaa

SEQ ID NO: 62236 - RNA, 23 nt, Artificial Sequence
  RNA Oligomer
auguguaucuauuugagucugga

SEQ ID NO: 62237 - RNA, 23 nt, Artificial Sequence
  RNA Oligomer
aauguguaucuauuugagucugg

SEQ ID NO: 62238 - RNA, 23 nt, Artificial Sequence
  RNA Oligomer
gaauguguaucuauuugagucug

SEQ ID NO: 62239 - RNA, 23 nt, Artificial Sequence
  RNA Oligomer
uuauugguugaauguguaucuau

SEQ ID NO: 62240 - RNA, 23 nt, Artificial Sequence
  RNA Oligomer
uuuauugguugaauguguaucua

SEQ ID NO: 62241 - RNA, 23 nt, Artificial Sequence
  RNA Oligomer
cucaguuuauugguugaaugugu

SEQ ID NO: 62242 - RNA, 23 nt, Artificial Sequence
  RNA Oligomer
ucucaguuuauugguugaaugug

SEQ ID NO: 62243 - RNA, 23 nt, Artificial Sequence
  RNA Oligomer
uucucaguuuauugguugaaugu

SEQ ID NO: 62244 - RNA, 23 nt, Artificial Sequence
  RNA Oligomer
uuucucaguuuauugguugaaug

SEQ ID NO: 62245 - RNA, 23 nt, Artificial Sequence
  RNA Oligomer
cuuucucaguuuauugguugaau

SEQ ID NO: 62246 - RNA, 23 nt, Artificial Sequence
  RNA Oligomer
caucuucugaggucaauuaaaag

SEQ ID NO: 62247 - RNA, 23 nt, Artificial Sequence
  RNA Oligomer
gauaaacaccugaaauuucguau

SEQ ID NO: 62248 - RNA, 23 nt, Artificial Sequence
  RNA Oligomer
agauaaacaccugaaauuucgua

SEQ ID NO: 62249 - RNA, 23 nt, Artificial Sequence
  RNA Oligomer
aguaaggaagaagauaaacaccu

SEQ ID NO: 62250 - RNA, 23 nt, Artificial Sequence
  RNA Oligomer
aaguaaggaagaagauaaacacc

SEQ ID NO: 62251 - RNA, 23 nt, Artificial Sequence
  RNA Oligomer
aaaguaaggaagaagauaaacac

SEQ ID NO: 62252 - RNA, 23 nt, Artificial Sequence
  RNA Oligomer
aaaaguaaggaagaagauaaaca

SEQ ID NO: 62253 - RNA, 23 nt, Artificial Sequence
  RNA Oligomer
gaaagccaaugaugagagcaaug

SEQ ID NO: 62254 - RNA, 23 nt, Artificial Sequence
  RNA Oligomer
uaagcggaaagccaaugaugaga

SEQ ID NO: 62255 - RNA, 23 nt, Artificial Sequence
  RNA Oligomer
acaguagacacauaugauggccg

SEQ ID NO: 62256 - RNA, 23 nt, Artificial Sequence
  RNA Oligomer
cacaguagacacauaugauggcc

SEQ ID NO: 62257 - RNA, 23 nt, Artificial Sequence
  RNA Oligomer
ccacaguagacacauaugauggc

SEQ ID NO: 62258 - RNA, 23 nt, Artificial Sequence
  RNA Oligomer
cccacaguagacacauaugaugg

SEQ ID NO: 62259 - RNA, 23 nt, Artificial Sequence
  RNA Oligomer
ccccacaguagacacauaugaug

SEQ ID NO: 62260 - RNA, 23 nt, Artificial Sequence
  RNA Oligomer
caaacgccgaccaaggaaaacuc

SEQ ID NO: 62261 - RNA, 23 nt, Artificial Sequence
  RNA Oligomer
ccaaacgccgaccaaggaaaacu

SEQ ID NO: 62262 - RNA, 23 nt, Artificial Sequence
  RNA Oligomer
gccaaacgccgaccaaggaaaac

SEQ ID NO: 62263 - RNA, 23 nt, Artificial Sequence
  RNA Oligomer
agccaaacgccgaccaaggaaaa

SEQ ID NO: 62264 - RNA, 23 nt, Artificial Sequence
  RNA Oligomer
cagccaaacgccgaccaaggaaa

SEQ ID NO: 62265 - RNA, 23 nt, Artificial Sequence
  RNA Oligomer
gacucugaugauguagaugacac

SEQ ID NO: 62266 - RNA, 23 nt, Artificial Sequence
  RNA Oligomer
cacauggaugauauggaugauga

SEQ ID NO: 62267 - RNA, 23 nt, Artificial Sequence
  RNA Oligomer
acccuuccaaguaaguccaacga

SEQ ID NO: 62268 - RNA, 23 nt, Artificial Sequence
  RNA Oligomer
gacccuuccaaguaaguccaacg

SEQ ID NO: 62269 - RNA, 23 nt, Artificial Sequence
  RNA Oligomer
agacccuuccaaguaaguccaac

SEQ ID NO: 62270 - RNA, 23 nt, Artificial Sequence
  RNA Oligomer
gagacccuuccaaguaaguccaa

SEQ ID NO: 62271 - RNA, 23 nt, Artificial Sequence
  RNA Oligomer
gaauuugguggugucaauugcuu

SEQ ID NO: 62272 - RNA, 23 nt, Artificial Sequence
  RNA Oligomer
guaauaagaauuuggugguguca

SEQ ID NO: 62273 - RNA, 23 nt, Artificial Sequence
  RNA Oligomer
uguaauaagaauuuggugguguc

SEQ ID NO: 62274 - RNA, 23 nt, Artificial Sequence
  RNA Oligomer
auguaauaagaauuugguggugu

SEQ ID NO: 62275 - RNA, 23 nt, Artificial Sequence
  RNA Oligomer
aauguaauaagaauuugguggug

SEQ ID NO: 62276 - RNA, 23 nt, Artificial Sequence
  RNA Oligomer
gaauguaauaagaauuugguggu

SEQ ID NO: 62277 - RNA, 23 nt, Artificial Sequence
  RNA Oligomer
guggugugaauaaaucuuuuauc

SEQ ID NO: 62278 - RNA, 23 nt, Artificial Sequence
  RNA Oligomer
uguggugugaauaaaucuuuuau

SEQ ID NO: 62279 - RNA, 23 nt, Artificial Sequence
  RNA Oligomer
uuguggugugaauaaaucuuuua

SEQ ID NO: 62280 - RNA, 23 nt, Artificial Sequence
  RNA Oligomer
uuuguggugugaauaaaucuuuu

SEQ ID NO: 62281 - RNA, 23 nt, Artificial Sequence
  RNA Oligomer
uuuuguggugugaauaaaucuuu

SEQ ID NO: 62282 - RNA, 23 nt, Artificial Sequence
  RNA Oligomer
uuuuacccacuuaaaaagagaau

SEQ ID NO: 62283 - RNA, 23 nt, Artificial Sequence
  RNA Oligomer
ugaauguguaucuauuugagucu

SEQ ID NO: 62284 - RNA, 23 nt, Artificial Sequence
  RNA Oligomer
ucaguuuauugguugaaugugua

SEQ ID NO: 62285 - RNA, 23 nt, Artificial Sequence
  RNA Oligomer
gcuucuuucucaguuuauugguu

SEQ ID NO: 62286 - RNA, 23 nt, Artificial Sequence
  RNA Oligomer
ugcuucuuucucaguuuauuggu

SEQ ID NO: 62287 - RNA, 23 nt, Artificial Sequence
  RNA Oligomer
augcuucuuucucaguuuauugg

SEQ ID NO: 62288 - RNA, 23 nt, Artificial Sequence
  RNA Oligomer
aaugcuucuuucucaguuuauug

SEQ ID NO: 62289 - RNA, 23 nt, Artificial Sequence
  RNA Oligomer
aaaugcuucuuucucaguuuauu

SEQ ID NO: 62290 - RNA, 23 nt, Artificial Sequence
  RNA Oligomer
ucacuuugcauuuagucaaaaga

SEQ ID NO: 62291 - RNA, 23 nt, Artificial Sequence
  RNA Oligomer
cucacuuugcauuuagucaaaag

SEQ ID NO: 62292 - RNA, 23 nt, Artificial Sequence
  RNA Oligomer
ucucacuuugcauuuagucaaaa

SEQ ID NO: 62293 - RNA, 23 nt, Artificial Sequence
  RNA Oligomer
uucucacuuugcauuuagucaaa

SEQ ID NO: 62294 - RNA, 23 nt, Artificial Sequence
  RNA Oligomer
uuucucacuuugcauuuagucaa

SEQ ID NO: 62295 - RNA, 23 nt, Artificial Sequence
  RNA Oligomer
ucugaggucaauuaaaaggagaa

SEQ ID NO: 62296 - RNA, 23 nt, Artificial Sequence
  RNA Oligomer
ugugauugauagucaggaacuuu

SEQ ID NO: 62297 - RNA, 23 nt, Artificial Sequence
  RNA Oligomer
augugauugauagucaggaacuu

SEQ ID NO: 62298 - RNA, 23 nt, Artificial Sequence
  RNA Oligomer
gaugugauugauagucaggaacu

SEQ ID NO: 62299 - RNA, 23 nt, Artificial Sequence
  RNA Oligomer
cagauuauauaagcggaaagcca

SEQ ID NO: 62300 - RNA, 23 nt, Artificial Sequence
  RNA Oligomer
ggacaucaccucacacauggaaa

SEQ ID NO: 62301 - RNA, 23 nt, Artificial Sequence
  RNA Oligomer
aggacaucaccucacacauggaa

SEQ ID NO: 62302 - RNA, 23 nt, Artificial Sequence
  RNA Oligomer
gaggacaucaccucacacaugga

SEQ ID NO: 62303 - RNA, 23 nt, Artificial Sequence
  RNA Oligomer
cgaggacaucaccucacacaugg

SEQ ID NO: 62304 - RNA, 23 nt, Artificial Sequence
  RNA Oligomer
acgaggacaucaccucacacaug

SEQ ID NO: 62305 - RNA, 23 nt, Artificial Sequence
  RNA Oligomer
ccgaggugauagugugguuuaug

SEQ ID NO: 62306 - RNA, 23 nt, Artificial Sequence
  RNA Oligomer
gccgaggugauagugugguuuau

SEQ ID NO: 62307 - RNA, 23 nt, Artificial Sequence
  RNA Oligomer
ggccgaggugauagugugguuua

SEQ ID NO: 62308 - RNA, 23 nt, Artificial Sequence
  RNA Oligomer
uggccgaggugauagugugguuu

SEQ ID NO: 62309 - RNA, 23 nt, Artificial Sequence
  RNA Oligomer
auggccgaggugauagugugguu

SEQ ID NO: 62310 - RNA, 23 nt, Artificial Sequence
  RNA Oligomer
uccccacaguagacacauaugau

SEQ ID NO: 62311 - RNA, 23 nt, Artificial Sequence
  RNA Oligomer
ccaaggaaaacucacuaccauga

SEQ ID NO: 62312 - RNA, 23 nt, Artificial Sequence
  RNA Oligomer
accaaggaaaacucacuaccaug

SEQ ID NO: 62313 - RNA, 23 nt, Artificial Sequence
  RNA Oligomer
ccacauggaugauauggaugaug

SEQ ID NO: 62314 - RNA, 23 nt, Artificial Sequence
  RNA Oligomer
accacauggaugauauggaugau

SEQ ID NO: 62315 - RNA, 23 nt, Artificial Sequence
  RNA Oligomer
gaccacauggaugauauggauga

SEQ ID NO: 62316 - RNA, 23 nt, Artificial Sequence
  RNA Oligomer
guaaguccaacgaaagccaugac

SEQ ID NO: 62317 - RNA, 23 nt, Artificial Sequence
  RNA Oligomer
aguaaguccaacgaaagccauga

SEQ ID NO: 62318 - RNA, 23 nt, Artificial Sequence
  RNA Oligomer
aaguaaguccaacgaaagccaug

SEQ ID NO: 62319 - RNA, 23 nt, Artificial Sequence
  RNA Oligomer
caaguaaguccaacgaaagccau

SEQ ID NO: 62320 - RNA, 23 nt, Artificial Sequence
  RNA Oligomer
gcauuuaaauucugggagggcuu

SEQ ID NO: 62321 - RNA, 23 nt, Artificial Sequence
  RNA Oligomer
agcauuuaaauucugggagggcu

SEQ ID NO: 62322 - RNA, 23 nt, Artificial Sequence
  RNA Oligomer
cagcauuuaaauucugggagggc

SEQ ID NO: 62323 - RNA, 23 nt, Artificial Sequence
  RNA Oligomer
gcagcauuuaaauucugggaggg

SEQ ID NO: 62324 - RNA, 23 nt, Artificial Sequence
  RNA Oligomer
agcagcauuuaaauucugggagg

SEQ ID NO: 62325 - RNA, 23 nt, Artificial Sequence
  RNA Oligomer
uaaaagcuucaggguuaugucua

SEQ ID NO: 62326 - RNA, 23 nt, Artificial Sequence
  RNA Oligomer
cuggaaauaacuaauguguuuga

SEQ ID NO: 62327 - RNA, 23 nt, Artificial Sequence
  RNA Oligomer
ucuggaaauaacuaauguguuug

SEQ ID NO: 62328 - RNA, 23 nt, Artificial Sequence
  RNA Oligomer
gucuggaaauaacuaauguguuu

SEQ ID NO: 62329 - RNA, 23 nt, Artificial Sequence
  RNA Oligomer
agucuggaaauaacuaauguguu

SEQ ID NO: 62330 - RNA, 23 nt, Artificial Sequence
  RNA Oligomer
gagucuggaaauaacuaaugugu

SEQ ID NO: 62331 - RNA, 23 nt, Artificial Sequence
  RNA Oligomer
ugagucuggaaauaacuaaugug

SEQ ID NO: 62332 - RNA, 23 nt, Artificial Sequence
  RNA Oligomer
uugagucuggaaauaacuaaugu

SEQ ID NO: 62333 - RNA, 23 nt, Artificial Sequence
  RNA Oligomer
uuugagucuggaaauaacuaaug

SEQ ID NO: 62334 - RNA, 23 nt, Artificial Sequence
  RNA Oligomer
auuugagucuggaaauaacuaau

SEQ ID NO: 62335 - RNA, 23 nt, Artificial Sequence
  RNA Oligomer
uauuugagucuggaaauaacuaa

SEQ ID NO: 62336 - RNA, 23 nt, Artificial Sequence
  RNA Oligomer
uguaucuauuugagucuggaaau

SEQ ID NO: 62337 - RNA, 23 nt, Artificial Sequence
  RNA Oligomer
ugaaagagaacaugaaaugcuuc

SEQ ID NO: 62338 - RNA, 23 nt, Artificial Sequence
  RNA Oligomer
augaaagagaacaugaaaugcuu

SEQ ID NO: 62339 - RNA, 23 nt, Artificial Sequence
  RNA Oligomer
aaugaaagagaacaugaaaugcu

SEQ ID NO: 62340 - RNA, 23 nt, Artificial Sequence
  RNA Oligomer
aaaugaaagagaacaugaaaugc

SEQ ID NO: 62341 - RNA, 23 nt, Artificial Sequence
  RNA Oligomer
aaaaugaaagagaacaugaaaug

SEQ ID NO: 62342 - RNA, 23 nt, Artificial Sequence
  RNA Oligomer
gauagugcaucuucugaggucaa

SEQ ID NO: 62343 - RNA, 23 nt, Artificial Sequence
  RNA Oligomer
gauugauagucaggaacuuucca

SEQ ID NO: 62344 - RNA, 23 nt, Artificial Sequence
  RNA Oligomer
ugauugauagucaggaacuuucc

SEQ ID NO: 62345 - RNA, 23 nt, Artificial Sequence
  RNA Oligomer
gugauugauagucaggaacuuuc

SEQ ID NO: 62346 - RNA, 23 nt, Artificial Sequence
  RNA Oligomer
caaugagcauuccgaugugauug

SEQ ID NO: 62347 - RNA, 23 nt, Artificial Sequence
  RNA Oligomer
auaagcggaaagccaaugaugag

SEQ ID NO: 62348 - RNA, 23 nt, Artificial Sequence
  RNA Oligomer
cacaagcaguccagauuauauaa

SEQ ID NO: 62349 - RNA, 23 nt, Artificial Sequence
  RNA Oligomer
ccacaagcaguccagauuauaua

SEQ ID NO: 62350 - RNA, 23 nt, Artificial Sequence
  RNA Oligomer
gccacaagcaguccagauuauau

SEQ ID NO: 62351 - RNA, 23 nt, Artificial Sequence
  RNA Oligomer
agccacaagcaguccagauuaua

SEQ ID NO: 62352 - RNA, 23 nt, Artificial Sequence
  RNA Oligomer
cagccacaagcaguccagauuau

SEQ ID NO: 62353 - RNA, 23 nt, Artificial Sequence
  RNA Oligomer
acagccacaagcaguccagauua

SEQ ID NO: 62354 - RNA, 23 nt, Artificial Sequence
  RNA Oligomer
cacagccacaagcaguccagauu

SEQ ID NO: 62355 - RNA, 23 nt, Artificial Sequence
  RNA Oligomer
ugaaacgagucagcuggaugacc

SEQ ID NO: 62356 - RNA, 23 nt, Artificial Sequence
  RNA Oligomer
augaaacgagucagcuggaugac

SEQ ID NO: 62357 - RNA, 23 nt, Artificial Sequence
  RNA Oligomer
uaugaaacgagucagcuggauga

SEQ ID NO: 62358 - RNA, 23 nt, Artificial Sequence
  RNA Oligomer
uuaugaaacgagucagcuggaug

SEQ ID NO: 62359 - RNA, 23 nt, Artificial Sequence
  RNA Oligomer
guuaugaaacgagucagcuggau

SEQ ID NO: 62360 - RNA, 23 nt, Artificial Sequence
  RNA Oligomer
acaguuaugaaacgagucagcug

SEQ ID NO: 62361 - RNA, 23 nt, Artificial Sequence
  RNA Oligomer
gacaguuaugaaacgagucagcu

SEQ ID NO: 62362 - RNA, 23 nt, Artificial Sequence
  RNA Oligomer
agcgaggaguugaauggugcaua

SEQ ID NO: 62363 - RNA, 23 nt, Artificial Sequence
  RNA Oligomer
cgaggugauagugugguuuaugg

SEQ ID NO: 62364 - RNA, 23 nt, Artificial Sequence
  RNA Oligomer
aaggaaaacucacuaccaugaga

SEQ ID NO: 62365 - RNA, 23 nt, Artificial Sequence
  RNA Oligomer
caaggaaaacucacuaccaugag

SEQ ID NO: 62366 - RNA, 23 nt, Artificial Sequence
  RNA Oligomer
cacauaugauggccgaggugaua

SEQ ID NO: 62367 - RNA, 23 nt, Artificial Sequence
  RNA Oligomer
acacauaugauggccgaggugau

SEQ ID NO: 62368 - RNA, 23 nt, Artificial Sequence
  RNA Oligomer
gacacauaugauggccgagguga

SEQ ID NO: 62369 - RNA, 23 nt, Artificial Sequence
  RNA Oligomer
agacacauaugauggccgaggug

SEQ ID NO: 62370 - RNA, 23 nt, Artificial Sequence
  RNA Oligomer
uagacacauaugauggccgaggu

SEQ ID NO: 62371 - RNA, 23 nt, Artificial Sequence
  RNA Oligomer
ugaacuggucacugauuuuccca

SEQ ID NO: 62372 - RNA, 23 nt, Artificial Sequence
  RNA Oligomer
augaacuggucacugauuuuccc

SEQ ID NO: 62373 - RNA, 23 nt, Artificial Sequence
  RNA Oligomer
gaugaacuggucacugauuuucc

SEQ ID NO: 62374 - RNA, 23 nt, Artificial Sequence
  RNA Oligomer
ugaugaacuggucacugauuuuc

SEQ ID NO: 62375 - RNA, 23 nt, Artificial Sequence
  RNA Oligomer
cugaugaacuggucacugauuuu

SEQ ID NO: 62376 - RNA, 23 nt, Artificial Sequence
  RNA Oligomer
agaugacacugaugauucucacc

SEQ ID NO: 62377 - RNA, 23 nt, Artificial Sequence
  RNA Oligomer
uagaugacacugaugauucucac

SEQ ID NO: 62378 - RNA, 23 nt, Artificial Sequence
  RNA Oligomer
gacucgaacgacucugaugaugu

SEQ ID NO: 62379 - RNA, 23 nt, Artificial Sequence
  RNA Oligomer
ugacucgaacgacucugaugaug

SEQ ID NO: 62380 - RNA, 23 nt, Artificial Sequence
  RNA Oligomer
uugacucgaacgacucugaugau

SEQ ID NO: 62381 - RNA, 23 nt, Artificial Sequence
  RNA Oligomer
cagcagcauuuaaauucugggag

SEQ ID NO: 62382 - RNA, 23 nt, Artificial Sequence
  RNA Oligomer
cuggaaguucugaggaaaagcag

SEQ ID NO: 62383 - RNA, 23 nt, Artificial Sequence
  RNA Oligomer
ucuggaaguucugaggaaaagca

SEQ ID NO: 62384 - RNA, 23 nt, Artificial Sequence
  RNA Oligomer
uucuggaaguucugaggaaaagc

SEQ ID NO: 62385 - RNA, 23 nt, Artificial Sequence
  RNA Oligomer
auucuggaaguucugaggaaaag

SEQ ID NO: 62386 - RNA, 23 nt, Artificial Sequence
  RNA Oligomer
gauucuggaaguucugaggaaaa

SEQ ID NO: 62387 - RNA, 23 nt, Artificial Sequence
  RNA Oligomer
caguuaaacaggcugauucugga

SEQ ID NO: 62388 - RNA, 23 nt, Artificial Sequence
  RNA Oligomer
ccaguuaaacaggcugauucugg

SEQ ID NO: 62389 - RNA, 23 nt, Artificial Sequence
  RNA Oligomer
accaguuaaacaggcugauucug

SEQ ID NO: 62390 - RNA, 23 nt, Artificial Sequence
  RNA Oligomer
uaccaguuaaacaggcugauucu

SEQ ID NO: 62391 - RNA, 23 nt, Artificial Sequence
  RNA Oligomer
auaccaguuaaacaggcugauuc

SEQ ID NO: 62392 - RNA, 23 nt, Artificial Sequence
  RNA Oligomer
gugauuaucuuuuugugguguga

SEQ ID NO: 62393 - RNA, 23 nt, Artificial Sequence
  RNA Oligomer
ugugauuaucuuuuuguggugug

SEQ ID NO: 62394 - RNA, 23 nt, Artificial Sequence
  RNA Oligomer
uugugauuaucuuuuuguggugu

SEQ ID NO: 62395 - RNA, 23 nt, Artificial Sequence
  RNA Oligomer
guugugauuaucuuuuuguggug

SEQ ID NO: 62396 - RNA, 23 nt, Artificial Sequence
  RNA Oligomer
caauuucucacuuugcauuuagu

SEQ ID NO: 62397 - RNA, 23 nt, Artificial Sequence
  RNA Oligomer
acaauuucucacuuugcauuuag

SEQ ID NO: 62398 - RNA, 23 nt, Artificial Sequence
  RNA Oligomer
uacaauuucucacuuugcauuua

SEQ ID NO: 62399 - RNA, 23 nt, Artificial Sequence
  RNA Oligomer
auacaauuucucacuuugcauuu

SEQ ID NO: 62400 - RNA, 23 nt, Artificial Sequence
  RNA Oligomer
aauacaauuucucacuuugcauu

SEQ ID NO: 62401 - RNA, 23 nt, Artificial Sequence
  RNA Oligomer
uucugaggucaauuaaaaggaga

SEQ ID NO: 62402 - RNA, 23 nt, Artificial Sequence
  RNA Oligomer
cuucugaggucaauuaaaaggag

SEQ ID NO: 62403 - RNA, 23 nt, Artificial Sequence
  RNA Oligomer
ucuucugaggucaauuaaaagga

SEQ ID NO: 62404 - RNA, 23 nt, Artificial Sequence
  RNA Oligomer
aucuucugaggucaauuaaaagg

SEQ ID NO: 62405 - RNA, 23 nt, Artificial Sequence
  RNA Oligomer
ucaugaauuagauagugcaucuu

SEQ ID NO: 62406 - RNA, 23 nt, Artificial Sequence
  RNA Oligomer
cucaugaauuagauagugcaucu

SEQ ID NO: 62407 - RNA, 23 nt, Artificial Sequence
  RNA Oligomer
ucucaugaauuagauagugcauc

SEQ ID NO: 62408 - RNA, 23 nt, Artificial Sequence
  RNA Oligomer
uucucaugaauuagauagugcau

SEQ ID NO: 62409 - RNA, 23 nt, Artificial Sequence
  RNA Oligomer
uuucucaugaauuagauagugca

SEQ ID NO: 62410 - RNA, 23 nt, Artificial Sequence
  RNA Oligomer
ugaagauaugcugguuguagacc

SEQ ID NO: 62411 - RNA, 23 nt, Artificial Sequence
  RNA Oligomer
augaagauaugcugguuguagac

SEQ ID NO: 62412 - RNA, 23 nt, Artificial Sequence
  RNA Oligomer
caugaagauaugcugguuguaga

SEQ ID NO: 62413 - RNA, 23 nt, Artificial Sequence
  RNA Oligomer
ccaugaagauaugcugguuguag

SEQ ID NO: 62414 - RNA, 23 nt, Artificial Sequence
  RNA Oligomer
gccaugaagauaugcugguugua

SEQ ID NO: 62415 - RNA, 23 nt, Artificial Sequence
  RNA Oligomer
ccaaagucagccgugaauuccac

SEQ ID NO: 62416 - RNA, 23 nt, Artificial Sequence
  RNA Oligomer
uccaaagucagccgugaauucca

SEQ ID NO: 62417 - RNA, 23 nt, Artificial Sequence
  RNA Oligomer
uuccaaagucagccgugaauucc

SEQ ID NO: 62418 - RNA, 23 nt, Artificial Sequence
  RNA Oligomer
uuuccaaagucagccgugaauuc

SEQ ID NO: 62419 - RNA, 23 nt, Artificial Sequence
  RNA Oligomer
cuuuccaaagucagccgugaauu

SEQ ID NO: 62420 - RNA, 23 nt, Artificial Sequence
  RNA Oligomer
aaugagcauuccgaugugauuga

SEQ ID NO: 62421 - RNA, 23 nt, Artificial Sequence
  RNA Oligomer
agauuauauaagcggaaagccaa

SEQ ID NO: 62422 - RNA, 23 nt, Artificial Sequence
  RNA Oligomer
caugagaauugcagugauuugcu

SEQ ID NO: 62423 - RNA, 23 nt, Artificial Sequence
  RNA Oligomer
aagcgaggaguugaauggugcau

SEQ ID NO: 62424 - RNA, 23 nt, Artificial Sequence
  RNA Oligomer
ggaaagcgaggaguugaauggug

SEQ ID NO: 62425 - RNA, 23 nt, Artificial Sequence
  RNA Oligomer
uggaaagcgaggaguugaauggu

SEQ ID NO: 62426 - RNA, 23 nt, Artificial Sequence
  RNA Oligomer
auggaaagcgaggaguugaaugg

SEQ ID NO: 62427 - RNA, 23 nt, Artificial Sequence
  RNA Oligomer
cauggaaagcgaggaguugaaug

SEQ ID NO: 62428 - RNA, 23 nt, Artificial Sequence
  RNA Oligomer
acauggaaagcgaggaguugaau

SEQ ID NO: 62429 - RNA, 23 nt, Artificial Sequence
  RNA Oligomer
cacauggaaagcgaggaguugaa

SEQ ID NO: 62430 - RNA, 23 nt, Artificial Sequence
  RNA Oligomer
acacauggaaagcgaggaguuga

SEQ ID NO: 62431 - RNA, 23 nt, Artificial Sequence
  RNA Oligomer
cacacauggaaagcgaggaguug

SEQ ID NO: 62432 - RNA, 23 nt, Artificial Sequence
  RNA Oligomer
ucacacauggaaagcgaggaguu

SEQ ID NO: 62433 - RNA, 23 nt, Artificial Sequence
  RNA Oligomer
augcuacagacgaggacaucacc

SEQ ID NO: 62434 - RNA, 23 nt, Artificial Sequence
  RNA Oligomer
gaugcuacagacgaggacaucac

SEQ ID NO: 62435 - RNA, 23 nt, Artificial Sequence
  RNA Oligomer
ugaugcuacagacgaggacauca

SEQ ID NO: 62436 - RNA, 23 nt, Artificial Sequence
  RNA Oligomer
cugaugcuacagacgaggacauc

SEQ ID NO: 62437 - RNA, 23 nt, Artificial Sequence
  RNA Oligomer
ccugaugcuacagacgaggacau

SEQ ID NO: 62438 - RNA, 23 nt, Artificial Sequence
  RNA Oligomer
cccugaugcuacagacgaggaca

SEQ ID NO: 62439 - RNA, 23 nt, Artificial Sequence
  RNA Oligomer
acccugaugcuacagacgaggac

SEQ ID NO: 62440 - RNA, 23 nt, Artificial Sequence
  RNA Oligomer
uggaaguucugaggaaaagcagc

SEQ ID NO: 62441 - RNA, 23 nt, Artificial Sequence
  RNA Oligomer
aauuugguggugucaauugcuua

SEQ ID NO: 62442 - RNA, 23 nt, Artificial Sequence
  RNA Oligomer
uguugugauuaucuuuuuguggu

SEQ ID NO: 62443 - RNA, 23 nt, Artificial Sequence
  RNA Oligomer
gaaaugcuucuuucucaguuuau

SEQ ID NO: 62444 - RNA, 23 nt, Artificial Sequence
  RNA Oligomer
uggacugaggucaaaaucuaaga

SEQ ID NO: 62445 - RNA, 23 nt, Artificial Sequence
  RNA Oligomer
aggugauagugugguuuauggac

SEQ ID NO: 62446 - RNA, 23 nt, Artificial Sequence
  RNA Oligomer
gaggugauagugugguuuaugga

SEQ ID NO: 62447 - RNA, 23 nt, Artificial Sequence
  RNA Oligomer
caccauucugaugaaucugauga

SEQ ID NO: 62448 - RNA, 23 nt, Artificial Sequence
  RNA Oligomer
ucaccauucugaugaaucugaug

SEQ ID NO: 62449 - RNA, 23 nt, Artificial Sequence
  RNA Oligomer
cucaccauucugaugaaucugau

SEQ ID NO: 62450 - RNA, 23 nt, Artificial Sequence
  RNA Oligomer
aacgccgaccaaggaaaacucac

SEQ ID NO: 62451 - RNA, 23 nt, Artificial Sequence
  RNA Oligomer
aaacgccgaccaaggaaaacuca

SEQ ID NO: 62452 - RNA, 23 nt, Artificial Sequence
  RNA Oligomer
ugagucucaccauucugaugaau

SEQ ID NO: 62453 - RNA, 23 nt, Artificial Sequence
  RNA Oligomer
augagucucaccauucugaugaa

SEQ ID NO: 62454 - RNA, 23 nt, Artificial Sequence
  RNA Oligomer
gaugagucucaccauucugauga

SEQ ID NO: 62455 - RNA, 23 nt, Artificial Sequence
  RNA Oligomer
ugaugagucucaccauucugaug

SEQ ID NO: 62456 - RNA, 23 nt, Artificial Sequence
  RNA Oligomer
cugaugagucucaccauucugau

SEQ ID NO: 62457 - RNA, 23 nt, Artificial Sequence
  RNA Oligomer
augauauggaugaugaagaugau

SEQ ID NO: 62458 - RNA, 23 nt, Artificial Sequence
  RNA Oligomer
gaugauauggaugaugaagauga

SEQ ID NO: 62459 - RNA, 23 nt, Artificial Sequence
  RNA Oligomer
ugauucuggaaguucugaggaaa

SEQ ID NO: 62460 - RNA, 23 nt, Artificial Sequence
  RNA Oligomer
caaaauacuuuuacccacuuaaa

SEQ ID NO: 62461 - RNA, 23 nt, Artificial Sequence
  RNA Oligomer
acaaaauacuuuuacccacuuaa

SEQ ID NO: 62462 - RNA, 23 nt, Artificial Sequence
  RNA Oligomer
aacaaaauacuuuuacccacuua

SEQ ID NO: 62463 - RNA, 23 nt, Artificial Sequence
  RNA Oligomer
aaacaaaauacuuuuacccacuu

SEQ ID NO: 62464 - RNA, 23 nt, Artificial Sequence
  RNA Oligomer
caaacaaaauacuuuuacccacu

SEQ ID NO: 62465 - RNA, 23 nt, Artificial Sequence
  RNA Oligomer
guuuauugguugaauguguaucu

SEQ ID NO: 62466 - RNA, 23 nt, Artificial Sequence
  RNA Oligomer
aguuuauugguugaauguguauc

SEQ ID NO: 62467 - RNA, 23 nt, Artificial Sequence
  RNA Oligomer
caguuuauugguugaauguguau

SEQ ID NO: 62468 - RNA, 23 nt, Artificial Sequence
  RNA Oligomer
ucuuucucaguuuauugguugaa

SEQ ID NO: 62469 - RNA, 23 nt, Artificial Sequence
  RNA Oligomer
aaauacaauuucucacuuugcau

SEQ ID NO: 62470 - RNA, 23 nt, Artificial Sequence
  RNA Oligomer
auggacugaggucaaaaucuaag

SEQ ID NO: 62471 - RNA, 23 nt, Artificial Sequence
  RNA Oligomer
uauggacugaggucaaaaucuaa

SEQ ID NO: 62472 - RNA, 23 nt, Artificial Sequence
  RNA Oligomer
ggaugaugaagaugaugaugacc

SEQ ID NO: 62473 - RNA, 23 nt, Artificial Sequence
  RNA Oligomer
uggaugaugaagaugaugaugac

SEQ ID NO: 62474 - RNA, 23 nt, Artificial Sequence
  RNA Oligomer
auggaugaugaagaugaugauga

SEQ ID NO: 62475 - RNA, 23 nt, Artificial Sequence
  RNA Oligomer
uauggaugaugaagaugaugaug

SEQ ID NO: 62476 - RNA, 23 nt, Artificial Sequence
  RNA Oligomer
auauggaugaugaagaugaugau

SEQ ID NO: 62477 - RNA, 23 nt, Artificial Sequence
  RNA Oligomer
agagacccuuccaaguaagucca

SEQ ID NO: 62478 - RNA, 23 nt, Artificial Sequence
  RNA Oligomer
cugauucuggaaguucugaggaa

SEQ ID NO: 62479 - RNA, 23 nt, Artificial Sequence
  RNA Oligomer
gcugauucuggaaguucugagga

SEQ ID NO: 62480 - RNA, 23 nt, Artificial Sequence
  RNA Oligomer
cuguguugguggaggaugucugc

SEQ ID NO: 62481 - RNA, 23 nt, Artificial Sequence
  RNA Oligomer
ccuguguugguggaggaugucug

SEQ ID NO: 62482 - RNA, 23 nt, Artificial Sequence
  RNA Oligomer
cccuguguugguggaggaugucu

SEQ ID NO: 62483 - RNA, 23 nt, Artificial Sequence
  RNA Oligomer
ucccuguguugguggaggauguc

SEQ ID NO: 62484 - RNA, 23 nt, Artificial Sequence
  RNA Oligomer
cucccuguguugguggaggaugu

SEQ ID NO: 62485 - RNA, 23 nt, Artificial Sequence
  RNA Oligomer
uuuuuguggugugaauaaaucuu

SEQ ID NO: 62486 - RNA, 23 nt, Artificial Sequence
  RNA Oligomer
aucuuuuuguggugugaauaaau

SEQ ID NO: 62487 - RNA, 23 nt, Artificial Sequence
  RNA Oligomer
uaucuuuuuguggugugaauaaa

SEQ ID NO: 62488 - RNA, 23 nt, Artificial Sequence
  RNA Oligomer
uuaucuuuuuguggugugaauaa

SEQ ID NO: 62489 - RNA, 23 nt, Artificial Sequence
  RNA Oligomer
auuaucuuuuuguggugugaaua

SEQ ID NO: 62490 - RNA, 23 nt, Artificial Sequence
  RNA Oligomer
gauuaucuuuuuguggugugaau

SEQ ID NO: 62491 - RNA, 23 nt, Artificial Sequence
  RNA Oligomer
ugaaaugcuucuuucucaguuua

SEQ ID NO: 62492 - RNA, 23 nt, Artificial Sequence
  RNA Oligomer
cacuaccaugagaauugcaguga

SEQ ID NO: 62493 - RNA, 23 nt, Artificial Sequence
  RNA Oligomer
caguuaugaaacgagucagcugg

SEQ ID NO: 62494 - RNA, 23 nt, Artificial Sequence
  RNA Oligomer
aaagcgaggaguugaauggugca

SEQ ID NO: 62495 - RNA, 23 nt, Artificial Sequence
  RNA Oligomer
cuuuuacccacuuaaaaagagaa

SEQ ID NO: 62496 - RNA, 23 nt, Artificial Sequence
  RNA Oligomer
gcaaacaaaauacuuuuacccac

SEQ ID NO: 62497 - RNA, 23 nt, Artificial Sequence
  RNA Oligomer
guagaagcaaacaaaauacuuuu

SEQ ID NO: 62498 - RNA, 23 nt, Artificial Sequence
  RNA Oligomer
uguagaagcaaacaaaauacuuu

SEQ ID NO: 62499 - RNA, 23 nt, Artificial Sequence
  RNA Oligomer
auguagaagcaaacaaaauacuu

SEQ ID NO: 62500 - RNA, 23 nt, Artificial Sequence
  RNA Oligomer
uauguagaagcaaacaaaauacu

SEQ ID NO: 62501 - RNA, 23 nt, Artificial Sequence
  RNA Oligomer
uuauguagaagcaaacaaaauac

SEQ ID NO: 62502 - RNA, 23 nt, Artificial Sequence
  RNA Oligomer
uuaguuuaguuuguggcuucaug

SEQ ID NO: 62503 - RNA, 23 nt, Artificial Sequence
  RNA Oligomer
auuaguuuaguuuguggcuucau

SEQ ID NO: 62504 - RNA, 23 nt, Artificial Sequence
  RNA Oligomer
aauuaguuuaguuuguggcuuca

SEQ ID NO: 62505 - RNA, 23 nt, Artificial Sequence
  RNA Oligomer
uaauuaguuuaguuuguggcuuc

SEQ ID NO: 62506 - RNA, 23 nt, Artificial Sequence
  RNA Oligomer
auaauuaguuuaguuuguggcuu

SEQ ID NO: 62507 - RNA, 23 nt, Artificial Sequence
  RNA Oligomer
uugaauguguaucuauuugaguc

SEQ ID NO: 62508 - RNA, 23 nt, Artificial Sequence
  RNA Oligomer
guugaauguguaucuauuugagu

SEQ ID NO: 62509 - RNA, 23 nt, Artificial Sequence
  RNA Oligomer
uucuuucucaguuuauugguuga

SEQ ID NO: 62510 - RNA, 23 nt, Artificial Sequence
  RNA Oligomer
cuucuuucucaguuuauugguug

SEQ ID NO: 62511 - RNA, 23 nt, Artificial Sequence
  RNA Oligomer
aagagaacaugaaaugcuucuuu

SEQ ID NO: 62512 - RNA, 23 nt, Artificial Sequence
  RNA Oligomer
aaagagaacaugaaaugcuucuu

SEQ ID NO: 62513 - RNA, 23 nt, Artificial Sequence
  RNA Oligomer
gaaagagaacaugaaaugcuucu

SEQ ID NO: 62514 - RNA, 23 nt, Artificial Sequence
  RNA Oligomer
auuucucaugaauuagauagugc

SEQ ID NO: 62515 - RNA, 23 nt, Artificial Sequence
  RNA Oligomer
uauuucucaugaauuagauagug

SEQ ID NO: 62516 - RNA, 23 nt, Artificial Sequence
  RNA Oligomer
gccgugggaaggacaguuaugaa

SEQ ID NO: 62517 - RNA, 23 nt, Artificial Sequence
  RNA Oligomer
gaaagcgaggaguugaauggugc

SEQ ID NO: 62518 - RNA, 23 nt, Artificial Sequence
  RNA Oligomer
ugauggccgaggugauagugugg

SEQ ID NO: 62519 - RNA, 23 nt, Artificial Sequence
  RNA Oligomer
augauggccgaggugauagugug

SEQ ID NO: 62520 - RNA, 23 nt, Artificial Sequence
  RNA Oligomer
uaugauggccgaggugauagugu

SEQ ID NO: 62521 - RNA, 23 nt, Artificial Sequence
  RNA Oligomer
auaugauggccgaggugauagug

SEQ ID NO: 62522 - RNA, 23 nt, Artificial Sequence
  RNA Oligomer
cauaugauggccgaggugauagu

SEQ ID NO: 62523 - RNA, 23 nt, Artificial Sequence
  RNA Oligomer
gaaaugcaaacuaucacuguauu

SEQ ID NO: 62524 - RNA, 23 nt, Artificial Sequence
  RNA Oligomer
agaaaugcaaacuaucacuguau

SEQ ID NO: 62525 - RNA, 23 nt, Artificial Sequence
  RNA Oligomer
guuuguggcuucauggaaacucc

SEQ ID NO: 62526 - RNA, 23 nt, Artificial Sequence
  RNA Oligomer
aguuuguggcuucauggaaacuc

SEQ ID NO: 62527 - RNA, 23 nt, Artificial Sequence
  RNA Oligomer
uaguuuguggcuucauggaaacu

SEQ ID NO: 62528 - RNA, 23 nt, Artificial Sequence
  RNA Oligomer
uuaguuuguggcuucauggaaac

SEQ ID NO: 62529 - RNA, 23 nt, Artificial Sequence
  RNA Oligomer
uuuaguuuguggcuucauggaaa

SEQ ID NO: 62530 - RNA, 23 nt, Artificial Sequence
  RNA Oligomer
ugagaauugcagugauuugcuuu

SEQ ID NO: 62531 - RNA, 23 nt, Artificial Sequence
  RNA Oligomer
augagaauugcagugauuugcuu

SEQ ID NO: 62532 - RNA, 23 nt, Artificial Sequence
  RNA Oligomer
aagaaaugcaaacuaucacugua

SEQ ID NO: 62533 - RNA, 23 nt, Artificial Sequence
  RNA Oligomer
accugugccauaccaguuaaaca

SEQ ID NO: 62534 - RNA, 23 nt, Artificial Sequence
  RNA Oligomer
caccugugccauaccaguuaaac

SEQ ID NO: 62535 - RNA, 23 nt, Artificial Sequence
  RNA Oligomer
ucaccugugccauaccaguuaaa

SEQ ID NO: 62536 - RNA, 23 nt, Artificial Sequence
  RNA Oligomer
aucaccugugccauaccaguuaa

SEQ ID NO: 62537 - RNA, 23 nt, Artificial Sequence
  RNA Oligomer
caucaccugugccauaccaguua

SEQ ID NO: 62538 - RNA, 23 nt, Artificial Sequence
  RNA Oligomer
augaaaugcuucuuucucaguuu

SEQ ID NO: 62539 - RNA, 23 nt, Artificial Sequence
  RNA Oligomer
caaaaugaaagagaacaugaaau

SEQ ID NO: 62540 - RNA, 23 nt, Artificial Sequence
  RNA Oligomer
agccgugggaaggacaguuauga

SEQ ID NO: 62541 - RNA, 23 nt, Artificial Sequence
  RNA Oligomer
gugugguuuauggacugagguca

SEQ ID NO: 62542 - RNA, 23 nt, Artificial Sequence
  RNA Oligomer
agugugguuuauggacugagguc

SEQ ID NO: 62543 - RNA, 23 nt, Artificial Sequence
  RNA Oligomer
uagugugguuuauggacugaggu

SEQ ID NO: 62544 - RNA, 23 nt, Artificial Sequence
  RNA Oligomer
auagugugguuuauggacugagg

SEQ ID NO: 62545 - RNA, 23 nt, Artificial Sequence
  RNA Oligomer
gauagugugguuuauggacugag

SEQ ID NO: 62546 - RNA, 23 nt, Artificial Sequence
  RNA Oligomer
gcagaccugacauccaguacccu

SEQ ID NO: 62547 - RNA, 23 nt, Artificial Sequence
  RNA Oligomer
cgcagaccugacauccaguaccc

SEQ ID NO: 62548 - RNA, 23 nt, Artificial Sequence
  RNA Oligomer
ucgcagaccugacauccaguacc

SEQ ID NO: 62549 - RNA, 23 nt, Artificial Sequence
  RNA Oligomer
uucgcagaccugacauccaguac

SEQ ID NO: 62550 - RNA, 23 nt, Artificial Sequence
  RNA Oligomer
uuucgcagaccugacauccagua

SEQ ID NO: 62551 - RNA, 23 nt, Artificial Sequence
  RNA Oligomer
ggugauagugugguuuauggacu

SEQ ID NO: 62552 - RNA, 23 nt, Artificial Sequence
  RNA Oligomer
ugaugaagaugaugaugaccaug

SEQ ID NO: 62553 - RNA, 23 nt, Artificial Sequence
  RNA Oligomer
augaugaagaugaugaugaccau

SEQ ID NO: 62554 - RNA, 23 nt, Artificial Sequence
  RNA Oligomer
gaugaugaagaugaugaugacca

SEQ ID NO: 62555 - RNA, 23 nt, Artificial Sequence
  RNA Oligomer
cccuguaaacuaaaagcuucagg

SEQ ID NO: 62556 - RNA, 23 nt, Artificial Sequence
  RNA Oligomer
ccaugaauuucacagccaugaag

SEQ ID NO: 62557 - RNA, 23 nt, Artificial Sequence
  RNA Oligomer
gccaugaauuucacagccaugaa

SEQ ID NO: 62558 - RNA, 23 nt, Artificial Sequence
  RNA Oligomer
agccaugaauuucacagccauga

SEQ ID NO: 62559 - RNA, 23 nt, Artificial Sequence
  RNA Oligomer
cagccaugaauuucacagccaug

SEQ ID NO: 62560 - RNA, 23 nt, Artificial Sequence
  RNA Oligomer
acagccaugaauuucacagccau

SEQ ID NO: 62561 - RNA, 23 nt, Artificial Sequence
  RNA Oligomer
gaacaugaaaugcuucuuucuca

SEQ ID NO: 62562 - RNA, 23 nt, Artificial Sequence
  RNA Oligomer
agaacaugaaaugcuucuuucuc

SEQ ID NO: 62563 - RNA, 23 nt, Artificial Sequence
  RNA Oligomer
gagaacaugaaaugcuucuuucu

SEQ ID NO: 62564 - RNA, 23 nt, Artificial Sequence
  RNA Oligomer
agagaacaugaaaugcuucuuuc

SEQ ID NO: 62565 - RNA, 23 nt, Artificial Sequence
  RNA Oligomer
aggacuccauugacucgaacgac

SEQ ID NO: 62566 - RNA, 23 nt, Artificial Sequence
  RNA Oligomer
caggacuccauugacucgaacga

SEQ ID NO: 62567 - RNA, 23 nt, Artificial Sequence
  RNA Oligomer
ccaggacuccauugacucgaacg

SEQ ID NO: 62568 - RNA, 23 nt, Artificial Sequence
  RNA Oligomer
gccaggacuccauugacucgaac

SEQ ID NO: 62569 - RNA, 23 nt, Artificial Sequence
  RNA Oligomer
agccaggacuccauugacucgaa

SEQ ID NO: 62570 - RNA, 23 nt, Artificial Sequence
  RNA Oligomer
ugaccacauggaugauauggaug

SEQ ID NO: 62571 - RNA, 23 nt, Artificial Sequence
  RNA Oligomer
augaccacauggaugauauggau

SEQ ID NO: 62572 - RNA, 23 nt, Artificial Sequence
  RNA Oligomer
cccacgguuguccagcaauuaau

SEQ ID NO: 62573 - RNA, 23 nt, Artificial Sequence
  RNA Oligomer
agccaugaagauaugcugguugu

SEQ ID NO: 62574 - RNA, 23 nt, Artificial Sequence
  RNA Oligomer
cagccaugaagauaugcugguug

SEQ ID NO: 62575 - RNA, 23 nt, Artificial Sequence
  RNA Oligomer
acagccaugaagauaugcugguu

SEQ ID NO: 62576 - RNA, 23 nt, Artificial Sequence
  RNA Oligomer
ucugaugaacuggucacugauuu

SEQ ID NO: 62577 - RNA, 23 nt, Artificial Sequence
  RNA Oligomer
aucugaugaacuggucacugauu

SEQ ID NO: 62578 - RNA, 23 nt, Artificial Sequence
  RNA Oligomer
aaucugaugaacuggucacugau

SEQ ID NO: 62579 - RNA, 23 nt, Artificial Sequence
  RNA Oligomer
gaaucugaugaacuggucacuga

SEQ ID NO: 62580 - RNA, 23 nt, Artificial Sequence
  RNA Oligomer
ucucaccauucugaugaaucuga

SEQ ID NO: 62581 - RNA, 23 nt, Artificial Sequence
  RNA Oligomer
agaugaugaugaccauguggaca

SEQ ID NO: 62582 - RNA, 23 nt, Artificial Sequence
  RNA Oligomer
aagaugaugaugaccauguggac

SEQ ID NO: 62583 - RNA, 23 nt, Artificial Sequence
  RNA Oligomer
gaagaugaugaugaccaugugga

SEQ ID NO: 62584 - RNA, 23 nt, Artificial Sequence
  RNA Oligomer
ugaagaugaugaugaccaugugg

SEQ ID NO: 62585 - RNA, 23 nt, Artificial Sequence
  RNA Oligomer
augaagaugaugaugaccaugug

SEQ ID NO: 62586 - RNA, 23 nt, Artificial Sequence
  RNA Oligomer
gaaguucugaggaaaagcagcuu

SEQ ID NO: 62587 - RNA, 23 nt, Artificial Sequence
  RNA Oligomer
ggaaguucugaggaaaagcagcu

SEQ ID NO: 62588 - RNA, 23 nt, Artificial Sequence
  RNA Oligomer
ucccacgguuguccagcaauuaa

SEQ ID NO: 62589 - RNA, 23 nt, Artificial Sequence
  RNA Oligomer
uucccacgguuguccagcaauua

SEQ ID NO: 62590 - RNA, 23 nt, Artificial Sequence
  RNA Oligomer
uuucccacgguuguccagcaauu

SEQ ID NO: 62591 - RNA, 23 nt, Artificial Sequence
  RNA Oligomer
ccuguaaacuaaaagcuucaggg

SEQ ID NO: 62592 - RNA, 23 nt, Artificial Sequence
  RNA Oligomer
cacagccaugaauuucacagcca

SEQ ID NO: 62593 - RNA, 23 nt, Artificial Sequence
  RNA Oligomer
ucaggaacuuuccaaagucagcc

SEQ ID NO: 62594 - RNA, 23 nt, Artificial Sequence
  RNA Oligomer
gucaggaacuuuccaaagucagc

SEQ ID NO: 62595 - RNA, 23 nt, Artificial Sequence
  RNA Oligomer
agucaggaacuuuccaaagucag

SEQ ID NO: 62596 - RNA, 23 nt, Artificial Sequence
  RNA Oligomer
uagucaggaacuuuccaaaguca

SEQ ID NO: 62597 - RNA, 23 nt, Artificial Sequence
  RNA Oligomer
auagucaggaacuuuccaaaguc

SEQ ID NO: 62598 - RNA, 23 nt, Artificial Sequence
  RNA Oligomer
guccccacaguagacacauauga

SEQ ID NO: 62599 - RNA, 23 nt, Artificial Sequence
  RNA Oligomer
gaacuggucacugauuuucccac

SEQ ID NO: 62600 - RNA, 23 nt, Artificial Sequence
  RNA Oligomer
gauauggaugaugaagaugauga

SEQ ID NO: 62601 - RNA, 23 nt, Artificial Sequence
  RNA Oligomer
ugucugcagcagcauuuaaauuc

SEQ ID NO: 62602 - RNA, 23 nt, Artificial Sequence
  RNA Oligomer
augucugcagcagcauuuaaauu

SEQ ID NO: 62603 - RNA, 23 nt, Artificial Sequence
  RNA Oligomer
gaugucugcagcagcauuuaaau

SEQ ID NO: 62604 - RNA, 23 nt, Artificial Sequence
  RNA Oligomer
ggaugucugcagcagcauuuaaa

SEQ ID NO: 62605 - RNA, 23 nt, Artificial Sequence
  RNA Oligomer
ccauaccaguuaaacaggcugau

SEQ ID NO: 62606 - RNA, 23 nt, Artificial Sequence
  RNA Oligomer
gccauaccaguuaaacaggcuga

SEQ ID NO: 62607 - RNA, 23 nt, Artificial Sequence
  RNA Oligomer
cuguaaacuaaaagcuucagggu

SEQ ID NO: 62608 - RNA, 23 nt, Artificial Sequence
  RNA Oligomer
uucauggaaacucccuguaaacu

SEQ ID NO: 62609 - RNA, 23 nt, Artificial Sequence
  RNA Oligomer
cuucauggaaacucccuguaaac

SEQ ID NO: 62610 - RNA, 23 nt, Artificial Sequence
  RNA Oligomer
gcuucauggaaacucccuguaaa

SEQ ID NO: 62611 - RNA, 23 nt, Artificial Sequence
  RNA Oligomer
caggaacuuuccaaagucagccg

SEQ ID NO: 62612 - RNA, 23 nt, Artificial Sequence
  RNA Oligomer
gauagucaggaacuuuccaaagu

SEQ ID NO: 62613 - RNA, 23 nt, Artificial Sequence
  RNA Oligomer
ugagagcaaugagcauuccgaug

SEQ ID NO: 62614 - RNA, 23 nt, Artificial Sequence
  RNA Oligomer
augagagcaaugagcauuccgau

SEQ ID NO: 62615 - RNA, 23 nt, Artificial Sequence
  RNA Oligomer
gaugagagcaaugagcauuccga

SEQ ID NO: 62616 - RNA, 23 nt, Artificial Sequence
  RNA Oligomer
caucaccucacacauggaaagcg

SEQ ID NO: 62617 - RNA, 23 nt, Artificial Sequence
  RNA Oligomer
acaucaccucacacauggaaagc

SEQ ID NO: 62618 - RNA, 23 nt, Artificial Sequence
  RNA Oligomer
gacaucaccucacacauggaaag

SEQ ID NO: 62619 - RNA, 23 nt, Artificial Sequence
  RNA Oligomer
uuauggacugaggucaaaaucua

SEQ ID NO: 62620 - RNA, 23 nt, Artificial Sequence
  RNA Oligomer
gccagcaaccgaaguuuucacuc

SEQ ID NO: 62621 - RNA, 23 nt, Artificial Sequence
  RNA Oligomer
ugccagcaaccgaaguuuucacu

SEQ ID NO: 62622 - RNA, 23 nt, Artificial Sequence
  RNA Oligomer
cugccagcaaccgaaguuuucac

SEQ ID NO: 62623 - RNA, 23 nt, Artificial Sequence
  RNA Oligomer
ccugccagcaaccgaaguuuuca

SEQ ID NO: 62624 - RNA, 23 nt, Artificial Sequence
  RNA Oligomer
accugccagcaaccgaaguuuuc

SEQ ID NO: 62625 - RNA, 23 nt, Artificial Sequence
  RNA Oligomer
gaccugccagcaaccgaaguuuu

SEQ ID NO: 62626 - RNA, 23 nt, Artificial Sequence
  RNA Oligomer
caugaccacauggaugauaugga

SEQ ID NO: 62627 - RNA, 23 nt, Artificial Sequence
  RNA Oligomer
ccaugaccacauggaugauaugg

SEQ ID NO: 62628 - RNA, 23 nt, Artificial Sequence
  RNA Oligomer
gccaugaccacauggaugauaug

SEQ ID NO: 62629 - RNA, 23 nt, Artificial Sequence
  RNA Oligomer
agccaugaccacauggaugauau

SEQ ID NO: 62630 - RNA, 23 nt, Artificial Sequence
  RNA Oligomer
cgaaagccaugaccacauggaug

SEQ ID NO: 62631 - RNA, 23 nt, Artificial Sequence
  RNA Oligomer
acgaaagccaugaccacauggau

SEQ ID NO: 62632 - RNA, 23 nt, Artificial Sequence
  RNA Oligomer
aacgaaagccaugaccacaugga

SEQ ID NO: 62633 - RNA, 23 nt, Artificial Sequence
  RNA Oligomer
caacgaaagccaugaccacaugg

SEQ ID NO: 62634 - RNA, 23 nt, Artificial Sequence
  RNA Oligomer
ccaacgaaagccaugaccacaug

SEQ ID NO: 62635 - RNA, 23 nt, Artificial Sequence
  RNA Oligomer
cauaccaguuaaacaggcugauu

SEQ ID NO: 62636 - RNA, 23 nt, Artificial Sequence
  RNA Oligomer
agaccccaaaaguaaggaagaag

SEQ ID NO: 62637 - RNA, 23 nt, Artificial Sequence
  RNA Oligomer
cacagccaugaagauaugcuggu

SEQ ID NO: 62638 - RNA, 23 nt, Artificial Sequence
  RNA Oligomer
gacgaggacaucaccucacacau

SEQ ID NO: 62639 - RNA, 23 nt, Artificial Sequence
  RNA Oligomer
agacgaggacaucaccucacaca

SEQ ID NO: 62640 - RNA, 23 nt, Artificial Sequence
  RNA Oligomer
cagacgaggacaucaccucacac

SEQ ID NO: 62641 - RNA, 23 nt, Artificial Sequence
  RNA Oligomer
acagacgaggacaucaccucaca

SEQ ID NO: 62642 - RNA, 23 nt, Artificial Sequence
  RNA Oligomer
ccgaaguuuucacuccaguuguc

SEQ ID NO: 62643 - RNA, 23 nt, Artificial Sequence
  RNA Oligomer
accgaaguuuucacuccaguugu

SEQ ID NO: 62644 - RNA, 23 nt, Artificial Sequence
  RNA Oligomer
aaccgaaguuuucacuccaguug

SEQ ID NO: 62645 - RNA, 23 nt, Artificial Sequence
  RNA Oligomer
caaccgaaguuuucacuccaguu

SEQ ID NO: 62646 - RNA, 23 nt, Artificial Sequence
  RNA Oligomer
gcaaccgaaguuuucacuccagu

SEQ ID NO: 62647 - RNA, 23 nt, Artificial Sequence
  RNA Oligomer
agcaaccgaaguuuucacuccag

SEQ ID NO: 62648 - RNA, 23 nt, Artificial Sequence
  RNA Oligomer
cagcaaccgaaguuuucacucca

SEQ ID NO: 62649 - RNA, 23 nt, Artificial Sequence
  RNA Oligomer
ccagcaaccgaaguuuucacucc

SEQ ID NO: 62650 - RNA, 23 nt, Artificial Sequence
  RNA Oligomer
ggacuccauugacucgaacgacu

SEQ ID NO: 62651 - RNA, 23 nt, Artificial Sequence
  RNA Oligomer
acagccaggacuccauugacucg

SEQ ID NO: 62652 - RNA, 23 nt, Artificial Sequence
  RNA Oligomer
gacagccaggacuccauugacuc

SEQ ID NO: 62653 - RNA, 23 nt, Artificial Sequence
  RNA Oligomer
ggacagccaggacuccauugacu

SEQ ID NO: 62654 - RNA, 23 nt, Artificial Sequence
  RNA Oligomer
uggacagccaggacuccauugac

SEQ ID NO: 62655 - RNA, 23 nt, Artificial Sequence
  RNA Oligomer
guggacagccaggacuccauuga

SEQ ID NO: 62656 - RNA, 23 nt, Artificial Sequence
  RNA Oligomer
gaugaagaugaugaugaccaugu

SEQ ID NO: 62657 - RNA, 23 nt, Artificial Sequence
  RNA Oligomer
uccaacgaaagccaugaccacau

SEQ ID NO: 62658 - RNA, 23 nt, Artificial Sequence
  RNA Oligomer
caugaaaugcuucuuucucaguu

SEQ ID NO: 62659 - RNA, 23 nt, Artificial Sequence
  RNA Oligomer
ccugaaauuucguauuucucaug

SEQ ID NO: 62660 - RNA, 23 nt, Artificial Sequence
  RNA Oligomer
accugaaauuucguauuucucau

SEQ ID NO: 62661 - RNA, 23 nt, Artificial Sequence
  RNA Oligomer
ucacagccaugaagauaugcugg

SEQ ID NO: 62662 - RNA, 23 nt, Artificial Sequence
  RNA Oligomer
uucacagccaugaagauaugcug

SEQ ID NO: 62663 - RNA, 23 nt, Artificial Sequence
  RNA Oligomer
uuucacagccaugaagauaugcu

SEQ ID NO: 62664 - RNA, 23 nt, Artificial Sequence
  RNA Oligomer
auuucacagccaugaagauaugc

SEQ ID NO: 62665 - RNA, 23 nt, Artificial Sequence
  RNA Oligomer
aauuucacagccaugaagauaug

SEQ ID NO: 62666 - RNA, 23 nt, Artificial Sequence
  RNA Oligomer
ugauagucaggaacuuuccaaag

SEQ ID NO: 62667 - RNA, 23 nt, Artificial Sequence
  RNA Oligomer
uugauagucaggaacuuuccaaa

SEQ ID NO: 62668 - RNA, 23 nt, Artificial Sequence
  RNA Oligomer
auugauagucaggaacuuuccaa

SEQ ID NO: 62669 - RNA, 23 nt, Artificial Sequence
  RNA Oligomer
gaauugcagugauuugcuuuugc

SEQ ID NO: 62670 - RNA, 23 nt, Artificial Sequence
  RNA Oligomer
agaauugcagugauuugcuuuug

SEQ ID NO: 62671 - RNA, 23 nt, Artificial Sequence
  RNA Oligomer
gagaauugcagugauuugcuuuu

SEQ ID NO: 62672 - RNA, 23 nt, Artificial Sequence
  RNA Oligomer
cuacagacgaggacaucaccuca

SEQ ID NO: 62673 - RNA, 23 nt, Artificial Sequence
  RNA Oligomer
gcuacagacgaggacaucaccuc

SEQ ID NO: 62674 - RNA, 23 nt, Artificial Sequence
  RNA Oligomer
ugcuacagacgaggacaucaccu

SEQ ID NO: 62675 - RNA, 23 nt, Artificial Sequence
  RNA Oligomer
ggaaaacucacuaccaugagaau

SEQ ID NO: 62676 - RNA, 23 nt, Artificial Sequence
  RNA Oligomer
aggaaaacucacuaccaugagaa

SEQ ID NO: 62677 - RNA, 23 nt, Artificial Sequence
  RNA Oligomer
cgaaguuuucacuccaguugucc

SEQ ID NO: 62678 - RNA, 23 nt, Artificial Sequence
  RNA Oligomer
ggaccugccagcaaccgaaguuu

SEQ ID NO: 62679 - RNA, 23 nt, Artificial Sequence
  RNA Oligomer
gucucaccauucugaugaaucug

SEQ ID NO: 62680 - RNA, 23 nt, Artificial Sequence
  RNA Oligomer
agucucaccauucugaugaaucu

SEQ ID NO: 62681 - RNA, 23 nt, Artificial Sequence
  RNA Oligomer
gagucucaccauucugaugaauc

SEQ ID NO: 62682 - RNA, 23 nt, Artificial Sequence
  RNA Oligomer
ucugaugagucucaccauucuga

SEQ ID NO: 62683 - RNA, 23 nt, Artificial Sequence
  RNA Oligomer
gucugaugagucucaccauucug

SEQ ID NO: 62684 - RNA, 23 nt, Artificial Sequence
  RNA Oligomer
agucugaugagucucaccauucu

SEQ ID NO: 62685 - RNA, 23 nt, Artificial Sequence
  RNA Oligomer
cagucugaugagucucaccauuc

SEQ ID NO: 62686 - RNA, 23 nt, Artificial Sequence
  RNA Oligomer
ccagucugaugagucucaccauu

SEQ ID NO: 62687 - RNA, 23 nt, Artificial Sequence
  RNA Oligomer
cuuuuuguggugugaauaaaucu

SEQ ID NO: 62688 - RNA, 23 nt, Artificial Sequence
  RNA Oligomer
ucuuuuuguggugugaauaaauc

SEQ ID NO: 62689 - RNA, 23 nt, Artificial Sequence
  RNA Oligomer
cacuuugcauuuagucaaaagaa

SEQ ID NO: 62690 - RNA, 23 nt, Artificial Sequence
  RNA Oligomer
gaauuagauagugcaucuucuga

SEQ ID NO: 62691 - RNA, 23 nt, Artificial Sequence
  RNA Oligomer
ugaauuagauagugcaucuucug

SEQ ID NO: 62692 - RNA, 23 nt, Artificial Sequence
  RNA Oligomer
augaauuagauagugcaucuucu

SEQ ID NO: 62693 - RNA, 23 nt, Artificial Sequence
  RNA Oligomer
caugaauuagauagugcaucuuc

SEQ ID NO: 62694 - RNA, 23 nt, Artificial Sequence
  RNA Oligomer
uauaagcggaaagccaaugauga

SEQ ID NO: 62695 - RNA, 23 nt, Artificial Sequence
  RNA Oligomer
auauaagcggaaagccaaugaug

SEQ ID NO: 62696 - RNA, 23 nt, Artificial Sequence
  RNA Oligomer
uauauaagcggaaagccaaugau

SEQ ID NO: 62697 - RNA, 23 nt, Artificial Sequence
  RNA Oligomer
ucagcuggaugaccagagugcug

SEQ ID NO: 62698 - RNA, 23 nt, Artificial Sequence
  RNA Oligomer
gucagcuggaugaccagagugcu

SEQ ID NO: 62699 - RNA, 23 nt, Artificial Sequence
  RNA Oligomer
agucagcuggaugaccagagugc

SEQ ID NO: 62700 - RNA, 23 nt, Artificial Sequence
  RNA Oligomer
gagucagcuggaugaccagagug

SEQ ID NO: 62701 - RNA, 23 nt, Artificial Sequence
  RNA Oligomer
cgagucagcuggaugaccagagu

SEQ ID NO: 62702 - RNA, 23 nt, Artificial Sequence
  RNA Oligomer
accagucugaugagucucaccau

SEQ ID NO: 62703 - RNA, 23 nt, Artificial Sequence
  RNA Oligomer
caccagucugaugagucucacca

SEQ ID NO: 62704 - RNA, 23 nt, Artificial Sequence
  RNA Oligomer
ucaccagucugaugagucucacc

SEQ ID NO: 62705 - RNA, 23 nt, Artificial Sequence
  RNA Oligomer
cucaccagucugaugagucucac

SEQ ID NO: 62706 - RNA, 23 nt, Artificial Sequence
  RNA Oligomer
aagccaugaccacauggaugaua

SEQ ID NO: 62707 - RNA, 23 nt, Artificial Sequence
  RNA Oligomer
aaagccaugaccacauggaugau

SEQ ID NO: 62708 - RNA, 23 nt, Artificial Sequence
  RNA Oligomer
gaaagccaugaccacauggauga

SEQ ID NO: 62709 - RNA, 23 nt, Artificial Sequence
  RNA Oligomer
ggcuucauggaaacucccuguaa

SEQ ID NO: 62710 - RNA, 23 nt, Artificial Sequence
  RNA Oligomer
uggcuucauggaaacucccugua

SEQ ID NO: 62711 - RNA, 23 nt, Artificial Sequence
  RNA Oligomer
ugaugagagcaaugagcauuccg

SEQ ID NO: 62712 - RNA, 23 nt, Artificial Sequence
  RNA Oligomer
augaugagagcaaugagcauucc

SEQ ID NO: 62713 - RNA, 23 nt, Artificial Sequence
  RNA Oligomer
aaugaugagagcaaugagcauuc

SEQ ID NO: 62714 - RNA, 23 nt, Artificial Sequence
  RNA Oligomer
caaugaugagagcaaugagcauu

SEQ ID NO: 62715 - RNA, 23 nt, Artificial Sequence
  RNA Oligomer
gaugaccagagugcugaaaccca

SEQ ID NO: 62716 - RNA, 23 nt, Artificial Sequence
  RNA Oligomer
ggaugaccagagugcugaaaccc

SEQ ID NO: 62717 - RNA, 23 nt, Artificial Sequence
  RNA Oligomer
uggaugaccagagugcugaaacc

SEQ ID NO: 62718 - RNA, 23 nt, Artificial Sequence
  RNA Oligomer
cuggaugaccagagugcugaaac

SEQ ID NO: 62719 - RNA, 23 nt, Artificial Sequence
  RNA Oligomer
gcuggaugaccagagugcugaaa

SEQ ID NO: 62720 - RNA, 23 nt, Artificial Sequence
  RNA Oligomer
guagacacauaugauggccgagg

SEQ ID NO: 62721 - RNA, 23 nt, Artificial Sequence
  RNA Oligomer
aguagacacauaugauggccgag

SEQ ID NO: 62722 - RNA, 23 nt, Artificial Sequence
  RNA Oligomer
caguagacacauaugauggccga

SEQ ID NO: 62723 - RNA, 23 nt, Artificial Sequence
  RNA Oligomer
guccaacgaaagccaugaccaca

SEQ ID NO: 62724 - RNA, 23 nt, Artificial Sequence
  RNA Oligomer
aguccaacgaaagccaugaccac

SEQ ID NO: 62725 - RNA, 23 nt, Artificial Sequence
  RNA Oligomer
aaguccaacgaaagccaugacca

SEQ ID NO: 62726 - RNA, 23 nt, Artificial Sequence
  RNA Oligomer
agcuggaugaccagagugcugaa

SEQ ID NO: 62727 - RNA, 23 nt, Artificial Sequence
  RNA Oligomer
ccucacacauggaaagcgaggag

SEQ ID NO: 62728 - RNA, 23 nt, Artificial Sequence
  RNA Oligomer
accucacacauggaaagcgagga

SEQ ID NO: 62729 - RNA, 23 nt, Artificial Sequence
  RNA Oligomer
caccucacacauggaaagcgagg

SEQ ID NO: 62730 - RNA, 23 nt, Artificial Sequence
  RNA Oligomer
ucaccucacacauggaaagcgag

SEQ ID NO: 62731 - RNA, 23 nt, Artificial Sequence
  RNA Oligomer
aucaccucacacauggaaagcga

SEQ ID NO: 62732 - RNA, 23 nt, Artificial Sequence
  RNA Oligomer
ccaguacccugaugcuacagacg

SEQ ID NO: 62733 - RNA, 23 nt, Artificial Sequence
  RNA Oligomer
uccaguacccugaugcuacagac

SEQ ID NO: 62734 - RNA, 23 nt, Artificial Sequence
  RNA Oligomer
auccaguacccugaugcuacaga

SEQ ID NO: 62735 - RNA, 23 nt, Artificial Sequence
  RNA Oligomer
cauccaguacccugaugcuacag

SEQ ID NO: 62736 - RNA, 23 nt, Artificial Sequence
  RNA Oligomer
acauccaguacccugaugcuaca

SEQ ID NO: 62737 - RNA, 23 nt, Artificial Sequence
  RNA Oligomer
uguccccacaguagacacauaug

SEQ ID NO: 62738 - RNA, 23 nt, Artificial Sequence
  RNA Oligomer
gaaguuuucacuccaguuguccc

SEQ ID NO: 62739 - RNA, 23 nt, Artificial Sequence
  RNA Oligomer
cagccaggacuccauugacucga

SEQ ID NO: 62740 - RNA, 23 nt, Artificial Sequence
  RNA Oligomer
aaacaggcugauucuggaaguuc

SEQ ID NO: 62741 - RNA, 23 nt, Artificial Sequence
  RNA Oligomer
uaaacaggcugauucuggaaguu

SEQ ID NO: 62742 - RNA, 23 nt, Artificial Sequence
  RNA Oligomer
gauuugcuuuugccuccuaggca

SEQ ID NO: 62743 - RNA, 23 nt, Artificial Sequence
  RNA Oligomer
ugauuugcuuuugccuccuaggc

SEQ ID NO: 62744 - RNA, 23 nt, Artificial Sequence
  RNA Oligomer
gugauuugcuuuugccuccuagg

SEQ ID NO: 62745 - RNA, 23 nt, Artificial Sequence
  RNA Oligomer
agugauuugcuuuugccuccuag

SEQ ID NO: 62746 - RNA, 23 nt, Artificial Sequence
  RNA Oligomer
cagugauuugcuuuugccuccua

SEQ ID NO: 62747 - RNA, 23 nt, Artificial Sequence
  RNA Oligomer
gaauuucacagccaugaagauau

SEQ ID NO: 62748 - RNA, 23 nt, Artificial Sequence
  RNA Oligomer
gaauuccacagccaugaauuuca

SEQ ID NO: 62749 - RNA, 23 nt, Artificial Sequence
  RNA Oligomer
ugaauuccacagccaugaauuuc

SEQ ID NO: 62750 - RNA, 23 nt, Artificial Sequence
  RNA Oligomer
gugaauuccacagccaugaauuu

SEQ ID NO: 62751 - RNA, 23 nt, Artificial Sequence
  RNA Oligomer
cgugaauuccacagccaugaauu

SEQ ID NO: 62752 - RNA, 23 nt, Artificial Sequence
  RNA Oligomer
ccgugaauuccacagccaugaau

SEQ ID NO: 62753 - RNA, 23 nt, Artificial Sequence
  RNA Oligomer
cucacacauggaaagcgaggagu

SEQ ID NO: 62754 - RNA, 23 nt, Artificial Sequence
  RNA Oligomer
ugaugauucucaccagucugaug

SEQ ID NO: 62755 - RNA, 23 nt, Artificial Sequence
  RNA Oligomer
cugaugauucucaccagucugau

SEQ ID NO: 62756 - RNA, 23 nt, Artificial Sequence
  RNA Oligomer
acugaugauucucaccagucuga

SEQ ID NO: 62757 - RNA, 23 nt, Artificial Sequence
  RNA Oligomer
cacugaugauucucaccagucug

SEQ ID NO: 62758 - RNA, 23 nt, Artificial Sequence
  RNA Oligomer
acacugaugauucucaccagucu

SEQ ID NO: 62759 - RNA, 23 nt, Artificial Sequence
  RNA Oligomer
gacacugaugauucucaccaguc

SEQ ID NO: 62760 - RNA, 23 nt, Artificial Sequence
  RNA Oligomer
ugacacugaugauucucaccagu

SEQ ID NO: 62761 - RNA, 23 nt, Artificial Sequence
  RNA Oligomer
augacacugaugauucucaccag

SEQ ID NO: 62762 - RNA, 23 nt, Artificial Sequence
  RNA Oligomer
gaugacacugaugauucucacca

SEQ ID NO: 62763 - RNA, 23 nt, Artificial Sequence
  RNA Oligomer
uaaguccaacgaaagccaugacc

SEQ ID NO: 62764 - RNA, 23 nt, Artificial Sequence
  RNA Oligomer
acuuuccaaagucagccgugaau

SEQ ID NO: 62765 - RNA, 23 nt, Artificial Sequence
  RNA Oligomer
agagugcugaaacccacagccac

SEQ ID NO: 62766 - RNA, 23 nt, Artificial Sequence
  RNA Oligomer
cagagugcugaaacccacagcca

SEQ ID NO: 62767 - RNA, 23 nt, Artificial Sequence
  RNA Oligomer
ccagagugcugaaacccacagcc

SEQ ID NO: 62768 - RNA, 23 nt, Artificial Sequence
  RNA Oligomer
accagagugcugaaacccacagc

SEQ ID NO: 62769 - RNA, 23 nt, Artificial Sequence
  RNA Oligomer
gaccagagugcugaaacccacag

SEQ ID NO: 62770 - RNA, 23 nt, Artificial Sequence
  RNA Oligomer
cucacuaccaugagaauugcagu

SEQ ID NO: 62771 - RNA, 23 nt, Artificial Sequence
  RNA Oligomer
acucacuaccaugagaauugcag

SEQ ID NO: 62772 - RNA, 23 nt, Artificial Sequence
  RNA Oligomer
aacucacuaccaugagaauugca

SEQ ID NO: 62773 - RNA, 23 nt, Artificial Sequence
  RNA Oligomer
aaacucacuaccaugagaauugc

SEQ ID NO: 62774 - RNA, 23 nt, Artificial Sequence
  RNA Oligomer
aaaacucacuaccaugagaauug

SEQ ID NO: 62775 - RNA, 23 nt, Artificial Sequence
  RNA Oligomer
ucucaccagucugaugagucuca

SEQ ID NO: 62776 - RNA, 23 nt, Artificial Sequence
  RNA Oligomer
uucucaccagucugaugagucuc

SEQ ID NO: 62777 - RNA, 23 nt, Artificial Sequence
  RNA Oligomer
auucucaccagucugaugagucu

SEQ ID NO: 62778 - RNA, 23 nt, Artificial Sequence
  RNA Oligomer
uuauuuguuuucccacgguuguc

SEQ ID NO: 62779 - RNA, 23 nt, Artificial Sequence
  RNA Oligomer
cuuauuuguuuucccacgguugu

SEQ ID NO: 62780 - RNA, 23 nt, Artificial Sequence
  RNA Oligomer
gcuuauuuguuuucccacgguug

SEQ ID NO: 62781 - RNA, 23 nt, Artificial Sequence
  RNA Oligomer
ugcuuauuuguuuucccacgguu

SEQ ID NO: 62782 - RNA, 23 nt, Artificial Sequence
  RNA Oligomer
uugcuuauuuguuuucccacggu

SEQ ID NO: 62783 - RNA, 23 nt, Artificial Sequence
  RNA Oligomer
gcagugauuugcuuuugccuccu

SEQ ID NO: 62784 - RNA, 23 nt, Artificial Sequence
  RNA Oligomer
ugcagugauuugcuuuugccucc

SEQ ID NO: 62785 - RNA, 23 nt, Artificial Sequence
  RNA Oligomer
uugcagugauuugcuuuugccuc

SEQ ID NO: 62786 - RNA, 23 nt, Artificial Sequence
  RNA Oligomer
auugcagugauuugcuuuugccu

SEQ ID NO: 62787 - RNA, 23 nt, Artificial Sequence
  RNA Oligomer
aauugcagugauuugcuuuugcc

SEQ ID NO: 62788 - RNA, 23 nt, Artificial Sequence
  RNA Oligomer
cugaaacccacagccacaagcag

SEQ ID NO: 62789 - RNA, 23 nt, Artificial Sequence
  RNA Oligomer
gcugaaacccacagccacaagca

SEQ ID NO: 62790 - RNA, 23 nt, Artificial Sequence
  RNA Oligomer
ugcugaaacccacagccacaagc

SEQ ID NO: 62791 - RNA, 23 nt, Artificial Sequence
  RNA Oligomer
gugcugaaacccacagccacaag

SEQ ID NO: 62792 - RNA, 23 nt, Artificial Sequence
  RNA Oligomer
agugcugaaacccacagccacaa

SEQ ID NO: 62793 - RNA, 23 nt, Artificial Sequence
  RNA Oligomer
guacccugaugcuacagacgagg

SEQ ID NO: 62794 - RNA, 23 nt, Artificial Sequence
  RNA Oligomer
aguacccugaugcuacagacgag

SEQ ID NO: 62795 - RNA, 23 nt, Artificial Sequence
  RNA Oligomer
caguacccugaugcuacagacga

SEQ ID NO: 62796 - RNA, 23 nt, Artificial Sequence
  RNA Oligomer
ugacauccaguacccugaugcua

SEQ ID NO: 62797 - RNA, 23 nt, Artificial Sequence
  RNA Oligomer
cugacauccaguacccugaugcu

SEQ ID NO: 62798 - RNA, 23 nt, Artificial Sequence
  RNA Oligomer
ccugacauccaguacccugaugc

SEQ ID NO: 62799 - RNA, 23 nt, Artificial Sequence
  RNA Oligomer
accugacauccaguacccugaug

SEQ ID NO: 62800 - RNA, 23 nt, Artificial Sequence
  RNA Oligomer
gaccugacauccaguacccugau

SEQ ID NO: 62801 - RNA, 23 nt, Artificial Sequence
  RNA Oligomer
ugauucucaccagucugaugagu

SEQ ID NO: 62802 - RNA, 23 nt, Artificial Sequence
  RNA Oligomer
augauucucaccagucugaugag

SEQ ID NO: 62803 - RNA, 23 nt, Artificial Sequence
  RNA Oligomer
gaugauucucaccagucugauga

SEQ ID NO: 62804 - RNA, 23 nt, Artificial Sequence
  RNA Oligomer
auugacucgaacgacucugauga

SEQ ID NO: 62805 - RNA, 23 nt, Artificial Sequence
  RNA Oligomer
cauugacucgaacgacucugaug

SEQ ID NO: 62806 - RNA, 23 nt, Artificial Sequence
  RNA Oligomer
ccauugacucgaacgacucugau

SEQ ID NO: 62807 - RNA, 23 nt, Artificial Sequence
  RNA Oligomer
uuaaacaggcugauucuggaagu

SEQ ID NO: 62808 - RNA, 23 nt, Artificial Sequence
  RNA Oligomer
ccacagccaugaauuucacagcc

SEQ ID NO: 62809 - RNA, 23 nt, Artificial Sequence
  RNA Oligomer
uccacagccaugaauuucacagc

SEQ ID NO: 62810 - RNA, 23 nt, Artificial Sequence
  RNA Oligomer
uuccacagccaugaauuucacag

SEQ ID NO: 62811 - RNA, 23 nt, Artificial Sequence
  RNA Oligomer
gccgugaauuccacagccaugaa

SEQ ID NO: 62812 - RNA, 23 nt, Artificial Sequence
  RNA Oligomer
gacauccaguacccugaugcuac

SEQ ID NO: 62813 - RNA, 23 nt, Artificial Sequence
  RNA Oligomer
ucacugauuuucccacggaccug

SEQ ID NO: 62814 - RNA, 23 nt, Artificial Sequence
  RNA Oligomer
gucacugauuuucccacggaccu

SEQ ID NO: 62815 - RNA, 23 nt, Artificial Sequence
  RNA Oligomer
ggucacugauuuucccacggacc

SEQ ID NO: 62816 - RNA, 23 nt, Artificial Sequence
  RNA Oligomer
uggucacugauuuucccacggac

SEQ ID NO: 62817 - RNA, 23 nt, Artificial Sequence
  RNA Oligomer
cuggucacugauuuucccacgga

SEQ ID NO: 62818 - RNA, 23 nt, Artificial Sequence
  RNA Oligomer
uccauugacucgaacgacucuga

SEQ ID NO: 62819 - RNA, 23 nt, Artificial Sequence
  RNA Oligomer
cuccauugacucgaacgacucug

SEQ ID NO: 62820 - RNA, 23 nt, Artificial Sequence
  RNA Oligomer
acuccauugacucgaacgacucu

SEQ ID NO: 62821 - RNA, 23 nt, Artificial Sequence
  RNA Oligomer
gacuccauugacucgaacgacuc

SEQ ID NO: 62822 - RNA, 23 nt, Artificial Sequence
  RNA Oligomer
guuauucucucaugaauagaaau

SEQ ID NO: 62823 - RNA, 23 nt, Artificial Sequence
  RNA Oligomer
uguuauucucucaugaauagaaa

SEQ ID NO: 62824 - RNA, 23 nt, Artificial Sequence
  RNA Oligomer
uuguuauucucucaugaauagaa

SEQ ID NO: 62825 - RNA, 23 nt, Artificial Sequence
  RNA Oligomer
uuuguuauucucucaugaauaga

SEQ ID NO: 62826 - RNA, 23 nt, Artificial Sequence
  RNA Oligomer
auuuguuauucucucaugaauag

SEQ ID NO: 62827 - RNA, 23 nt, Artificial Sequence
  RNA Oligomer
gcuuuugccuccuaggcaucacc

SEQ ID NO: 62828 - RNA, 23 nt, Artificial Sequence
  RNA Oligomer
ugcuuuugccuccuaggcaucac

SEQ ID NO: 62829 - RNA, 23 nt, Artificial Sequence
  RNA Oligomer
uugcuuuugccuccuaggcauca

SEQ ID NO: 62830 - RNA, 23 nt, Artificial Sequence
  RNA Oligomer
uuugcuuuugccuccuaggcauc

SEQ ID NO: 62831 - RNA, 23 nt, Artificial Sequence
  RNA Oligomer
auuugcuuuugccuccuaggcau

SEQ ID NO: 62832 - RNA, 23 nt, Artificial Sequence
  RNA Oligomer
cuuugcauuuagucaaaagaaaa

SEQ ID NO: 62833 - RNA, 23 nt, Artificial Sequence
  RNA Oligomer
acuuugcauuuagucaaaagaaa

SEQ ID NO: 62834 - RNA, 23 nt, Artificial Sequence
  RNA Oligomer
agccgugaauuccacagccauga

SEQ ID NO: 62835 - RNA, 23 nt, Artificial Sequence
  RNA Oligomer
cagccgugaauuccacagccaug

SEQ ID NO: 62836 - RNA, 23 nt, Artificial Sequence
  RNA Oligomer
ucagccgugaauuccacagccau

SEQ ID NO: 62837 - RNA, 23 nt, Artificial Sequence
  RNA Oligomer
cagccgugggaaggacaguuaug

SEQ ID NO: 62838 - RNA, 23 nt, Artificial Sequence
  RNA Oligomer
acagccgugggaaggacaguuau

SEQ ID NO: 62839 - RNA, 23 nt, Artificial Sequence
  RNA Oligomer
guggcuucauggaaacucccugu

SEQ ID NO: 62840 - RNA, 23 nt, Artificial Sequence
  RNA Oligomer
uguggcuucauggaaacucccug

SEQ ID NO: 62841 - RNA, 23 nt, Artificial Sequence
  RNA Oligomer
uuguggcuucauggaaacucccu

SEQ ID NO: 62842 - RNA, 23 nt, Artificial Sequence
  RNA Oligomer
aggaugucugcagcagcauuuaa

SEQ ID NO: 62843 - RNA, 23 nt, Artificial Sequence
  RNA Oligomer
gaggaugucugcagcagcauuua

SEQ ID NO: 62844 - RNA, 23 nt, Artificial Sequence
  RNA Oligomer
ggaggaugucugcagcagcauuu

SEQ ID NO: 62845 - RNA, 23 nt, Artificial Sequence
  RNA Oligomer
uggaggaugucugcagcagcauu

SEQ ID NO: 62846 - RNA, 23 nt, Artificial Sequence
  RNA Oligomer
cacugauuuucccacggaccugc

SEQ ID NO: 62847 - RNA, 23 nt, Artificial Sequence
  RNA Oligomer
ugcagccuucucagccaaacgcc

SEQ ID NO: 62848 - RNA, 23 nt, Artificial Sequence
  RNA Oligomer
uugcagccuucucagccaaacgc

SEQ ID NO: 62849 - RNA, 23 nt, Artificial Sequence
  RNA Oligomer
guugcagccuucucagccaaacg

SEQ ID NO: 62850 - RNA, 23 nt, Artificial Sequence
  RNA Oligomer
aguugcagccuucucagccaaac

SEQ ID NO: 62851 - RNA, 23 nt, Artificial Sequence
  RNA Oligomer
caguugcagccuucucagccaaa

SEQ ID NO: 62852 - RNA, 23 nt, Artificial Sequence
  RNA Oligomer
auugcuuauuuguuuucccacgg

SEQ ID NO: 62853 - RNA, 23 nt, Artificial Sequence
  RNA Oligomer
aauugcuuauuuguuuucccacg

SEQ ID NO: 62854 - RNA, 23 nt, Artificial Sequence
  RNA Oligomer
gaaaacucacuaccaugagaauu

SEQ ID NO: 62855 - RNA, 23 nt, Artificial Sequence
  RNA Oligomer
ugaauuucacagccaugaagaua

SEQ ID NO: 62856 - RNA, 23 nt, Artificial Sequence
  RNA Oligomer
augaauuucacagccaugaagau

SEQ ID NO: 62857 - RNA, 23 nt, Artificial Sequence
  RNA Oligomer
caugaauuucacagccaugaaga

SEQ ID NO: 62858 - RNA, 23 nt, Artificial Sequence
  RNA Oligomer
gguuuauggacugaggucaaaau

SEQ ID NO: 62859 - RNA, 23 nt, Artificial Sequence
  RNA Oligomer
ugguuuauggacugaggucaaaa

SEQ ID NO: 62860 - RNA, 23 nt, Artificial Sequence
  RNA Oligomer
gugguuuauggacugaggucaaa

SEQ ID NO: 62861 - RNA, 23 nt, Artificial Sequence
  RNA Oligomer
ugugguuuauggacugaggucaa

SEQ ID NO: 62862 - RNA, 23 nt, Artificial Sequence
  RNA Oligomer
acaugaaaugcuucuuucucagu

SEQ ID NO: 62863 - RNA, 23 nt, Artificial Sequence
  RNA Oligomer
aacaugaaaugcuucuuucucag

SEQ ID NO: 62864 - RNA, 23 nt, Artificial Sequence
  RNA Oligomer
auuccacagccaugaauuucaca

SEQ ID NO: 62865 - RNA, 23 nt, Artificial Sequence
  RNA Oligomer
aauuccacagccaugaauuucac

SEQ ID NO: 62866 - RNA, 23 nt, Artificial Sequence
  RNA Oligomer
ccacagccacaagcaguccagau

SEQ ID NO: 62867 - RNA, 23 nt, Artificial Sequence
  RNA Oligomer
caaaaucuaagaaguuucgcaga

SEQ ID NO: 62868 - RNA, 23 nt, Artificial Sequence
  RNA Oligomer
ucaaaaucuaagaaguuucgcag

SEQ ID NO: 62869 - RNA, 23 nt, Artificial Sequence
  RNA Oligomer
gucaaaaucuaagaaguuucgca

SEQ ID NO: 62870 - RNA, 23 nt, Artificial Sequence
  RNA Oligomer
aggcaucaccugugccauaccag

SEQ ID NO: 62871 - RNA, 23 nt, Artificial Sequence
  RNA Oligomer
uaggcaucaccugugccauacca

SEQ ID NO: 62872 - RNA, 23 nt, Artificial Sequence
  RNA Oligomer
cuaggcaucaccugugccauacc

SEQ ID NO: 62873 - RNA, 23 nt, Artificial Sequence
  RNA Oligomer
ccuaggcaucaccugugccauac

SEQ ID NO: 62874 - RNA, 23 nt, Artificial Sequence
  RNA Oligomer
uccuaggcaucaccugugccaua

SEQ ID NO: 62875 - RNA, 23 nt, Artificial Sequence
  RNA Oligomer
agauagugcaucuucugagguca

SEQ ID NO: 62876 - RNA, 23 nt, Artificial Sequence
  RNA Oligomer
uagauagugcaucuucugagguc

SEQ ID NO: 62877 - RNA, 23 nt, Artificial Sequence
  RNA Oligomer
uuagauagugcaucuucugaggu

SEQ ID NO: 62878 - RNA, 23 nt, Artificial Sequence
  RNA Oligomer
auuagauagugcaucuucugagg

SEQ ID NO: 62879 - RNA, 23 nt, Artificial Sequence
  RNA Oligomer
aauuagauagugcaucuucugag

SEQ ID NO: 62880 - RNA, 23 nt, Artificial Sequence
  RNA Oligomer
gugccauaccaguuaaacaggcu

SEQ ID NO: 62881 - RNA, 23 nt, Artificial Sequence
  RNA Oligomer
ugugccauaccaguuaaacaggc

SEQ ID NO: 62882 - RNA, 23 nt, Artificial Sequence
  RNA Oligomer
cugugccauaccaguuaaacagg

SEQ ID NO: 62883 - RNA, 23 nt, Artificial Sequence
  RNA Oligomer
ccugugccauaccaguuaaacag

SEQ ID NO: 62884 - RNA, 23 nt, Artificial Sequence
  RNA Oligomer
accugugccauaccaguuaaaca

SEQ ID NO: 62885 - RNA, 23 nt, Artificial Sequence
  RNA Oligomer
ccagcaauuaauaaaacauaacc

SEQ ID NO: 62886 - RNA, 23 nt, Artificial Sequence
  RNA Oligomer
agaaguuucgcagaccugacauc

SEQ ID NO: 62887 - RNA, 23 nt, Artificial Sequence
  RNA Oligomer
gugucaauugcuuauuuguuuuc

SEQ ID NO: 62888 - RNA, 23 nt, Artificial Sequence
  RNA Oligomer
uaauaagaauuugguggugucaa

SEQ ID NO: 62889 - RNA, 23 nt, Artificial Sequence
  RNA Oligomer
ucaauugcuuauuuguuuuccca

SEQ ID NO: 62890 - RNA, 23 nt, Artificial Sequence
  RNA Oligomer
caauugcuuauuuguuuucccac

SEQ ID NO: 62891 - RNA, 23 nt, Artificial Sequence
  RNA Oligomer
ugauaauuaguuuaguuuguggc

SEQ ID NO: 62892 - RNA, 23 nt, Artificial Sequence
  RNA Oligomer
ugauagugugguuuauggacuga

SEQ ID NO: 62893 - RNA, 23 nt, Artificial Sequence
  RNA Oligomer
aguuuaguuuguggcuucaugga

SEQ ID NO: 62894 - RNA, 23 nt, Artificial Sequence
  RNA Oligomer
uguaaacuaaaagcuucaggguu

SEQ ID NO: 62895 - RNA, 23 nt, Artificial Sequence
  RNA Oligomer
gcuuuauagcaaaaugaaagaga

SEQ ID NO: 62896 - RNA, 23 nt, Artificial Sequence
  RNA Oligomer
ugcuuuauagcaaaaugaaagag

SEQ ID NO: 62897 - RNA, 23 nt, Artificial Sequence
  RNA Oligomer
gcaucaccugugccauaccaguu

SEQ ID NO: 62898 - RNA, 23 nt, Artificial Sequence
  RNA Oligomer
cugaaauuucguauuucucauga

SEQ ID NO: 62899 - RNA, 23 nt, Artificial Sequence
  RNA Oligomer
ugucuauguucauucuauagaag

SEQ ID NO: 62900 - RNA, 23 nt, Artificial Sequence
  RNA Oligomer
ucacuaccaugagaauugcagug

SEQ ID NO: 62901 - RNA, 23 nt, Artificial Sequence
  RNA Oligomer
ugaauggugcauacaaggccauc

SEQ ID NO: 62902 - RNA, 23 nt, Artificial Sequence
  RNA Oligomer
uugaauggugcauacaaggccau

SEQ ID NO: 62903 - RNA, 23 nt, Artificial Sequence
  RNA Oligomer
gucuauguucauucuauagaaga

SEQ ID NO: 62904 - RNA, 23 nt, Artificial Sequence
  RNA Oligomer
ggagaaaaaauacaauuucucac

SEQ ID NO: 62905 - RNA, 23 nt, Artificial Sequence
  RNA Oligomer
agcaaacaaaauacuuuuaccca

SEQ ID NO: 62906 - RNA, 23 nt, Artificial Sequence
  RNA Oligomer
cguauuucucaugaauuagauag

SEQ ID NO: 62907 - RNA, 23 nt, Artificial Sequence
  RNA Oligomer
ggaacuuuccaaagucagccgug

SEQ ID NO: 62908 - RNA, 23 nt, Artificial Sequence
  RNA Oligomer
aggaacuuuccaaagucagccgu

SEQ ID NO: 62909 - RNA, 23 nt, Artificial Sequence
  RNA Oligomer
gaacuuuccaaagucagccguga

SEQ ID NO: 62910 - RNA, 23 nt, Artificial Sequence
  RNA Oligomer
uuucauguucucuuucauuuugc

SEQ ID NO: 62911 - RNA, 23 nt, Artificial Sequence
  RNA Oligomer
uucauguucucuuucauuuugcu

SEQ ID NO: 62912 - RNA, 23 nt, Artificial Sequence
  RNA Oligomer
ucauguucucuuucauuuugcua

SEQ ID NO: 62913 - RNA, 23 nt, Artificial Sequence
  RNA Oligomer
cauguucucuuucauuuugcuau

SEQ ID NO: 62914 - RNA, 23 nt, Artificial Sequence
  RNA Oligomer
auguucucuuucauuuugcuaua

SEQ ID NO: 62915 - RNA, 23 nt, Artificial Sequence
  RNA Oligomer
uggcuuucguuggacuuacuugg

SEQ ID NO: 62916 - RNA, 23 nt, Artificial Sequence
  RNA Oligomer
ggcuuucguuggacuuacuugga

SEQ ID NO: 62917 - RNA, 23 nt, Artificial Sequence
  RNA Oligomer
gcuuucguuggacuuacuuggaa

SEQ ID NO: 62918 - RNA, 23 nt, Artificial Sequence
  RNA Oligomer
cuuucguuggacuuacuuggaag

SEQ ID NO: 62919 - RNA, 23 nt, Artificial Sequence
  RNA Oligomer
uuucguuggacuuacuuggaagg

SEQ ID NO: 62920 - RNA, 23 nt, Artificial Sequence
  RNA Oligomer
auuaaaauacagugauaguuugc

SEQ ID NO: 62921 - RNA, 23 nt, Artificial Sequence
  RNA Oligomer
uuaaaauacagugauaguuugca

SEQ ID NO: 62922 - RNA, 23 nt, Artificial Sequence
  RNA Oligomer
uaaaauacagugauaguuugcau

SEQ ID NO: 62923 - RNA, 23 nt, Artificial Sequence
  RNA Oligomer
aaaauacagugauaguuugcauu

SEQ ID NO: 62924 - RNA, 23 nt, Artificial Sequence
  RNA Oligomer
aaauacagugauaguuugcauuu

SEQ ID NO: 62925 - RNA, 23 nt, Artificial Sequence
  RNA Oligomer
agacauaacccugaagcuuuuag

SEQ ID NO: 62926 - RNA, 23 nt, Artificial Sequence
  RNA Oligomer
gacauaacccugaagcuuuuagu

SEQ ID NO: 62927 - RNA, 23 nt, Artificial Sequence
  RNA Oligomer
acauaacccugaagcuuuuaguu

SEQ ID NO: 62928 - RNA, 23 nt, Artificial Sequence
  RNA Oligomer
cauaacccugaagcuuuuaguuu

SEQ ID NO: 62929 - RNA, 23 nt, Artificial Sequence
  RNA Oligomer
auaacccugaagcuuuuaguuua

SEQ ID NO: 62930 - RNA, 23 nt, Artificial Sequence
  RNA Oligomer
gaaauuucagguguuuaucuucu

SEQ ID NO: 62931 - RNA, 23 nt, Artificial Sequence
  RNA Oligomer
aaauuucagguguuuaucuucuu

SEQ ID NO: 62932 - RNA, 23 nt, Artificial Sequence
  RNA Oligomer
aauuucagguguuuaucuucuuc

SEQ ID NO: 62933 - RNA, 23 nt, Artificial Sequence
  RNA Oligomer
auuucagguguuuaucuucuucc

SEQ ID NO: 62934 - RNA, 23 nt, Artificial Sequence
  RNA Oligomer
uuucagguguuuaucuucuuccu

SEQ ID NO: 62935 - RNA, 23 nt, Artificial Sequence
  RNA Oligomer
ugagaaauacgaaauuucaggug

SEQ ID NO: 62936 - RNA, 23 nt, Artificial Sequence
  RNA Oligomer
gagaaauacgaaauuucaggugu

SEQ ID NO: 62937 - RNA, 23 nt, Artificial Sequence
  RNA Oligomer
agaaauacgaaauuucagguguu

SEQ ID NO: 62938 - RNA, 23 nt, Artificial Sequence
  RNA Oligomer
gaaauacgaaauuucagguguuu

SEQ ID NO: 62939 - RNA, 23 nt, Artificial Sequence
  RNA Oligomer
aaauacgaaauuucagguguuua

SEQ ID NO: 62940 - RNA, 23 nt, Artificial Sequence
  RNA Oligomer
aauacgaaauuucagguguuuau

SEQ ID NO: 62941 - RNA, 23 nt, Artificial Sequence
  RNA Oligomer
ugucaucuacaucaucagagucg

SEQ ID NO: 62942 - RNA, 23 nt, Artificial Sequence
  RNA Oligomer
gucaucuacaucaucagagucgu

SEQ ID NO: 62943 - RNA, 23 nt, Artificial Sequence
  RNA Oligomer
ucaucuacaucaucagagucguu

SEQ ID NO: 62944 - RNA, 23 nt, Artificial Sequence
  RNA Oligomer
caucuacaucaucagagucguuc

SEQ ID NO: 62945 - RNA, 23 nt, Artificial Sequence
  RNA Oligomer
aucuacaucaucagagucguucg

SEQ ID NO: 62946 - RNA, 23 nt, Artificial Sequence
  RNA Oligomer
uuauguuuuauuaauugcuggac

SEQ ID NO: 62947 - RNA, 23 nt, Artificial Sequence
  RNA Oligomer
uauguuuuauuaauugcuggaca

SEQ ID NO: 62948 - RNA, 23 nt, Artificial Sequence
  RNA Oligomer
auguuuuauuaauugcuggacaa

SEQ ID NO: 62949 - RNA, 23 nt, Artificial Sequence
  RNA Oligomer
uguuuuauuaauugcuggacaac

SEQ ID NO: 62950 - RNA, 23 nt, Artificial Sequence
  RNA Oligomer
guuuuauuaauugcuggacaacc

SEQ ID NO: 62951 - RNA, 23 nt, Artificial Sequence
  RNA Oligomer
aaacaaauaagcaauugacacca

SEQ ID NO: 62952 - RNA, 23 nt, Artificial Sequence
  RNA Oligomer
aacaaauaagcaauugacaccac

SEQ ID NO: 62953 - RNA, 23 nt, Artificial Sequence
  RNA Oligomer
acaaauaagcaauugacaccacc

SEQ ID NO: 62954 - RNA, 23 nt, Artificial Sequence
  RNA Oligomer
caaauaagcaauugacaccacca

SEQ ID NO: 62955 - RNA, 23 nt, Artificial Sequence
  RNA Oligomer
aaauaagcaauugacaccaccaa

SEQ ID NO: 62956 - RNA, 23 nt, Artificial Sequence
  RNA Oligomer
uaacccugaagcuuuuaguuuac

SEQ ID NO: 62957 - RNA, 23 nt, Artificial Sequence
  RNA Oligomer
gcuuuuaguuuacagggaguuuc

SEQ ID NO: 62958 - RNA, 23 nt, Artificial Sequence
  RNA Oligomer
cuuuuaguuuacagggaguuucc

SEQ ID NO: 62959 - RNA, 23 nt, Artificial Sequence
  RNA Oligomer
uuuuaguuuacagggaguuucca

SEQ ID NO: 62960 - RNA, 23 nt, Artificial Sequence
  RNA Oligomer
uuuaguuuacagggaguuuccau

SEQ ID NO: 62961 - RNA, 23 nt, Artificial Sequence
  RNA Oligomer
uuaguuuacagggaguuuccaug

SEQ ID NO: 62962 - RNA, 23 nt, Artificial Sequence
  RNA Oligomer
uaguuuacagggaguuuccauga

SEQ ID NO: 62963 - RNA, 23 nt, Artificial Sequence
  RNA Oligomer
cucaaauagauacacauucaacc

SEQ ID NO: 62964 - RNA, 23 nt, Artificial Sequence
  RNA Oligomer
ucaaauagauacacauucaacca

SEQ ID NO: 62965 - RNA, 23 nt, Artificial Sequence
  RNA Oligomer
caaauagauacacauucaaccaa

SEQ ID NO: 62966 - RNA, 23 nt, Artificial Sequence
  RNA Oligomer
aaauagauacacauucaaccaau

SEQ ID NO: 62967 - RNA, 23 nt, Artificial Sequence
  RNA Oligomer
aauagauacacauucaaccaaua

SEQ ID NO: 62968 - RNA, 23 nt, Artificial Sequence
  RNA Oligomer
cgaaauuucagguguuuaucuuc

SEQ ID NO: 62969 - RNA, 23 nt, Artificial Sequence
  RNA Oligomer
uucagguguuuaucuucuuccuu

SEQ ID NO: 62970 - RNA, 23 nt, Artificial Sequence
  RNA Oligomer
ucagguguuuaucuucuuccuua

SEQ ID NO: 62971 - RNA, 23 nt, Artificial Sequence
  RNA Oligomer
cagguguuuaucuucuuccuuac

SEQ ID NO: 62972 - RNA, 23 nt, Artificial Sequence
  RNA Oligomer
uuuaucuucuuccuuacuuuugg

SEQ ID NO: 62973 - RNA, 23 nt, Artificial Sequence
  RNA Oligomer
uuaucuucuuccuuacuuuuggg

SEQ ID NO: 62974 - RNA, 23 nt, Artificial Sequence
  RNA Oligomer
uaucuucuuccuuacuuuugggg

SEQ ID NO: 62975 - RNA, 23 nt, Artificial Sequence
  RNA Oligomer
aucuucuuccuuacuuuuggggu

SEQ ID NO: 62976 - RNA, 23 nt, Artificial Sequence
  RNA Oligomer
ucuucuuccuuacuuuugggguc

SEQ ID NO: 62977 - RNA, 23 nt, Artificial Sequence
  RNA Oligomer
augcucauugcucucaucauugg

SEQ ID NO: 62978 - RNA, 23 nt, Artificial Sequence
  RNA Oligomer
ugcucauugcucucaucauuggc

SEQ ID NO: 62979 - RNA, 23 nt, Artificial Sequence
  RNA Oligomer
gcucauugcucucaucauuggcu

SEQ ID NO: 62980 - RNA, 23 nt, Artificial Sequence
  RNA Oligomer
cucauugcucucaucauuggcuu

SEQ ID NO: 62981 - RNA, 23 nt, Artificial Sequence
  RNA Oligomer
ucauugcucucaucauuggcuuu

SEQ ID NO: 62982 - RNA, 23 nt, Artificial Sequence
  RNA Oligomer
aaucaucagugucaucuacauca

SEQ ID NO: 62983 - RNA, 23 nt, Artificial Sequence
  RNA Oligomer
aucaucagugucaucuacaucau

SEQ ID NO: 62984 - RNA, 23 nt, Artificial Sequence
  RNA Oligomer
ucaucagugucaucuacaucauc

SEQ ID NO: 62985 - RNA, 23 nt, Artificial Sequence
  RNA Oligomer
caucagugucaucuacaucauca

SEQ ID NO: 62986 - RNA, 23 nt, Artificial Sequence
  RNA Oligomer
aucagugucaucuacaucaucag

SEQ ID NO: 62987 - RNA, 23 nt, Artificial Sequence
  RNA Oligomer
agcaauugacaccaccaaauucu

SEQ ID NO: 62988 - RNA, 23 nt, Artificial Sequence
  RNA Oligomer
gcaauugacaccaccaaauucuu

SEQ ID NO: 62989 - RNA, 23 nt, Artificial Sequence
  RNA Oligomer
caauugacaccaccaaauucuua

SEQ ID NO: 62990 - RNA, 23 nt, Artificial Sequence
  RNA Oligomer
aauugacaccaccaaauucuuau

SEQ ID NO: 62991 - RNA, 23 nt, Artificial Sequence
  RNA Oligomer
auugacaccaccaaauucuuauu

SEQ ID NO: 62992 - RNA, 23 nt, Artificial Sequence
  RNA Oligomer
cugaagcuuuuaguuuacaggga

SEQ ID NO: 62993 - RNA, 23 nt, Artificial Sequence
  RNA Oligomer
ugaagcuuuuaguuuacagggag

SEQ ID NO: 62994 - RNA, 23 nt, Artificial Sequence
  RNA Oligomer
gaagcuuuuaguuuacagggagu

SEQ ID NO: 62995 - RNA, 23 nt, Artificial Sequence
  RNA Oligomer
aagcuuuuaguuuacagggaguu

SEQ ID NO: 62996 - RNA, 23 nt, Artificial Sequence
  RNA Oligomer
agcuuuuaguuuacagggaguuu

SEQ ID NO: 62997 - RNA, 23 nt, Artificial Sequence
  RNA Oligomer
gacuaucaaucacaucggaaugc

SEQ ID NO: 62998 - RNA, 23 nt, Artificial Sequence
  RNA Oligomer
acuaucaaucacaucggaaugcu

SEQ ID NO: 62999 - RNA, 23 nt, Artificial Sequence
  RNA Oligomer
cuaucaaucacaucggaaugcuc

SEQ ID NO: 63000 - RNA, 23 nt, Artificial Sequence
  RNA Oligomer
uaucaaucacaucggaaugcuca

SEQ ID NO: 63001 - RNA, 23 nt, Artificial Sequence
  RNA Oligomer
aucaaucacaucggaaugcucau

SEQ ID NO: 63002 - RNA, 23 nt, Artificial Sequence
  RNA Oligomer
ggcuuuccgcuuauauaaucugg

SEQ ID NO: 63003 - RNA, 23 nt, Artificial Sequence
  RNA Oligomer
gcuuuccgcuuauauaaucugga

SEQ ID NO: 63004 - RNA, 23 nt, Artificial Sequence
  RNA Oligomer
cuuuccgcuuauauaaucuggac

SEQ ID NO: 63005 - RNA, 23 nt, Artificial Sequence
  RNA Oligomer
uuuccgcuuauauaaucuggacu

SEQ ID NO: 63006 - RNA, 23 nt, Artificial Sequence
  RNA Oligomer
uuccgcuuauauaaucuggacug

SEQ ID NO: 63007 - RNA, 23 nt, Artificial Sequence
  RNA Oligomer
gcaaaucacugcaauucucaugg

SEQ ID NO: 63008 - RNA, 23 nt, Artificial Sequence
  RNA Oligomer
caaaucacugcaauucucauggu

SEQ ID NO: 63009 - RNA, 23 nt, Artificial Sequence
  RNA Oligomer
aaaucacugcaauucucauggua

SEQ ID NO: 63010 - RNA, 23 nt, Artificial Sequence
  RNA Oligomer
aaucacugcaauucucaugguag

SEQ ID NO: 63011 - RNA, 23 nt, Artificial Sequence
  RNA Oligomer
aucacugcaauucucaugguagu

SEQ ID NO: 63012 - RNA, 23 nt, Artificial Sequence
  RNA Oligomer
ugaccaguucaucagauucauca

SEQ ID NO: 63013 - RNA, 23 nt, Artificial Sequence
  RNA Oligomer
gaccaguucaucagauucaucag

SEQ ID NO: 63014 - RNA, 23 nt, Artificial Sequence
  RNA Oligomer
accaguucaucagauucaucaga

SEQ ID NO: 63015 - RNA, 23 nt, Artificial Sequence
  RNA Oligomer
ccaguucaucagauucaucagaa

SEQ ID NO: 63016 - RNA, 23 nt, Artificial Sequence
  RNA Oligomer
caguucaucagauucaucagaau

SEQ ID NO: 63017 - RNA, 23 nt, Artificial Sequence
  RNA Oligomer
caucuucaucauccauaucaucc

SEQ ID NO: 63018 - RNA, 23 nt, Artificial Sequence
  RNA Oligomer
aucuucaucauccauaucaucca

SEQ ID NO: 63019 - RNA, 23 nt, Artificial Sequence
  RNA Oligomer
ucuucaucauccauaucauccau

SEQ ID NO: 63020 - RNA, 23 nt, Artificial Sequence
  RNA Oligomer
cuucaucauccauaucauccaug

SEQ ID NO: 63021 - RNA, 23 nt, Artificial Sequence
  RNA Oligomer
uucaucauccauaucauccaugu

SEQ ID NO: 63022 - RNA, 23 nt, Artificial Sequence
  RNA Oligomer
ucccagaauuuaaaugcugcugc

SEQ ID NO: 63023 - RNA, 23 nt, Artificial Sequence
  RNA Oligomer
cccagaauuuaaaugcugcugca

SEQ ID NO: 63024 - RNA, 23 nt, Artificial Sequence
  RNA Oligomer
ccagaauuuaaaugcugcugcag

SEQ ID NO: 63025 - RNA, 23 nt, Artificial Sequence
  RNA Oligomer
cagaauuuaaaugcugcugcaga

SEQ ID NO: 63026 - RNA, 23 nt, Artificial Sequence
  RNA Oligomer
agaauuuaaaugcugcugcagac

SEQ ID NO: 63027 - RNA, 23 nt, Artificial Sequence
  RNA Oligomer
cagccuguuuaacugguauggca

SEQ ID NO: 63028 - RNA, 23 nt, Artificial Sequence
  RNA Oligomer
agccuguuuaacugguauggcac

SEQ ID NO: 63029 - RNA, 23 nt, Artificial Sequence
  RNA Oligomer
gccuguuuaacugguauggcaca

SEQ ID NO: 63030 - RNA, 23 nt, Artificial Sequence
  RNA Oligomer
ccuguuuaacugguauggcacag

SEQ ID NO: 63031 - RNA, 23 nt, Artificial Sequence
  RNA Oligomer
cuguuuaacugguauggcacagg

SEQ ID NO: 63032 - RNA, 23 nt, Artificial Sequence
  RNA Oligomer
aaugaacauagacauaacccuga

SEQ ID NO: 63033 - RNA, 23 nt, Artificial Sequence
  RNA Oligomer
augaacauagacauaacccugaa

SEQ ID NO: 63034 - RNA, 23 nt, Artificial Sequence
  RNA Oligomer
ugaacauagacauaacccugaag

SEQ ID NO: 63035 - RNA, 23 nt, Artificial Sequence
  RNA Oligomer
gaacauagacauaacccugaagc

SEQ ID NO: 63036 - RNA, 23 nt, Artificial Sequence
  RNA Oligomer
aacauagacauaacccugaagcu

SEQ ID NO: 63037 - RNA, 23 nt, Artificial Sequence
  RNA Oligomer
acauagacauaacccugaagcuu

SEQ ID NO: 63038 - RNA, 23 nt, Artificial Sequence
  RNA Oligomer
cauagacauaacccugaagcuuu

SEQ ID NO: 63039 - RNA, 23 nt, Artificial Sequence
  RNA Oligomer
auagacauaacccugaagcuuuu

SEQ ID NO: 63040 - RNA, 23 nt, Artificial Sequence
  RNA Oligomer
gcgaaacuucuuagauuuugacc

SEQ ID NO: 63041 - RNA, 23 nt, Artificial Sequence
  RNA Oligomer
cgaaacuucuuagauuuugaccu

SEQ ID NO: 63042 - RNA, 23 nt, Artificial Sequence
  RNA Oligomer
gaaacuucuuagauuuugaccuc

SEQ ID NO: 63043 - RNA, 23 nt, Artificial Sequence
  RNA Oligomer
aaacuucuuagauuuugaccuca

SEQ ID NO: 63044 - RNA, 23 nt, Artificial Sequence
  RNA Oligomer
aacuucuuagauuuugaccucag

SEQ ID NO: 63045 - RNA, 23 nt, Artificial Sequence
  RNA Oligomer
cagugaccaguucaucagauuca

SEQ ID NO: 63046 - RNA, 23 nt, Artificial Sequence
  RNA Oligomer
agugaccaguucaucagauucau

SEQ ID NO: 63047 - RNA, 23 nt, Artificial Sequence
  RNA Oligomer
gugaccaguucaucagauucauc

SEQ ID NO: 63048 - RNA, 23 nt, Artificial Sequence
  RNA Oligomer
aauaagcaauugacaccaccaaa

SEQ ID NO: 63049 - RNA, 23 nt, Artificial Sequence
  RNA Oligomer
guuauauucucuuuuuaaguggg

SEQ ID NO: 63050 - RNA, 23 nt, Artificial Sequence
  RNA Oligomer
uuauauucucuuuuuaagugggu

SEQ ID NO: 63051 - RNA, 23 nt, Artificial Sequence
  RNA Oligomer
uauauucucuuuuuaagugggua

SEQ ID NO: 63052 - RNA, 23 nt, Artificial Sequence
  RNA Oligomer
auauucucuuuuuaaguggguaa

SEQ ID NO: 63053 - RNA, 23 nt, Artificial Sequence
  RNA Oligomer
uauucucuuuuuaaguggguaaa

SEQ ID NO: 63054 - RNA, 23 nt, Artificial Sequence
  RNA Oligomer
acagugauaguuugcauuucuuc

SEQ ID NO: 63055 - RNA, 23 nt, Artificial Sequence
  RNA Oligomer
cagugauaguuugcauuucuucu

SEQ ID NO: 63056 - RNA, 23 nt, Artificial Sequence
  RNA Oligomer
agugauaguuugcauuucuucua

SEQ ID NO: 63057 - RNA, 23 nt, Artificial Sequence
  RNA Oligomer
gugauaguuugcauuucuucuau

SEQ ID NO: 63058 - RNA, 23 nt, Artificial Sequence
  RNA Oligomer
ugauaguuugcauuucuucuaua

SEQ ID NO: 63059 - RNA, 23 nt, Artificial Sequence
  RNA Oligomer
uagaaugaacauagacauaaccc

SEQ ID NO: 63060 - RNA, 23 nt, Artificial Sequence
  RNA Oligomer
agaaugaacauagacauaacccu

SEQ ID NO: 63061 - RNA, 23 nt, Artificial Sequence
  RNA Oligomer
gaaugaacauagacauaacccug

SEQ ID NO: 63062 - RNA, 23 nt, Artificial Sequence
  RNA Oligomer
uaguuauuuccagacucaaauag

SEQ ID NO: 63063 - RNA, 23 nt, Artificial Sequence
  RNA Oligomer
aguuauuuccagacucaaauaga

SEQ ID NO: 63064 - RNA, 23 nt, Artificial Sequence
  RNA Oligomer
guuauuuccagacucaaauagau

SEQ ID NO: 63065 - RNA, 23 nt, Artificial Sequence
  RNA Oligomer
uuauuuccagacucaaauagaua

SEQ ID NO: 63066 - RNA, 23 nt, Artificial Sequence
  RNA Oligomer
uauuuccagacucaaauagauac

SEQ ID NO: 63067 - RNA, 23 nt, Artificial Sequence
  RNA Oligomer
uguucucuuucauuuugcuauaa

SEQ ID NO: 63068 - RNA, 23 nt, Artificial Sequence
  RNA Oligomer
uuuuaauugaccucagaagaugc

SEQ ID NO: 63069 - RNA, 23 nt, Artificial Sequence
  RNA Oligomer
uuuaauugaccucagaagaugca

SEQ ID NO: 63070 - RNA, 23 nt, Artificial Sequence
  RNA Oligomer
uuaauugaccucagaagaugcac

SEQ ID NO: 63071 - RNA, 23 nt, Artificial Sequence
  RNA Oligomer
uaauugaccucagaagaugcacu

SEQ ID NO: 63072 - RNA, 23 nt, Artificial Sequence
  RNA Oligomer
aauugaccucagaagaugcacua

SEQ ID NO: 63073 - RNA, 23 nt, Artificial Sequence
  RNA Oligomer
auugaccucagaagaugcacuau

SEQ ID NO: 63074 - RNA, 23 nt, Artificial Sequence
  RNA Oligomer
uuccugacuaucaaucacaucgg

SEQ ID NO: 63075 - RNA, 23 nt, Artificial Sequence
  RNA Oligomer
uccugacuaucaaucacaucgga

SEQ ID NO: 63076 - RNA, 23 nt, Artificial Sequence
  RNA Oligomer
ccugacuaucaaucacaucggaa

SEQ ID NO: 63077 - RNA, 23 nt, Artificial Sequence
  RNA Oligomer
cugacuaucaaucacaucggaau

SEQ ID NO: 63078 - RNA, 23 nt, Artificial Sequence
  RNA Oligomer
ugacuaucaaucacaucggaaug

SEQ ID NO: 63079 - RNA, 23 nt, Artificial Sequence
  RNA Oligomer
auugcucucaucauuggcuuucc

SEQ ID NO: 63080 - RNA, 23 nt, Artificial Sequence
  RNA Oligomer
uugcucucaucauuggcuuuccg

SEQ ID NO: 63081 - RNA, 23 nt, Artificial Sequence
  RNA Oligomer
ugcucucaucauuggcuuuccgc

SEQ ID NO: 63082 - RNA, 23 nt, Artificial Sequence
  RNA Oligomer
gcucucaucauuggcuuuccgcu

SEQ ID NO: 63083 - RNA, 23 nt, Artificial Sequence
  RNA Oligomer
cucucaucauuggcuuuccgcuu

SEQ ID NO: 63084 - RNA, 23 nt, Artificial Sequence
  RNA Oligomer
ccuuguaugcaccauucaacucc

SEQ ID NO: 63085 - RNA, 23 nt, Artificial Sequence
  RNA Oligomer
cuuguaugcaccauucaacuccu

SEQ ID NO: 63086 - RNA, 23 nt, Artificial Sequence
  RNA Oligomer
uuguaugcaccauucaacuccuc

SEQ ID NO: 63087 - RNA, 23 nt, Artificial Sequence
  RNA Oligomer
uguaugcaccauucaacuccucg

SEQ ID NO: 63088 - RNA, 23 nt, Artificial Sequence
  RNA Oligomer
guaugcaccauucaacuccucgc

SEQ ID NO: 63089 - RNA, 23 nt, Artificial Sequence
  RNA Oligomer
acuucuuagauuuugaccucagu

SEQ ID NO: 63090 - RNA, 23 nt, Artificial Sequence
  RNA Oligomer
cuucuuagauuuugaccucaguc

SEQ ID NO: 63091 - RNA, 23 nt, Artificial Sequence
  RNA Oligomer
uucuuagauuuugaccucagucc

SEQ ID NO: 63092 - RNA, 23 nt, Artificial Sequence
  RNA Oligomer
ugguagugaguuuuccuuggucg

SEQ ID NO: 63093 - RNA, 23 nt, Artificial Sequence
  RNA Oligomer
gguagugaguuuuccuuggucgg

SEQ ID NO: 63094 - RNA, 23 nt, Artificial Sequence
  RNA Oligomer
guagugaguuuuccuuggucggc

SEQ ID NO: 63095 - RNA, 23 nt, Artificial Sequence
  RNA Oligomer
uagugaguuuuccuuggucggcg

SEQ ID NO: 63096 - RNA, 23 nt, Artificial Sequence
  RNA Oligomer
agugaguuuuccuuggucggcgu

SEQ ID NO: 63097 - RNA, 23 nt, Artificial Sequence
  RNA Oligomer
aguucaucagauucaucagaaug

SEQ ID NO: 63098 - RNA, 23 nt, Artificial Sequence
  RNA Oligomer
guucaucagauucaucagaaugg

SEQ ID NO: 63099 - RNA, 23 nt, Artificial Sequence
  RNA Oligomer
uucaucagauucaucagaauggu

SEQ ID NO: 63100 - RNA, 23 nt, Artificial Sequence
  RNA Oligomer
ucuacaucaucagagucguucga

SEQ ID NO: 63101 - RNA, 23 nt, Artificial Sequence
  RNA Oligomer
cuacaucaucagagucguucgag

SEQ ID NO: 63102 - RNA, 23 nt, Artificial Sequence
  RNA Oligomer
uacaucaucagagucguucgagu

SEQ ID NO: 63103 - RNA, 23 nt, Artificial Sequence
  RNA Oligomer
ccucagaacuuccagaaucagcc

SEQ ID NO: 63104 - RNA, 23 nt, Artificial Sequence
  RNA Oligomer
cucagaacuuccagaaucagccu

SEQ ID NO: 63105 - RNA, 23 nt, Artificial Sequence
  RNA Oligomer
ucagaacuuccagaaucagccug

SEQ ID NO: 63106 - RNA, 23 nt, Artificial Sequence
  RNA Oligomer
cagaacuuccagaaucagccugu

SEQ ID NO: 63107 - RNA, 23 nt, Artificial Sequence
  RNA Oligomer
agaacuuccagaaucagccuguu

SEQ ID NO: 63108 - RNA, 23 nt, Artificial Sequence
  RNA Oligomer
aaaacaaauaagcaauugacacc

SEQ ID NO: 63109 - RNA, 23 nt, Artificial Sequence
  RNA Oligomer
auaagcaauugacaccaccaaau

SEQ ID NO: 63110 - RNA, 23 nt, Artificial Sequence
  RNA Oligomer
auagaaugaacauagacauaacc

SEQ ID NO: 63111 - RNA, 23 nt, Artificial Sequence
  RNA Oligomer
auuuuuucuccuuuuaauugacc

SEQ ID NO: 63112 - RNA, 23 nt, Artificial Sequence
  RNA Oligomer
uuuuuucuccuuuuaauugaccu

SEQ ID NO: 63113 - RNA, 23 nt, Artificial Sequence
  RNA Oligomer
uuuuucuccuuuuaauugaccuc

SEQ ID NO: 63114 - RNA, 23 nt, Artificial Sequence
  RNA Oligomer
uuuucuccuuuuaauugaccuca

SEQ ID NO: 63115 - RNA, 23 nt, Artificial Sequence
  RNA Oligomer
uuucuccuuuuaauugaccucag

SEQ ID NO: 63116 - RNA, 23 nt, Artificial Sequence
  RNA Oligomer
guuuaucuucuuccuuacuuuug

SEQ ID NO: 63117 - RNA, 23 nt, Artificial Sequence
  RNA Oligomer
guuccugacuaucaaucacaucg

SEQ ID NO: 63118 - RNA, 23 nt, Artificial Sequence
  RNA Oligomer
aaucacaucggaaugcucauugc

SEQ ID NO: 63119 - RNA, 23 nt, Artificial Sequence
  RNA Oligomer
aucacaucggaaugcucauugcu

SEQ ID NO: 63120 - RNA, 23 nt, Artificial Sequence
  RNA Oligomer
ucacaucggaaugcucauugcuc

SEQ ID NO: 63121 - RNA, 23 nt, Artificial Sequence
  RNA Oligomer
cacaucggaaugcucauugcucu

SEQ ID NO: 63122 - RNA, 23 nt, Artificial Sequence
  RNA Oligomer
acaucggaaugcucauugcucuc

SEQ ID NO: 63123 - RNA, 23 nt, Artificial Sequence
  RNA Oligomer
uccgcuuauauaaucuggacugc

SEQ ID NO: 63124 - RNA, 23 nt, Artificial Sequence
  RNA Oligomer
ccgcuuauauaaucuggacugcu

SEQ ID NO: 63125 - RNA, 23 nt, Artificial Sequence
  RNA Oligomer
cgcuuauauaaucuggacugcuu

SEQ ID NO: 63126 - RNA, 23 nt, Artificial Sequence
  RNA Oligomer
gcuuauauaaucuggacugcuug

SEQ ID NO: 63127 - RNA, 23 nt, Artificial Sequence
  RNA Oligomer
cuuauauaaucuggacugcuugu

SEQ ID NO: 63128 - RNA, 23 nt, Artificial Sequence
  RNA Oligomer
gcugacucguuucauaacugucc

SEQ ID NO: 63129 - RNA, 23 nt, Artificial Sequence
  RNA Oligomer
cugacucguuucauaacuguccu

SEQ ID NO: 63130 - RNA, 23 nt, Artificial Sequence
  RNA Oligomer
ugacucguuucauaacuguccuu

SEQ ID NO: 63131 - RNA, 23 nt, Artificial Sequence
  RNA Oligomer
gacucguuucauaacuguccuuc

SEQ ID NO: 63132 - RNA, 23 nt, Artificial Sequence
  RNA Oligomer
acucguuucauaacuguccuucc

SEQ ID NO: 63133 - RNA, 23 nt, Artificial Sequence
  RNA Oligomer
cucguuucauaacuguccuuccc

SEQ ID NO: 63134 - RNA, 23 nt, Artificial Sequence
  RNA Oligomer
ucguuucauaacuguccuuccca

SEQ ID NO: 63135 - RNA, 23 nt, Artificial Sequence
  RNA Oligomer
cguuucauaacuguccuucccac

SEQ ID NO: 63136 - RNA, 23 nt, Artificial Sequence
  RNA Oligomer
guuucauaacuguccuucccacg

SEQ ID NO: 63137 - RNA, 23 nt, Artificial Sequence
  RNA Oligomer
uuucauaacuguccuucccacgg

SEQ ID NO: 63138 - RNA, 23 nt, Artificial Sequence
  RNA Oligomer
augguagugaguuuuccuugguc

SEQ ID NO: 63139 - RNA, 23 nt, Artificial Sequence
  RNA Oligomer
ugagaaucaucagugucaucuac

SEQ ID NO: 63140 - RNA, 23 nt, Artificial Sequence
  RNA Oligomer
gagaaucaucagugucaucuaca

SEQ ID NO: 63141 - RNA, 23 nt, Artificial Sequence
  RNA Oligomer
agaaucaucagugucaucuacau

SEQ ID NO: 63142 - RNA, 23 nt, Artificial Sequence
  RNA Oligomer
gaaucaucagugucaucuacauc

SEQ ID NO: 63143 - RNA, 23 nt, Artificial Sequence
  RNA Oligomer
ucagugucaucuacaucaucaga

SEQ ID NO: 63144 - RNA, 23 nt, Artificial Sequence
  RNA Oligomer
cagugucaucuacaucaucagag

SEQ ID NO: 63145 - RNA, 23 nt, Artificial Sequence
  RNA Oligomer
agugucaucuacaucaucagagu

SEQ ID NO: 63146 - RNA, 23 nt, Artificial Sequence
  RNA Oligomer
uucguuggacuuacuuggaaggg

SEQ ID NO: 63147 - RNA, 23 nt, Artificial Sequence
  RNA Oligomer
uuaggcaguaaaaaagguuaugu

SEQ ID NO: 63148 - RNA, 23 nt, Artificial Sequence
  RNA Oligomer
uaggcaguaaaaaagguuauguu

SEQ ID NO: 63149 - RNA, 23 nt, Artificial Sequence
  RNA Oligomer
aggcaguaaaaaagguuauguuu

SEQ ID NO: 63150 - RNA, 23 nt, Artificial Sequence
  RNA Oligomer
ggcaguaaaaaagguuauguuuu

SEQ ID NO: 63151 - RNA, 23 nt, Artificial Sequence
  RNA Oligomer
gcaguaaaaaagguuauguuuua

SEQ ID NO: 63152 - RNA, 23 nt, Artificial Sequence
  RNA Oligomer
uuuuauuaauugcuggacaaccg

SEQ ID NO: 63153 - RNA, 23 nt, Artificial Sequence
  RNA Oligomer
uuuauuaauugcuggacaaccgu

SEQ ID NO: 63154 - RNA, 23 nt, Artificial Sequence
  RNA Oligomer
uuauuaauugcuggacaaccgug

SEQ ID NO: 63155 - RNA, 23 nt, Artificial Sequence
  RNA Oligomer
uauuaauugcuggacaaccgugg

SEQ ID NO: 63156 - RNA, 23 nt, Artificial Sequence
  RNA Oligomer
gauaguuugcauuucuucuauag

SEQ ID NO: 63157 - RNA, 23 nt, Artificial Sequence
  RNA Oligomer
auaguuugcauuucuucuauaga

SEQ ID NO: 63158 - RNA, 23 nt, Artificial Sequence
  RNA Oligomer
uaguuugcauuucuucuauagaa

SEQ ID NO: 63159 - RNA, 23 nt, Artificial Sequence
  RNA Oligomer
aguuugcauuucuucuauagaau

SEQ ID NO: 63160 - RNA, 23 nt, Artificial Sequence
  RNA Oligomer
guuugcauuucuucuauagaaug

SEQ ID NO: 63161 - RNA, 23 nt, Artificial Sequence
  RNA Oligomer
uuuccagacucaaauagauacac

SEQ ID NO: 63162 - RNA, 23 nt, Artificial Sequence
  RNA Oligomer
uuccagacucaaauagauacaca

SEQ ID NO: 63163 - RNA, 23 nt, Artificial Sequence
  RNA Oligomer
uccagacucaaauagauacacau

SEQ ID NO: 63164 - RNA, 23 nt, Artificial Sequence
  RNA Oligomer
ccagacucaaauagauacacauu

SEQ ID NO: 63165 - RNA, 23 nt, Artificial Sequence
  RNA Oligomer
cagacucaaauagauacacauuc

SEQ ID NO: 63166 - RNA, 23 nt, Artificial Sequence
  RNA Oligomer
auagauacacauucaaccaauaa

SEQ ID NO: 63167 - RNA, 23 nt, Artificial Sequence
  RNA Oligomer
uagauacacauucaaccaauaaa

SEQ ID NO: 63168 - RNA, 23 nt, Artificial Sequence
  RNA Oligomer
acacauucaaccaauaaacugag

SEQ ID NO: 63169 - RNA, 23 nt, Artificial Sequence
  RNA Oligomer
cacauucaaccaauaaacugaga

SEQ ID NO: 63170 - RNA, 23 nt, Artificial Sequence
  RNA Oligomer
acauucaaccaauaaacugagaa

SEQ ID NO: 63171 - RNA, 23 nt, Artificial Sequence
  RNA Oligomer
cauucaaccaauaaacugagaaa

SEQ ID NO: 63172 - RNA, 23 nt, Artificial Sequence
  RNA Oligomer
auucaaccaauaaacugagaaag

SEQ ID NO: 63173 - RNA, 23 nt, Artificial Sequence
  RNA Oligomer
cuuuuaauugaccucagaagaug

SEQ ID NO: 63174 - RNA, 23 nt, Artificial Sequence
  RNA Oligomer
auacgaaauuucagguguuuauc

SEQ ID NO: 63175 - RNA, 23 nt, Artificial Sequence
  RNA Oligomer
uacgaaauuucagguguuuaucu

SEQ ID NO: 63176 - RNA, 23 nt, Artificial Sequence
  RNA Oligomer
agguguuuaucuucuuccuuacu

SEQ ID NO: 63177 - RNA, 23 nt, Artificial Sequence
  RNA Oligomer
gguguuuaucuucuuccuuacuu

SEQ ID NO: 63178 - RNA, 23 nt, Artificial Sequence
  RNA Oligomer
guguuuaucuucuuccuuacuuu

SEQ ID NO: 63179 - RNA, 23 nt, Artificial Sequence
  RNA Oligomer
uguuuaucuucuuccuuacuuuu

SEQ ID NO: 63180 - RNA, 23 nt, Artificial Sequence
  RNA Oligomer
cauugcucucaucauuggcuuuc

SEQ ID NO: 63181 - RNA, 23 nt, Artificial Sequence
  RNA Oligomer
ucucaucauuggcuuuccgcuua

SEQ ID NO: 63182 - RNA, 23 nt, Artificial Sequence
  RNA Oligomer
cggccaucauaugugucuacugu

SEQ ID NO: 63183 - RNA, 23 nt, Artificial Sequence
  RNA Oligomer
ggccaucauaugugucuacugug

SEQ ID NO: 63184 - RNA, 23 nt, Artificial Sequence
  RNA Oligomer
gccaucauaugugucuacugugg

SEQ ID NO: 63185 - RNA, 23 nt, Artificial Sequence
  RNA Oligomer
ccaucauaugugucuacuguggg

SEQ ID NO: 63186 - RNA, 23 nt, Artificial Sequence
  RNA Oligomer
caucauaugugucuacugugggg

SEQ ID NO: 63187 - RNA, 23 nt, Artificial Sequence
  RNA Oligomer
gaguuuuccuuggucggcguuug

SEQ ID NO: 63188 - RNA, 23 nt, Artificial Sequence
  RNA Oligomer
aguuuuccuuggucggcguuugg

SEQ ID NO: 63189 - RNA, 23 nt, Artificial Sequence
  RNA Oligomer
guuuuccuuggucggcguuuggc

SEQ ID NO: 63190 - RNA, 23 nt, Artificial Sequence
  RNA Oligomer
uuuuccuuggucggcguuuggcu

SEQ ID NO: 63191 - RNA, 23 nt, Artificial Sequence
  RNA Oligomer
uuuccuuggucggcguuuggcug

SEQ ID NO: 63192 - RNA, 23 nt, Artificial Sequence
  RNA Oligomer
gugucaucuacaucaucagaguc

SEQ ID NO: 63193 - RNA, 23 nt, Artificial Sequence
  RNA Oligomer
ucaucauccauaucauccaugug

SEQ ID NO: 63194 - RNA, 23 nt, Artificial Sequence
  RNA Oligomer
ucguuggacuuacuuggaagggu

SEQ ID NO: 63195 - RNA, 23 nt, Artificial Sequence
  RNA Oligomer
cguuggacuuacuuggaaggguc

SEQ ID NO: 63196 - RNA, 23 nt, Artificial Sequence
  RNA Oligomer
guuggacuuacuuggaagggucu

SEQ ID NO: 63197 - RNA, 23 nt, Artificial Sequence
  RNA Oligomer
uuggacuuacuuggaagggucuc

SEQ ID NO: 63198 - RNA, 23 nt, Artificial Sequence
  RNA Oligomer
aagcaauugacaccaccaaauuc

SEQ ID NO: 63199 - RNA, 23 nt, Artificial Sequence
  RNA Oligomer
ugacaccaccaaauucuuauuac

SEQ ID NO: 63200 - RNA, 23 nt, Artificial Sequence
  RNA Oligomer
gacaccaccaaauucuuauuaca

SEQ ID NO: 63201 - RNA, 23 nt, Artificial Sequence
  RNA Oligomer
acaccaccaaauucuuauuacau

SEQ ID NO: 63202 - RNA, 23 nt, Artificial Sequence
  RNA Oligomer
caccaccaaauucuuauuacauu

SEQ ID NO: 63203 - RNA, 23 nt, Artificial Sequence
  RNA Oligomer
accaccaaauucuuauuacauuc

SEQ ID NO: 63204 - RNA, 23 nt, Artificial Sequence
  RNA Oligomer
gauaaaagauuuauucacaccac

SEQ ID NO: 63205 - RNA, 23 nt, Artificial Sequence
  RNA Oligomer
auaaaagauuuauucacaccaca

SEQ ID NO: 63206 - RNA, 23 nt, Artificial Sequence
  RNA Oligomer
uaaaagauuuauucacaccacaa

SEQ ID NO: 63207 - RNA, 23 nt, Artificial Sequence
  RNA Oligomer
aaaagauuuauucacaccacaaa

SEQ ID NO: 63208 - RNA, 23 nt, Artificial Sequence
  RNA Oligomer
aaagauuuauucacaccacaaaa

SEQ ID NO: 63209 - RNA, 23 nt, Artificial Sequence
  RNA Oligomer
auucucuuuuuaaguggguaaaa

SEQ ID NO: 63210 - RNA, 23 nt, Artificial Sequence
  RNA Oligomer
agacucaaauagauacacauuca

SEQ ID NO: 63211 - RNA, 23 nt, Artificial Sequence
  RNA Oligomer
uacacauucaaccaauaaacuga

SEQ ID NO: 63212 - RNA, 23 nt, Artificial Sequence
  RNA Oligomer
aaccaauaaacugagaaagaagc

SEQ ID NO: 63213 - RNA, 23 nt, Artificial Sequence
  RNA Oligomer
accaauaaacugagaaagaagca

SEQ ID NO: 63214 - RNA, 23 nt, Artificial Sequence
  RNA Oligomer
ccaauaaacugagaaagaagcau

SEQ ID NO: 63215 - RNA, 23 nt, Artificial Sequence
  RNA Oligomer
caauaaacugagaaagaagcauu

SEQ ID NO: 63216 - RNA, 23 nt, Artificial Sequence
  RNA Oligomer
aauaaacugagaaagaagcauuu

SEQ ID NO: 63217 - RNA, 23 nt, Artificial Sequence
  RNA Oligomer
ucuuuugacuaaaugcaaaguga

SEQ ID NO: 63218 - RNA, 23 nt, Artificial Sequence
  RNA Oligomer
cuuuugacuaaaugcaaagugag

SEQ ID NO: 63219 - RNA, 23 nt, Artificial Sequence
  RNA Oligomer
uuuugacuaaaugcaaagugaga

SEQ ID NO: 63220 - RNA, 23 nt, Artificial Sequence
  RNA Oligomer
uuugacuaaaugcaaagugagaa

SEQ ID NO: 63221 - RNA, 23 nt, Artificial Sequence
  RNA Oligomer
uugacuaaaugcaaagugagaaa

SEQ ID NO: 63222 - RNA, 23 nt, Artificial Sequence
  RNA Oligomer
uucuccuuuuaauugaccucaga

SEQ ID NO: 63223 - RNA, 23 nt, Artificial Sequence
  RNA Oligomer
aaaguuccugacuaucaaucaca

SEQ ID NO: 63224 - RNA, 23 nt, Artificial Sequence
  RNA Oligomer
aaguuccugacuaucaaucacau

SEQ ID NO: 63225 - RNA, 23 nt, Artificial Sequence
  RNA Oligomer
aguuccugacuaucaaucacauc

SEQ ID NO: 63226 - RNA, 23 nt, Artificial Sequence
  RNA Oligomer
uggcuuuccgcuuauauaaucug

SEQ ID NO: 63227 - RNA, 23 nt, Artificial Sequence
  RNA Oligomer
uuuccaugugugaggugaugucc

SEQ ID NO: 63228 - RNA, 23 nt, Artificial Sequence
  RNA Oligomer
uuccaugugugaggugauguccu

SEQ ID NO: 63229 - RNA, 23 nt, Artificial Sequence
  RNA Oligomer
uccaugugugaggugauguccuc

SEQ ID NO: 63230 - RNA, 23 nt, Artificial Sequence
  RNA Oligomer
ccaugugugaggugauguccucg

SEQ ID NO: 63231 - RNA, 23 nt, Artificial Sequence
  RNA Oligomer
caugugugaggugauguccucgu

SEQ ID NO: 63232 - RNA, 23 nt, Artificial Sequence
  RNA Oligomer
cauaaaccacacuaucaccucgg

SEQ ID NO: 63233 - RNA, 23 nt, Artificial Sequence
  RNA Oligomer
auaaaccacacuaucaccucggc

SEQ ID NO: 63234 - RNA, 23 nt, Artificial Sequence
  RNA Oligomer
uaaaccacacuaucaccucggcc

SEQ ID NO: 63235 - RNA, 23 nt, Artificial Sequence
  RNA Oligomer
aaaccacacuaucaccucggcca

SEQ ID NO: 63236 - RNA, 23 nt, Artificial Sequence
  RNA Oligomer
aaccacacuaucaccucggccau

SEQ ID NO: 63237 - RNA, 23 nt, Artificial Sequence
  RNA Oligomer
aucauaugugucuacugugggga

SEQ ID NO: 63238 - RNA, 23 nt, Artificial Sequence
  RNA Oligomer
ucaugguagugaguuuuccuugg

SEQ ID NO: 63239 - RNA, 23 nt, Artificial Sequence
  RNA Oligomer
caugguagugaguuuuccuuggu

SEQ ID NO: 63240 - RNA, 23 nt, Artificial Sequence
  RNA Oligomer
caucauccauaucauccaugugg

SEQ ID NO: 63241 - RNA, 23 nt, Artificial Sequence
  RNA Oligomer
aucauccauaucauccauguggu

SEQ ID NO: 63242 - RNA, 23 nt, Artificial Sequence
  RNA Oligomer
ucauccauaucauccaugugguc

SEQ ID NO: 63243 - RNA, 23 nt, Artificial Sequence
  RNA Oligomer
gucauggcuuucguuggacuuac

SEQ ID NO: 63244 - RNA, 23 nt, Artificial Sequence
  RNA Oligomer
ucauggcuuucguuggacuuacu

SEQ ID NO: 63245 - RNA, 23 nt, Artificial Sequence
  RNA Oligomer
cauggcuuucguuggacuuacuu

SEQ ID NO: 63246 - RNA, 23 nt, Artificial Sequence
  RNA Oligomer
auggcuuucguuggacuuacuug

SEQ ID NO: 63247 - RNA, 23 nt, Artificial Sequence
  RNA Oligomer
aagcccucccagaauuuaaaugc

SEQ ID NO: 63248 - RNA, 23 nt, Artificial Sequence
  RNA Oligomer
agcccucccagaauuuaaaugcu

SEQ ID NO: 63249 - RNA, 23 nt, Artificial Sequence
  RNA Oligomer
gcccucccagaauuuaaaugcug

SEQ ID NO: 63250 - RNA, 23 nt, Artificial Sequence
  RNA Oligomer
cccucccagaauuuaaaugcugc

SEQ ID NO: 63251 - RNA, 23 nt, Artificial Sequence
  RNA Oligomer
ccucccagaauuuaaaugcugcu

SEQ ID NO: 63252 - RNA, 23 nt, Artificial Sequence
  RNA Oligomer
uagacauaacccugaagcuuuua

SEQ ID NO: 63253 - RNA, 23 nt, Artificial Sequence
  RNA Oligomer
ucaaacacauuaguuauuuccag

SEQ ID NO: 63254 - RNA, 23 nt, Artificial Sequence
  RNA Oligomer
caaacacauuaguuauuuccaga

SEQ ID NO: 63255 - RNA, 23 nt, Artificial Sequence
  RNA Oligomer
aaacacauuaguuauuuccagac

SEQ ID NO: 63256 - RNA, 23 nt, Artificial Sequence
  RNA Oligomer
aacacauuaguuauuuccagacu

SEQ ID NO: 63257 - RNA, 23 nt, Artificial Sequence
  RNA Oligomer
acacauuaguuauuuccagacuc

SEQ ID NO: 63258 - RNA, 23 nt, Artificial Sequence
  RNA Oligomer
cacauuaguuauuuccagacuca

SEQ ID NO: 63259 - RNA, 23 nt, Artificial Sequence
  RNA Oligomer
acauuaguuauuuccagacucaa

SEQ ID NO: 63260 - RNA, 23 nt, Artificial Sequence
  RNA Oligomer
cauuaguuauuuccagacucaaa

SEQ ID NO: 63261 - RNA, 23 nt, Artificial Sequence
  RNA Oligomer
auuaguuauuuccagacucaaau

SEQ ID NO: 63262 - RNA, 23 nt, Artificial Sequence
  RNA Oligomer
uuaguuauuuccagacucaaaua

SEQ ID NO: 63263 - RNA, 23 nt, Artificial Sequence
  RNA Oligomer
auuuccagacucaaauagauaca

SEQ ID NO: 63264 - RNA, 23 nt, Artificial Sequence
  RNA Oligomer
gaagcauuucauguucucuuuca

SEQ ID NO: 63265 - RNA, 23 nt, Artificial Sequence
  RNA Oligomer
aagcauuucauguucucuuucau

SEQ ID NO: 63266 - RNA, 23 nt, Artificial Sequence
  RNA Oligomer
agcauuucauguucucuuucauu

SEQ ID NO: 63267 - RNA, 23 nt, Artificial Sequence
  RNA Oligomer
gcauuucauguucucuuucauuu

SEQ ID NO: 63268 - RNA, 23 nt, Artificial Sequence
  RNA Oligomer
cauuucauguucucuuucauuuu

SEQ ID NO: 63269 - RNA, 23 nt, Artificial Sequence
  RNA Oligomer
uugaccucagaagaugcacuauc

SEQ ID NO: 63270 - RNA, 23 nt, Artificial Sequence
  RNA Oligomer
uggaaaguuccugacuaucaauc

SEQ ID NO: 63271 - RNA, 23 nt, Artificial Sequence
  RNA Oligomer
ggaaaguuccugacuaucaauca

SEQ ID NO: 63272 - RNA, 23 nt, Artificial Sequence
  RNA Oligomer
gaaaguuccugacuaucaaucac

SEQ ID NO: 63273 - RNA, 23 nt, Artificial Sequence
  RNA Oligomer
caaucacaucggaaugcucauug

SEQ ID NO: 63274 - RNA, 23 nt, Artificial Sequence
  RNA Oligomer
cucaucauuggcuuuccgcuuau

SEQ ID NO: 63275 - RNA, 23 nt, Artificial Sequence
  RNA Oligomer
uuauauaaucuggacugcuugug

SEQ ID NO: 63276 - RNA, 23 nt, Artificial Sequence
  RNA Oligomer
uauauaaucuggacugcuugugg

SEQ ID NO: 63277 - RNA, 23 nt, Artificial Sequence
  RNA Oligomer
auauaaucuggacugcuuguggc

SEQ ID NO: 63278 - RNA, 23 nt, Artificial Sequence
  RNA Oligomer
uauaaucuggacugcuuguggcu

SEQ ID NO: 63279 - RNA, 23 nt, Artificial Sequence
  RNA Oligomer
auaaucuggacugcuuguggcug

SEQ ID NO: 63280 - RNA, 23 nt, Artificial Sequence
  RNA Oligomer
uaaucuggacugcuuguggcugu

SEQ ID NO: 63281 - RNA, 23 nt, Artificial Sequence
  RNA Oligomer
aaucuggacugcuuguggcugug

SEQ ID NO: 63282 - RNA, 23 nt, Artificial Sequence
  RNA Oligomer
ggucauccagcugacucguuuca

SEQ ID NO: 63283 - RNA, 23 nt, Artificial Sequence
  RNA Oligomer
gucauccagcugacucguuucau

SEQ ID NO: 63284 - RNA, 23 nt, Artificial Sequence
  RNA Oligomer
ucauccagcugacucguuucaua

SEQ ID NO: 63285 - RNA, 23 nt, Artificial Sequence
  RNA Oligomer
cauccagcugacucguuucauaa

SEQ ID NO: 63286 - RNA, 23 nt, Artificial Sequence
  RNA Oligomer
auccagcugacucguuucauaac

SEQ ID NO: 63287 - RNA, 23 nt, Artificial Sequence
  RNA Oligomer
cagcugacucguuucauaacugu

SEQ ID NO: 63288 - RNA, 23 nt, Artificial Sequence
  RNA Oligomer
agcugacucguuucauaacuguc

SEQ ID NO: 63289 - RNA, 23 nt, Artificial Sequence
  RNA Oligomer
uaugcaccauucaacuccucgcu

SEQ ID NO: 63290 - RNA, 23 nt, Artificial Sequence
  RNA Oligomer
ccauaaaccacacuaucaccucg

SEQ ID NO: 63291 - RNA, 23 nt, Artificial Sequence
  RNA Oligomer
ucucaugguagugaguuuuccuu

SEQ ID NO: 63292 - RNA, 23 nt, Artificial Sequence
  RNA Oligomer
cucaugguagugaguuuuccuug

SEQ ID NO: 63293 - RNA, 23 nt, Artificial Sequence
  RNA Oligomer
uaucaccucggccaucauaugug

SEQ ID NO: 63294 - RNA, 23 nt, Artificial Sequence
  RNA Oligomer
aucaccucggccaucauaugugu

SEQ ID NO: 63295 - RNA, 23 nt, Artificial Sequence
  RNA Oligomer
ucaccucggccaucauauguguc

SEQ ID NO: 63296 - RNA, 23 nt, Artificial Sequence
  RNA Oligomer
caccucggccaucauaugugucu

SEQ ID NO: 63297 - RNA, 23 nt, Artificial Sequence
  RNA Oligomer
accucggccaucauaugugucua

SEQ ID NO: 63298 - RNA, 23 nt, Artificial Sequence
  RNA Oligomer
ugggaaaaucagugaccaguuca

SEQ ID NO: 63299 - RNA, 23 nt, Artificial Sequence
  RNA Oligomer
gggaaaaucagugaccaguucau

SEQ ID NO: 63300 - RNA, 23 nt, Artificial Sequence
  RNA Oligomer
ggaaaaucagugaccaguucauc

SEQ ID NO: 63301 - RNA, 23 nt, Artificial Sequence
  RNA Oligomer
gaaaaucagugaccaguucauca

SEQ ID NO: 63302 - RNA, 23 nt, Artificial Sequence
  RNA Oligomer
aaaaucagugaccaguucaucag

SEQ ID NO: 63303 - RNA, 23 nt, Artificial Sequence
  RNA Oligomer
ggugagaaucaucagugucaucu

SEQ ID NO: 63304 - RNA, 23 nt, Artificial Sequence
  RNA Oligomer
gugagaaucaucagugucaucua

SEQ ID NO: 63305 - RNA, 23 nt, Artificial Sequence
  RNA Oligomer
acaucaucagagucguucgaguc

SEQ ID NO: 63306 - RNA, 23 nt, Artificial Sequence
  RNA Oligomer
caucaucagagucguucgaguca

SEQ ID NO: 63307 - RNA, 23 nt, Artificial Sequence
  RNA Oligomer
aucaucagagucguucgagucaa

SEQ ID NO: 63308 - RNA, 23 nt, Artificial Sequence
  RNA Oligomer
cucccagaauuuaaaugcugcug

SEQ ID NO: 63309 - RNA, 23 nt, Artificial Sequence
  RNA Oligomer
cugcuuuuccucagaacuuccag

SEQ ID NO: 63310 - RNA, 23 nt, Artificial Sequence
  RNA Oligomer
ugcuuuuccucagaacuuccaga

SEQ ID NO: 63311 - RNA, 23 nt, Artificial Sequence
  RNA Oligomer
gcuuuuccucagaacuuccagaa

SEQ ID NO: 63312 - RNA, 23 nt, Artificial Sequence
  RNA Oligomer
cuuuuccucagaacuuccagaau

SEQ ID NO: 63313 - RNA, 23 nt, Artificial Sequence
  RNA Oligomer
uuuuccucagaacuuccagaauc

SEQ ID NO: 63314 - RNA, 23 nt, Artificial Sequence
  RNA Oligomer
uccagaaucagccuguuuaacug

SEQ ID NO: 63315 - RNA, 23 nt, Artificial Sequence
  RNA Oligomer
ccagaaucagccuguuuaacugg

SEQ ID NO: 63316 - RNA, 23 nt, Artificial Sequence
  RNA Oligomer
cagaaucagccuguuuaacuggu

SEQ ID NO: 63317 - RNA, 23 nt, Artificial Sequence
  RNA Oligomer
agaaucagccuguuuaacuggua

SEQ ID NO: 63318 - RNA, 23 nt, Artificial Sequence
  RNA Oligomer
gaaucagccuguuuaacugguau

SEQ ID NO: 63319 - RNA, 23 nt, Artificial Sequence
  RNA Oligomer
ucacaccacaaaaagauaaucac

SEQ ID NO: 63320 - RNA, 23 nt, Artificial Sequence
  RNA Oligomer
cacaccacaaaaagauaaucaca

SEQ ID NO: 63321 - RNA, 23 nt, Artificial Sequence
  RNA Oligomer
acaccacaaaaagauaaucacaa

SEQ ID NO: 63322 - RNA, 23 nt, Artificial Sequence
  RNA Oligomer
caccacaaaaagauaaucacaac

SEQ ID NO: 63323 - RNA, 23 nt, Artificial Sequence
  RNA Oligomer
acuaaaugcaaagugagaaauug

SEQ ID NO: 63324 - RNA, 23 nt, Artificial Sequence
  RNA Oligomer
cuaaaugcaaagugagaaauugu

SEQ ID NO: 63325 - RNA, 23 nt, Artificial Sequence
  RNA Oligomer
uaaaugcaaagugagaaauugua

SEQ ID NO: 63326 - RNA, 23 nt, Artificial Sequence
  RNA Oligomer
aaaugcaaagugagaaauuguau

SEQ ID NO: 63327 - RNA, 23 nt, Artificial Sequence
  RNA Oligomer
aaugcaaagugagaaauuguauu

SEQ ID NO: 63328 - RNA, 23 nt, Artificial Sequence
  RNA Oligomer
ucuccuuuuaauugaccucagaa

SEQ ID NO: 63329 - RNA, 23 nt, Artificial Sequence
  RNA Oligomer
cuccuuuuaauugaccucagaag

SEQ ID NO: 63330 - RNA, 23 nt, Artificial Sequence
  RNA Oligomer
uccuuuuaauugaccucagaaga

SEQ ID NO: 63331 - RNA, 23 nt, Artificial Sequence
  RNA Oligomer
ccuuuuaauugaccucagaagau

SEQ ID NO: 63332 - RNA, 23 nt, Artificial Sequence
  RNA Oligomer
aagaugcacuaucuaauucauga

SEQ ID NO: 63333 - RNA, 23 nt, Artificial Sequence
  RNA Oligomer
agaugcacuaucuaauucaugag

SEQ ID NO: 63334 - RNA, 23 nt, Artificial Sequence
  RNA Oligomer
gaugcacuaucuaauucaugaga

SEQ ID NO: 63335 - RNA, 23 nt, Artificial Sequence
  RNA Oligomer
augcacuaucuaauucaugagaa

SEQ ID NO: 63336 - RNA, 23 nt, Artificial Sequence
  RNA Oligomer
ugcacuaucuaauucaugagaaa

SEQ ID NO: 63337 - RNA, 23 nt, Artificial Sequence
  RNA Oligomer
ggucuacaaccagcauaucuuca

SEQ ID NO: 63338 - RNA, 23 nt, Artificial Sequence
  RNA Oligomer
gucuacaaccagcauaucuucau

SEQ ID NO: 63339 - RNA, 23 nt, Artificial Sequence
  RNA Oligomer
ucuacaaccagcauaucuucaug

SEQ ID NO: 63340 - RNA, 23 nt, Artificial Sequence
  RNA Oligomer
cuacaaccagcauaucuucaugg

SEQ ID NO: 63341 - RNA, 23 nt, Artificial Sequence
  RNA Oligomer
uacaaccagcauaucuucauggc

SEQ ID NO: 63342 - RNA, 23 nt, Artificial Sequence
  RNA Oligomer
guggaauucacggcugacuuugg

SEQ ID NO: 63343 - RNA, 23 nt, Artificial Sequence
  RNA Oligomer
uggaauucacggcugacuuugga

SEQ ID NO: 63344 - RNA, 23 nt, Artificial Sequence
  RNA Oligomer
ggaauucacggcugacuuuggaa

SEQ ID NO: 63345 - RNA, 23 nt, Artificial Sequence
  RNA Oligomer
gaauucacggcugacuuuggaaa

SEQ ID NO: 63346 - RNA, 23 nt, Artificial Sequence
  RNA Oligomer
aauucacggcugacuuuggaaag

SEQ ID NO: 63347 - RNA, 23 nt, Artificial Sequence
  RNA Oligomer
ucaaucacaucggaaugcucauu

SEQ ID NO: 63348 - RNA, 23 nt, Artificial Sequence
  RNA Oligomer
uuggcuuuccgcuuauauaaucu

SEQ ID NO: 63349 - RNA, 23 nt, Artificial Sequence
  RNA Oligomer
agcaaaucacugcaauucucaug

SEQ ID NO: 63350 - RNA, 23 nt, Artificial Sequence
  RNA Oligomer
augcaccauucaacuccucgcuu

SEQ ID NO: 63351 - RNA, 23 nt, Artificial Sequence
  RNA Oligomer
caccauucaacuccucgcuuucc

SEQ ID NO: 63352 - RNA, 23 nt, Artificial Sequence
  RNA Oligomer
accauucaacuccucgcuuucca

SEQ ID NO: 63353 - RNA, 23 nt, Artificial Sequence
  RNA Oligomer
ccauucaacuccucgcuuuccau

SEQ ID NO: 63354 - RNA, 23 nt, Artificial Sequence
  RNA Oligomer
cauucaacuccucgcuuuccaug

SEQ ID NO: 63355 - RNA, 23 nt, Artificial Sequence
  RNA Oligomer
auucaacuccucgcuuuccaugu

SEQ ID NO: 63356 - RNA, 23 nt, Artificial Sequence
  RNA Oligomer
uucaacuccucgcuuuccaugug

SEQ ID NO: 63357 - RNA, 23 nt, Artificial Sequence
  RNA Oligomer
ucaacuccucgcuuuccaugugu

SEQ ID NO: 63358 - RNA, 23 nt, Artificial Sequence
  RNA Oligomer
caacuccucgcuuuccaugugug

SEQ ID NO: 63359 - RNA, 23 nt, Artificial Sequence
  RNA Oligomer
aacuccucgcuuuccauguguga

SEQ ID NO: 63360 - RNA, 23 nt, Artificial Sequence
  RNA Oligomer
ggugauguccucgucuguagcau

SEQ ID NO: 63361 - RNA, 23 nt, Artificial Sequence
  RNA Oligomer
gugauguccucgucuguagcauc

SEQ ID NO: 63362 - RNA, 23 nt, Artificial Sequence
  RNA Oligomer
ugauguccucgucuguagcauca

SEQ ID NO: 63363 - RNA, 23 nt, Artificial Sequence
  RNA Oligomer
gauguccucgucuguagcaucag

SEQ ID NO: 63364 - RNA, 23 nt, Artificial Sequence
  RNA Oligomer
auguccucgucuguagcaucagg

SEQ ID NO: 63365 - RNA, 23 nt, Artificial Sequence
  RNA Oligomer
uguccucgucuguagcaucaggg

SEQ ID NO: 63366 - RNA, 23 nt, Artificial Sequence
  RNA Oligomer
guccucgucuguagcaucagggu

SEQ ID NO: 63367 - RNA, 23 nt, Artificial Sequence
  RNA Oligomer
gcugcuuuuccucagaacuucca

SEQ ID NO: 63368 - RNA, 23 nt, Artificial Sequence
  RNA Oligomer
uaagcaauugacaccaccaaauu

SEQ ID NO: 63369 - RNA, 23 nt, Artificial Sequence
  RNA Oligomer
accacaaaaagauaaucacaaca

SEQ ID NO: 63370 - RNA, 23 nt, Artificial Sequence
  RNA Oligomer
auaaacugagaaagaagcauuuc

SEQ ID NO: 63371 - RNA, 23 nt, Artificial Sequence
  RNA Oligomer
ucuuagauuuugaccucagucca

SEQ ID NO: 63372 - RNA, 23 nt, Artificial Sequence
  RNA Oligomer
guccauaaaccacacuaucaccu

SEQ ID NO: 63373 - RNA, 23 nt, Artificial Sequence
  RNA Oligomer
uccauaaaccacacuaucaccuc

SEQ ID NO: 63374 - RNA, 23 nt, Artificial Sequence
  RNA Oligomer
ucaucagauucaucagaauggug

SEQ ID NO: 63375 - RNA, 23 nt, Artificial Sequence
  RNA Oligomer
caucagauucaucagaaugguga

SEQ ID NO: 63376 - RNA, 23 nt, Artificial Sequence
  RNA Oligomer
aucagauucaucagaauggugag

SEQ ID NO: 63377 - RNA, 23 nt, Artificial Sequence
  RNA Oligomer
gugaguuuuccuuggucggcguu

SEQ ID NO: 63378 - RNA, 23 nt, Artificial Sequence
  RNA Oligomer
ugaguuuuccuuggucggcguuu

SEQ ID NO: 63379 - RNA, 23 nt, Artificial Sequence
  RNA Oligomer
auucaucagaauggugagacuca

SEQ ID NO: 63380 - RNA, 23 nt, Artificial Sequence
  RNA Oligomer
uucaucagaauggugagacucau

SEQ ID NO: 63381 - RNA, 23 nt, Artificial Sequence
  RNA Oligomer
ucaucagaauggugagacucauc

SEQ ID NO: 63382 - RNA, 23 nt, Artificial Sequence
  RNA Oligomer
caucagaauggugagacucauca

SEQ ID NO: 63383 - RNA, 23 nt, Artificial Sequence
  RNA Oligomer
aucagaauggugagacucaucag

SEQ ID NO: 63384 - RNA, 23 nt, Artificial Sequence
  RNA Oligomer
aucaucuucaucauccauaucau

SEQ ID NO: 63385 - RNA, 23 nt, Artificial Sequence
  RNA Oligomer
ucaucuucaucauccauaucauc

SEQ ID NO: 63386 - RNA, 23 nt, Artificial Sequence
  RNA Oligomer
uuuccucagaacuuccagaauca

SEQ ID NO: 63387 - RNA, 23 nt, Artificial Sequence
  RNA Oligomer
uuuaaguggguaaaaguauuuug

SEQ ID NO: 63388 - RNA, 23 nt, Artificial Sequence
  RNA Oligomer
uuaaguggguaaaaguauuuugu

SEQ ID NO: 63389 - RNA, 23 nt, Artificial Sequence
  RNA Oligomer
uaaguggguaaaaguauuuuguu

SEQ ID NO: 63390 - RNA, 23 nt, Artificial Sequence
  RNA Oligomer
aaguggguaaaaguauuuuguuu

SEQ ID NO: 63391 - RNA, 23 nt, Artificial Sequence
  RNA Oligomer
aguggguaaaaguauuuuguuug

SEQ ID NO: 63392 - RNA, 23 nt, Artificial Sequence
  RNA Oligomer
agauacacauucaaccaauaaac

SEQ ID NO: 63393 - RNA, 23 nt, Artificial Sequence
  RNA Oligomer
gauacacauucaaccaauaaacu

SEQ ID NO: 63394 - RNA, 23 nt, Artificial Sequence
  RNA Oligomer
auacacauucaaccaauaaacug

SEQ ID NO: 63395 - RNA, 23 nt, Artificial Sequence
  RNA Oligomer
uucaaccaauaaacugagaaaga

SEQ ID NO: 63396 - RNA, 23 nt, Artificial Sequence
  RNA Oligomer
augcaaagugagaaauuguauuu

SEQ ID NO: 63397 - RNA, 23 nt, Artificial Sequence
  RNA Oligomer
cuuagauuuugaccucaguccau

SEQ ID NO: 63398 - RNA, 23 nt, Artificial Sequence
  RNA Oligomer
uuagauuuugaccucaguccaua

SEQ ID NO: 63399 - RNA, 23 nt, Artificial Sequence
  RNA Oligomer
ggucaucaucaucuucaucaucc

SEQ ID NO: 63400 - RNA, 23 nt, Artificial Sequence
  RNA Oligomer
gucaucaucaucuucaucaucca

SEQ ID NO: 63401 - RNA, 23 nt, Artificial Sequence
  RNA Oligomer
ucaucaucaucuucaucauccau

SEQ ID NO: 63402 - RNA, 23 nt, Artificial Sequence
  RNA Oligomer
caucaucaucuucaucauccaua

SEQ ID NO: 63403 - RNA, 23 nt, Artificial Sequence
  RNA Oligomer
aucaucaucuucaucauccauau

SEQ ID NO: 63404 - RNA, 23 nt, Artificial Sequence
  RNA Oligomer
uggacuuacuuggaagggucucu

SEQ ID NO: 63405 - RNA, 23 nt, Artificial Sequence
  RNA Oligomer
uuccucagaacuuccagaaucag

SEQ ID NO: 63406 - RNA, 23 nt, Artificial Sequence
  RNA Oligomer
uccucagaacuuccagaaucagc

SEQ ID NO: 63407 - RNA, 23 nt, Artificial Sequence
  RNA Oligomer
gcagacauccuccaccaacacag

SEQ ID NO: 63408 - RNA, 23 nt, Artificial Sequence
  RNA Oligomer
cagacauccuccaccaacacagg

SEQ ID NO: 63409 - RNA, 23 nt, Artificial Sequence
  RNA Oligomer
agacauccuccaccaacacaggg

SEQ ID NO: 63410 - RNA, 23 nt, Artificial Sequence
  RNA Oligomer
gacauccuccaccaacacaggga

SEQ ID NO: 63411 - RNA, 23 nt, Artificial Sequence
  RNA Oligomer
acauccuccaccaacacagggag

SEQ ID NO: 63412 - RNA, 23 nt, Artificial Sequence
  RNA Oligomer
aagauuuauucacaccacaaaaa

SEQ ID NO: 63413 - RNA, 23 nt, Artificial Sequence
  RNA Oligomer
auuuauucacaccacaaaaagau

SEQ ID NO: 63414 - RNA, 23 nt, Artificial Sequence
  RNA Oligomer
uuuauucacaccacaaaaagaua

SEQ ID NO: 63415 - RNA, 23 nt, Artificial Sequence
  RNA Oligomer
uuauucacaccacaaaaagauaa

SEQ ID NO: 63416 - RNA, 23 nt, Artificial Sequence
  RNA Oligomer
uauucacaccacaaaaagauaau

SEQ ID NO: 63417 - RNA, 23 nt, Artificial Sequence
  RNA Oligomer
auucacaccacaaaaagauaauc

SEQ ID NO: 63418 - RNA, 23 nt, Artificial Sequence
  RNA Oligomer
uaaacugagaaagaagcauuuca

SEQ ID NO: 63419 - RNA, 23 nt, Artificial Sequence
  RNA Oligomer
ucacugcaauucucaugguagug

SEQ ID NO: 63420 - RNA, 23 nt, Artificial Sequence
  RNA Oligomer
ccagcugacucguuucauaacug

SEQ ID NO: 63421 - RNA, 23 nt, Artificial Sequence
  RNA Oligomer
ugcaccauucaacuccucgcuuu

SEQ ID NO: 63422 - RNA, 23 nt, Artificial Sequence
  RNA Oligomer
uucucuuuuuaaguggguaaaag

SEQ ID NO: 63423 - RNA, 23 nt, Artificial Sequence
  RNA Oligomer
guggguaaaaguauuuuguuugc

SEQ ID NO: 63424 - RNA, 23 nt, Artificial Sequence
  RNA Oligomer
aaaaguauuuuguuugcuucuac

SEQ ID NO: 63425 - RNA, 23 nt, Artificial Sequence
  RNA Oligomer
aaaguauuuuguuugcuucuaca

SEQ ID NO: 63426 - RNA, 23 nt, Artificial Sequence
  RNA Oligomer
aaguauuuuguuugcuucuacau

SEQ ID NO: 63427 - RNA, 23 nt, Artificial Sequence
  RNA Oligomer
aguauuuuguuugcuucuacaua

SEQ ID NO: 63428 - RNA, 23 nt, Artificial Sequence
  RNA Oligomer
guauuuuguuugcuucuacauaa

SEQ ID NO: 63429 - RNA, 23 nt, Artificial Sequence
  RNA Oligomer
caugaagccacaaacuaaacuaa

SEQ ID NO: 63430 - RNA, 23 nt, Artificial Sequence
  RNA Oligomer
augaagccacaaacuaaacuaau

SEQ ID NO: 63431 - RNA, 23 nt, Artificial Sequence
  RNA Oligomer
ugaagccacaaacuaaacuaauu

SEQ ID NO: 63432 - RNA, 23 nt, Artificial Sequence
  RNA Oligomer
gaagccacaaacuaaacuaauua

SEQ ID NO: 63433 - RNA, 23 nt, Artificial Sequence
  RNA Oligomer
aagccacaaacuaaacuaauuau

SEQ ID NO: 63434 - RNA, 23 nt, Artificial Sequence
  RNA Oligomer
gacucaaauagauacacauucaa

SEQ ID NO: 63435 - RNA, 23 nt, Artificial Sequence
  RNA Oligomer
acucaaauagauacacauucaac

SEQ ID NO: 63436 - RNA, 23 nt, Artificial Sequence
  RNA Oligomer
ucaaccaauaaacugagaaagaa

SEQ ID NO: 63437 - RNA, 23 nt, Artificial Sequence
  RNA Oligomer
caaccaauaaacugagaaagaag

SEQ ID NO: 63438 - RNA, 23 nt, Artificial Sequence
  RNA Oligomer
aaagaagcauuucauguucucuu

SEQ ID NO: 63439 - RNA, 23 nt, Artificial Sequence
  RNA Oligomer
aagaagcauuucauguucucuuu

SEQ ID NO: 63440 - RNA, 23 nt, Artificial Sequence
  RNA Oligomer
agaagcauuucauguucucuuuc

SEQ ID NO: 63441 - RNA, 23 nt, Artificial Sequence
  RNA Oligomer
gcacuaucuaauucaugagaaau

SEQ ID NO: 63442 - RNA, 23 nt, Artificial Sequence
  RNA Oligomer
cacuaucuaauucaugagaaaua

SEQ ID NO: 63443 - RNA, 23 nt, Artificial Sequence
  RNA Oligomer
uucauaacuguccuucccacggc

SEQ ID NO: 63444 - RNA, 23 nt, Artificial Sequence
  RNA Oligomer
gcaccauucaacuccucgcuuuc

SEQ ID NO: 63445 - RNA, 23 nt, Artificial Sequence
  RNA Oligomer
ccacacuaucaccucggccauca

SEQ ID NO: 63446 - RNA, 23 nt, Artificial Sequence
  RNA Oligomer
cacacuaucaccucggccaucau

SEQ ID NO: 63447 - RNA, 23 nt, Artificial Sequence
  RNA Oligomer
acacuaucaccucggccaucaua

SEQ ID NO: 63448 - RNA, 23 nt, Artificial Sequence
  RNA Oligomer
cacuaucaccucggccaucauau

SEQ ID NO: 63449 - RNA, 23 nt, Artificial Sequence
  RNA Oligomer
acuaucaccucggccaucauaug

SEQ ID NO: 63450 - RNA, 23 nt, Artificial Sequence
  RNA Oligomer
aauacagugauaguuugcauuuc

SEQ ID NO: 63451 - RNA, 23 nt, Artificial Sequence
  RNA Oligomer
auacagugauaguuugcauuucu

SEQ ID NO: 63452 - RNA, 23 nt, Artificial Sequence
  RNA Oligomer
ggaguuuccaugaagccacaaac

SEQ ID NO: 63453 - RNA, 23 nt, Artificial Sequence
  RNA Oligomer
gaguuuccaugaagccacaaacu

SEQ ID NO: 63454 - RNA, 23 nt, Artificial Sequence
  RNA Oligomer
aguuuccaugaagccacaaacua

SEQ ID NO: 63455 - RNA, 23 nt, Artificial Sequence
  RNA Oligomer
guuuccaugaagccacaaacuaa

SEQ ID NO: 63456 - RNA, 23 nt, Artificial Sequence
  RNA Oligomer
uuuccaugaagccacaaacuaaa

SEQ ID NO: 63457 - RNA, 23 nt, Artificial Sequence
  RNA Oligomer
aaagcaaaucacugcaauucuca

SEQ ID NO: 63458 - RNA, 23 nt, Artificial Sequence
  RNA Oligomer
aagcaaaucacugcaauucucau

SEQ ID NO: 63459 - RNA, 23 nt, Artificial Sequence
  RNA Oligomer
uacagugauaguuugcauuucuu

SEQ ID NO: 63460 - RNA, 23 nt, Artificial Sequence
  RNA Oligomer
uguuuaacugguauggcacaggu

SEQ ID NO: 63461 - RNA, 23 nt, Artificial Sequence
  RNA Oligomer
guuuaacugguauggcacaggug

SEQ ID NO: 63462 - RNA, 23 nt, Artificial Sequence
  RNA Oligomer
uuuaacugguauggcacagguga

SEQ ID NO: 63463 - RNA, 23 nt, Artificial Sequence
  RNA Oligomer
uuaacugguauggcacaggugau

SEQ ID NO: 63464 - RNA, 23 nt, Artificial Sequence
  RNA Oligomer
uaacugguauggcacaggugaug

SEQ ID NO: 63465 - RNA, 23 nt, Artificial Sequence
  RNA Oligomer
aaacugagaaagaagcauuucau

SEQ ID NO: 63466 - RNA, 23 nt, Artificial Sequence
  RNA Oligomer
auuucauguucucuuucauuuug

SEQ ID NO: 63467 - RNA, 23 nt, Artificial Sequence
  RNA Oligomer
ucauaacuguccuucccacggcu

SEQ ID NO: 63468 - RNA, 23 nt, Artificial Sequence
  RNA Oligomer
ugaccucaguccauaaaccacac

SEQ ID NO: 63469 - RNA, 23 nt, Artificial Sequence
  RNA Oligomer
gaccucaguccauaaaccacacu

SEQ ID NO: 63470 - RNA, 23 nt, Artificial Sequence
  RNA Oligomer
accucaguccauaaaccacacua

SEQ ID NO: 63471 - RNA, 23 nt, Artificial Sequence
  RNA Oligomer
ccucaguccauaaaccacacuau

SEQ ID NO: 63472 - RNA, 23 nt, Artificial Sequence
  RNA Oligomer
cucaguccauaaaccacacuauc

SEQ ID NO: 63473 - RNA, 23 nt, Artificial Sequence
  RNA Oligomer
aggguacuggaugucaggucugc

SEQ ID NO: 63474 - RNA, 23 nt, Artificial Sequence
  RNA Oligomer
ggguacuggaugucaggucugcg

SEQ ID NO: 63475 - RNA, 23 nt, Artificial Sequence
  RNA Oligomer
gguacuggaugucaggucugcga

SEQ ID NO: 63476 - RNA, 23 nt, Artificial Sequence
  RNA Oligomer
guacuggaugucaggucugcgaa

SEQ ID NO: 63477 - RNA, 23 nt, Artificial Sequence
  RNA Oligomer
uacuggaugucaggucugcgaaa

SEQ ID NO: 63478 - RNA, 23 nt, Artificial Sequence
  RNA Oligomer
aguccauaaaccacacuaucacc

SEQ ID NO: 63479 - RNA, 23 nt, Artificial Sequence
  RNA Oligomer
cauggucaucaucaucuucauca

SEQ ID NO: 63480 - RNA, 23 nt, Artificial Sequence
  RNA Oligomer
auggucaucaucaucuucaucau

SEQ ID NO: 63481 - RNA, 23 nt, Artificial Sequence
  RNA Oligomer
uggucaucaucaucuucaucauc

SEQ ID NO: 63482 - RNA, 23 nt, Artificial Sequence
  RNA Oligomer
ccugaagcuuuuaguuuacaggg

SEQ ID NO: 63483 - RNA, 23 nt, Artificial Sequence
  RNA Oligomer
cuucauggcugugaaauucaugg

SEQ ID NO: 63484 - RNA, 23 nt, Artificial Sequence
  RNA Oligomer
uucauggcugugaaauucauggc

SEQ ID NO: 63485 - RNA, 23 nt, Artificial Sequence
  RNA Oligomer
ucauggcugugaaauucauggcu

SEQ ID NO: 63486 - RNA, 23 nt, Artificial Sequence
  RNA Oligomer
cauggcugugaaauucauggcug

SEQ ID NO: 63487 - RNA, 23 nt, Artificial Sequence
  RNA Oligomer
auggcugugaaauucauggcugu

SEQ ID NO: 63488 - RNA, 23 nt, Artificial Sequence
  RNA Oligomer
ugagaaagaagcauuucauguuc

SEQ ID NO: 63489 - RNA, 23 nt, Artificial Sequence
  RNA Oligomer
gagaaagaagcauuucauguucu

SEQ ID NO: 63490 - RNA, 23 nt, Artificial Sequence
  RNA Oligomer
agaaagaagcauuucauguucuc

SEQ ID NO: 63491 - RNA, 23 nt, Artificial Sequence
  RNA Oligomer
gaaagaagcauuucauguucucu

SEQ ID NO: 63492 - RNA, 23 nt, Artificial Sequence
  RNA Oligomer
gucguucgagucaauggaguccu

SEQ ID NO: 63493 - RNA, 23 nt, Artificial Sequence
  RNA Oligomer
ucguucgagucaauggaguccug

SEQ ID NO: 63494 - RNA, 23 nt, Artificial Sequence
  RNA Oligomer
cguucgagucaauggaguccugg

SEQ ID NO: 63495 - RNA, 23 nt, Artificial Sequence
  RNA Oligomer
guucgagucaauggaguccuggc

SEQ ID NO: 63496 - RNA, 23 nt, Artificial Sequence
  RNA Oligomer
uucgagucaauggaguccuggcu

SEQ ID NO: 63497 - RNA, 23 nt, Artificial Sequence
  RNA Oligomer
cauccauaucauccaugugguca

SEQ ID NO: 63498 - RNA, 23 nt, Artificial Sequence
  RNA Oligomer
auccauaucauccauguggucau

SEQ ID NO: 63499 - RNA, 23 nt, Artificial Sequence
  RNA Oligomer
auuaauugcuggacaaccguggg

SEQ ID NO: 63500 - RNA, 23 nt, Artificial Sequence
  RNA Oligomer
acaaccagcauaucuucauggcu

SEQ ID NO: 63501 - RNA, 23 nt, Artificial Sequence
  RNA Oligomer
caaccagcauaucuucauggcug

SEQ ID NO: 63502 - RNA, 23 nt, Artificial Sequence
  RNA Oligomer
aaccagcauaucuucauggcugu

SEQ ID NO: 63503 - RNA, 23 nt, Artificial Sequence
  RNA Oligomer
aaaucagugaccaguucaucaga

SEQ ID NO: 63504 - RNA, 23 nt, Artificial Sequence
  RNA Oligomer
aaucagugaccaguucaucagau

SEQ ID NO: 63505 - RNA, 23 nt, Artificial Sequence
  RNA Oligomer
aucagugaccaguucaucagauu

SEQ ID NO: 63506 - RNA, 23 nt, Artificial Sequence
  RNA Oligomer
ucagugaccaguucaucagauuc

SEQ ID NO: 63507 - RNA, 23 nt, Artificial Sequence
  RNA Oligomer
ucagauucaucagaauggugaga

SEQ ID NO: 63508 - RNA, 23 nt, Artificial Sequence
  RNA Oligomer
uguccacauggucaucaucaucu

SEQ ID NO: 63509 - RNA, 23 nt, Artificial Sequence
  RNA Oligomer
guccacauggucaucaucaucuu

SEQ ID NO: 63510 - RNA, 23 nt, Artificial Sequence
  RNA Oligomer
uccacauggucaucaucaucuuc

SEQ ID NO: 63511 - RNA, 23 nt, Artificial Sequence
  RNA Oligomer
ccacauggucaucaucaucuuca

SEQ ID NO: 63512 - RNA, 23 nt, Artificial Sequence
  RNA Oligomer
cacauggucaucaucaucuucau

SEQ ID NO: 63513 - RNA, 23 nt, Artificial Sequence
  RNA Oligomer
aagcugcuuuuccucagaacuuc

SEQ ID NO: 63514 - RNA, 23 nt, Artificial Sequence
  RNA Oligomer
agcugcuuuuccucagaacuucc

SEQ ID NO: 63515 - RNA, 23 nt, Artificial Sequence
  RNA Oligomer
uuaauugcuggacaaccguggga

SEQ ID NO: 63516 - RNA, 23 nt, Artificial Sequence
  RNA Oligomer
uaauugcuggacaaccgugggaa

SEQ ID NO: 63517 - RNA, 23 nt, Artificial Sequence
  RNA Oligomer
aauugcuggacaaccgugggaaa

SEQ ID NO: 63518 - RNA, 23 nt, Artificial Sequence
  RNA Oligomer
cccugaagcuuuuaguuuacagg

SEQ ID NO: 63519 - RNA, 23 nt, Artificial Sequence
  RNA Oligomer
uggcugugaaauucauggcugug

SEQ ID NO: 63520 - RNA, 23 nt, Artificial Sequence
  RNA Oligomer
ggcugacuuuggaaaguuccuga

SEQ ID NO: 63521 - RNA, 23 nt, Artificial Sequence
  RNA Oligomer
gcugacuuuggaaaguuccugac

SEQ ID NO: 63522 - RNA, 23 nt, Artificial Sequence
  RNA Oligomer
cugacuuuggaaaguuccugacu

SEQ ID NO: 63523 - RNA, 23 nt, Artificial Sequence
  RNA Oligomer
ugacuuuggaaaguuccugacua

SEQ ID NO: 63524 - RNA, 23 nt, Artificial Sequence
  RNA Oligomer
gacuuuggaaaguuccugacuau

SEQ ID NO: 63525 - RNA, 23 nt, Artificial Sequence
  RNA Oligomer
ucauaugugucuacuguggggac

SEQ ID NO: 63526 - RNA, 23 nt, Artificial Sequence
  RNA Oligomer
gugggaaaaucagugaccaguuc

SEQ ID NO: 63527 - RNA, 23 nt, Artificial Sequence
  RNA Oligomer
ucaucaucuucaucauccauauc

SEQ ID NO: 63528 - RNA, 23 nt, Artificial Sequence
  RNA Oligomer
gaauuuaaaugcugcugcagaca

SEQ ID NO: 63529 - RNA, 23 nt, Artificial Sequence
  RNA Oligomer
aauuuaaaugcugcugcagacau

SEQ ID NO: 63530 - RNA, 23 nt, Artificial Sequence
  RNA Oligomer
auuuaaaugcugcugcagacauc

SEQ ID NO: 63531 - RNA, 23 nt, Artificial Sequence
  RNA Oligomer
uuuaaaugcugcugcagacaucc

SEQ ID NO: 63532 - RNA, 23 nt, Artificial Sequence
  RNA Oligomer
aucagccuguuuaacugguaugg

SEQ ID NO: 63533 - RNA, 23 nt, Artificial Sequence
  RNA Oligomer
ucagccuguuuaacugguauggc

SEQ ID NO: 63534 - RNA, 23 nt, Artificial Sequence
  RNA Oligomer
acccugaagcuuuuaguuuacag

SEQ ID NO: 63535 - RNA, 23 nt, Artificial Sequence
  RNA Oligomer
aguuuacagggaguuuccaugaa

SEQ ID NO: 63536 - RNA, 23 nt, Artificial Sequence
  RNA Oligomer
guuuacagggaguuuccaugaag

SEQ ID NO: 63537 - RNA, 23 nt, Artificial Sequence
  RNA Oligomer
uuuacagggaguuuccaugaagc

SEQ ID NO: 63538 - RNA, 23 nt, Artificial Sequence
  RNA Oligomer
cggcugacuuuggaaaguuccug

SEQ ID NO: 63539 - RNA, 23 nt, Artificial Sequence
  RNA Oligomer
acuuuggaaaguuccugacuauc

SEQ ID NO: 63540 - RNA, 23 nt, Artificial Sequence
  RNA Oligomer
caucggaaugcucauugcucuca

SEQ ID NO: 63541 - RNA, 23 nt, Artificial Sequence
  RNA Oligomer
aucggaaugcucauugcucucau

SEQ ID NO: 63542 - RNA, 23 nt, Artificial Sequence
  RNA Oligomer
ucggaaugcucauugcucucauc

SEQ ID NO: 63543 - RNA, 23 nt, Artificial Sequence
  RNA Oligomer
cgcuuuccaugugugaggugaug

SEQ ID NO: 63544 - RNA, 23 nt, Artificial Sequence
  RNA Oligomer
gcuuuccaugugugaggugaugu

SEQ ID NO: 63545 - RNA, 23 nt, Artificial Sequence
  RNA Oligomer
cuuuccaugugugaggugauguc

SEQ ID NO: 63546 - RNA, 23 nt, Artificial Sequence
  RNA Oligomer
uagauuuugaccucaguccauaa

SEQ ID NO: 63547 - RNA, 23 nt, Artificial Sequence
  RNA Oligomer
gagugaaaacuucgguugcuggc

SEQ ID NO: 63548 - RNA, 23 nt, Artificial Sequence
  RNA Oligomer
agugaaaacuucgguugcuggca

SEQ ID NO: 63549 - RNA, 23 nt, Artificial Sequence
  RNA Oligomer
gugaaaacuucgguugcuggcag

SEQ ID NO: 63550 - RNA, 23 nt, Artificial Sequence
  RNA Oligomer
ugaaaacuucgguugcuggcagg

SEQ ID NO: 63551 - RNA, 23 nt, Artificial Sequence
  RNA Oligomer
gaaaacuucgguugcuggcaggu

SEQ ID NO: 63552 - RNA, 23 nt, Artificial Sequence
  RNA Oligomer
aaaacuucgguugcuggcagguc

SEQ ID NO: 63553 - RNA, 23 nt, Artificial Sequence
  RNA Oligomer
uccauaucauccauguggucaug

SEQ ID NO: 63554 - RNA, 23 nt, Artificial Sequence
  RNA Oligomer
ccauaucauccauguggucaugg

SEQ ID NO: 63555 - RNA, 23 nt, Artificial Sequence
  RNA Oligomer
cauaucauccauguggucauggc

SEQ ID NO: 63556 - RNA, 23 nt, Artificial Sequence
  RNA Oligomer
auaucauccauguggucauggcu

SEQ ID NO: 63557 - RNA, 23 nt, Artificial Sequence
  RNA Oligomer
cauccauguggucauggcuuucg

SEQ ID NO: 63558 - RNA, 23 nt, Artificial Sequence
  RNA Oligomer
auccauguggucauggcuuucgu

SEQ ID NO: 63559 - RNA, 23 nt, Artificial Sequence
  RNA Oligomer
uccauguggucauggcuuucguu

SEQ ID NO: 63560 - RNA, 23 nt, Artificial Sequence
  RNA Oligomer
ccauguggucauggcuuucguug

SEQ ID NO: 63561 - RNA, 23 nt, Artificial Sequence
  RNA Oligomer
cauguggucauggcuuucguugg

SEQ ID NO: 63562 - RNA, 23 nt, Artificial Sequence
  RNA Oligomer
aaucagccuguuuaacugguaug

SEQ ID NO: 63563 - RNA, 23 nt, Artificial Sequence
  RNA Oligomer
cuucuuccuuacuuuuggggucu

SEQ ID NO: 63564 - RNA, 23 nt, Artificial Sequence
  RNA Oligomer
accagcauaucuucauggcugug

SEQ ID NO: 63565 - RNA, 23 nt, Artificial Sequence
  RNA Oligomer
augugugaggugauguccucguc

SEQ ID NO: 63566 - RNA, 23 nt, Artificial Sequence
  RNA Oligomer
ugugugaggugauguccucgucu

SEQ ID NO: 63567 - RNA, 23 nt, Artificial Sequence
  RNA Oligomer
gugugaggugauguccucgucug

SEQ ID NO: 63568 - RNA, 23 nt, Artificial Sequence
  RNA Oligomer
ugugaggugauguccucgucugu

SEQ ID NO: 63569 - RNA, 23 nt, Artificial Sequence
  RNA Oligomer
gacaacuggagugaaaacuucgg

SEQ ID NO: 63570 - RNA, 23 nt, Artificial Sequence
  RNA Oligomer
acaacuggagugaaaacuucggu

SEQ ID NO: 63571 - RNA, 23 nt, Artificial Sequence
  RNA Oligomer
caacuggagugaaaacuucgguu

SEQ ID NO: 63572 - RNA, 23 nt, Artificial Sequence
  RNA Oligomer
aacuggagugaaaacuucgguug

SEQ ID NO: 63573 - RNA, 23 nt, Artificial Sequence
  RNA Oligomer
acuggagugaaaacuucgguugc

SEQ ID NO: 63574 - RNA, 23 nt, Artificial Sequence
  RNA Oligomer
cuggagugaaaacuucgguugcu

SEQ ID NO: 63575 - RNA, 23 nt, Artificial Sequence
  RNA Oligomer
uggagugaaaacuucgguugcug

SEQ ID NO: 63576 - RNA, 23 nt, Artificial Sequence
  RNA Oligomer
ggagugaaaacuucgguugcugg

SEQ ID NO: 63577 - RNA, 23 nt, Artificial Sequence
  RNA Oligomer
agucguucgagucaauggagucc

SEQ ID NO: 63578 - RNA, 23 nt, Artificial Sequence
  RNA Oligomer
cgagucaauggaguccuggcugu

SEQ ID NO: 63579 - RNA, 23 nt, Artificial Sequence
  RNA Oligomer
gagucaauggaguccuggcuguc

SEQ ID NO: 63580 - RNA, 23 nt, Artificial Sequence
  RNA Oligomer
agucaauggaguccuggcugucc

SEQ ID NO: 63581 - RNA, 23 nt, Artificial Sequence
  RNA Oligomer
gucaauggaguccuggcugucca

SEQ ID NO: 63582 - RNA, 23 nt, Artificial Sequence
  RNA Oligomer
ucaauggaguccuggcuguccac

SEQ ID NO: 63583 - RNA, 23 nt, Artificial Sequence
  RNA Oligomer
acauggucaucaucaucuucauc

SEQ ID NO: 63584 - RNA, 23 nt, Artificial Sequence
  RNA Oligomer
auguggucauggcuuucguugga

SEQ ID NO: 63585 - RNA, 23 nt, Artificial Sequence
  RNA Oligomer
aacugagaaagaagcauuucaug

SEQ ID NO: 63586 - RNA, 23 nt, Artificial Sequence
  RNA Oligomer
caugagaaauacgaaauuucagg

SEQ ID NO: 63587 - RNA, 23 nt, Artificial Sequence
  RNA Oligomer
augagaaauacgaaauuucaggu

SEQ ID NO: 63588 - RNA, 23 nt, Artificial Sequence
  RNA Oligomer
ccagcauaucuucauggcuguga

SEQ ID NO: 63589 - RNA, 23 nt, Artificial Sequence
  RNA Oligomer
cagcauaucuucauggcugugaa

SEQ ID NO: 63590 - RNA, 23 nt, Artificial Sequence
  RNA Oligomer
agcauaucuucauggcugugaaa

SEQ ID NO: 63591 - RNA, 23 nt, Artificial Sequence
  RNA Oligomer
gcauaucuucauggcugugaaau

SEQ ID NO: 63592 - RNA, 23 nt, Artificial Sequence
  RNA Oligomer
cauaucuucauggcugugaaauu

SEQ ID NO: 63593 - RNA, 23 nt, Artificial Sequence
  RNA Oligomer
cuuuggaaaguuccugacuauca

SEQ ID NO: 63594 - RNA, 23 nt, Artificial Sequence
  RNA Oligomer
uuuggaaaguuccugacuaucaa

SEQ ID NO: 63595 - RNA, 23 nt, Artificial Sequence
  RNA Oligomer
uuggaaaguuccugacuaucaau

SEQ ID NO: 63596 - RNA, 23 nt, Artificial Sequence
  RNA Oligomer
gcaaaagcaaaucacugcaauuc

SEQ ID NO: 63597 - RNA, 23 nt, Artificial Sequence
  RNA Oligomer
caaaagcaaaucacugcaauucu

SEQ ID NO: 63598 - RNA, 23 nt, Artificial Sequence
  RNA Oligomer
aaaagcaaaucacugcaauucuc

SEQ ID NO: 63599 - RNA, 23 nt, Artificial Sequence
  RNA Oligomer
ugaggugauguccucgucuguag

SEQ ID NO: 63600 - RNA, 23 nt, Artificial Sequence
  RNA Oligomer
gaggugauguccucgucuguagc

SEQ ID NO: 63601 - RNA, 23 nt, Artificial Sequence
  RNA Oligomer
aggugauguccucgucuguagca

SEQ ID NO: 63602 - RNA, 23 nt, Artificial Sequence
  RNA Oligomer
auucucaugguagugaguuuucc

SEQ ID NO: 63603 - RNA, 23 nt, Artificial Sequence
  RNA Oligomer
uucucaugguagugaguuuuccu

SEQ ID NO: 63604 - RNA, 23 nt, Artificial Sequence
  RNA Oligomer
ggacaacuggagugaaaacuucg

SEQ ID NO: 63605 - RNA, 23 nt, Artificial Sequence
  RNA Oligomer
aaacuucgguugcuggcaggucc

SEQ ID NO: 63606 - RNA, 23 nt, Artificial Sequence
  RNA Oligomer
cagauucaucagaauggugagac

SEQ ID NO: 63607 - RNA, 23 nt, Artificial Sequence
  RNA Oligomer
agauucaucagaauggugagacu

SEQ ID NO: 63608 - RNA, 23 nt, Artificial Sequence
  RNA Oligomer
gauucaucagaauggugagacuc

SEQ ID NO: 63609 - RNA, 23 nt, Artificial Sequence
  RNA Oligomer
ucagaauggugagacucaucaga

SEQ ID NO: 63610 - RNA, 23 nt, Artificial Sequence
  RNA Oligomer
cagaauggugagacucaucagac

SEQ ID NO: 63611 - RNA, 23 nt, Artificial Sequence
  RNA Oligomer
agaauggugagacucaucagacu

SEQ ID NO: 63612 - RNA, 23 nt, Artificial Sequence
  RNA Oligomer
gaauggugagacucaucagacug

SEQ ID NO: 63613 - RNA, 23 nt, Artificial Sequence
  RNA Oligomer
aauggugagacucaucagacugg

SEQ ID NO: 63614 - RNA, 23 nt, Artificial Sequence
  RNA Oligomer
agauuuauucacaccacaaaaag

SEQ ID NO: 63615 - RNA, 23 nt, Artificial Sequence
  RNA Oligomer
gauuuauucacaccacaaaaaga

SEQ ID NO: 63616 - RNA, 23 nt, Artificial Sequence
  RNA Oligomer
uucuuuugacuaaaugcaaagug

SEQ ID NO: 63617 - RNA, 23 nt, Artificial Sequence
  RNA Oligomer
ucagaagaugcacuaucuaauuc

SEQ ID NO: 63618 - RNA, 23 nt, Artificial Sequence
  RNA Oligomer
cagaagaugcacuaucuaauuca

SEQ ID NO: 63619 - RNA, 23 nt, Artificial Sequence
  RNA Oligomer
agaagaugcacuaucuaauucau

SEQ ID NO: 63620 - RNA, 23 nt, Artificial Sequence
  RNA Oligomer
gaagaugcacuaucuaauucaug

SEQ ID NO: 63621 - RNA, 23 nt, Artificial Sequence
  RNA Oligomer
ucaucauuggcuuuccgcuuaua

SEQ ID NO: 63622 - RNA, 23 nt, Artificial Sequence
  RNA Oligomer
caucauuggcuuuccgcuuauau

SEQ ID NO: 63623 - RNA, 23 nt, Artificial Sequence
  RNA Oligomer
aucauuggcuuuccgcuuauaua

SEQ ID NO: 63624 - RNA, 23 nt, Artificial Sequence
  RNA Oligomer
cagcacucuggucauccagcuga

SEQ ID NO: 63625 - RNA, 23 nt, Artificial Sequence
  RNA Oligomer
agcacucuggucauccagcugac

SEQ ID NO: 63626 - RNA, 23 nt, Artificial Sequence
  RNA Oligomer
gcacucuggucauccagcugacu

SEQ ID NO: 63627 - RNA, 23 nt, Artificial Sequence
  RNA Oligomer
cacucuggucauccagcugacuc

SEQ ID NO: 63628 - RNA, 23 nt, Artificial Sequence
  RNA Oligomer
acucuggucauccagcugacucg

SEQ ID NO: 63629 - RNA, 23 nt, Artificial Sequence
  RNA Oligomer
auggugagacucaucagacuggu

SEQ ID NO: 63630 - RNA, 23 nt, Artificial Sequence
  RNA Oligomer
uggugagacucaucagacuggug

SEQ ID NO: 63631 - RNA, 23 nt, Artificial Sequence
  RNA Oligomer
ggugagacucaucagacugguga

SEQ ID NO: 63632 - RNA, 23 nt, Artificial Sequence
  RNA Oligomer
gugagacucaucagacuggugag

SEQ ID NO: 63633 - RNA, 23 nt, Artificial Sequence
  RNA Oligomer
uaucauccauguggucauggcuu

SEQ ID NO: 63634 - RNA, 23 nt, Artificial Sequence
  RNA Oligomer
aucauccauguggucauggcuuu

SEQ ID NO: 63635 - RNA, 23 nt, Artificial Sequence
  RNA Oligomer
ucauccauguggucauggcuuuc

SEQ ID NO: 63636 - RNA, 23 nt, Artificial Sequence
  RNA Oligomer
uuacagggaguuuccaugaagcc

SEQ ID NO: 63637 - RNA, 23 nt, Artificial Sequence
  RNA Oligomer
uacagggaguuuccaugaagcca

SEQ ID NO: 63638 - RNA, 23 nt, Artificial Sequence
  RNA Oligomer
cggaaugcucauugcucucauca

SEQ ID NO: 63639 - RNA, 23 nt, Artificial Sequence
  RNA Oligomer
ggaaugcucauugcucucaucau

SEQ ID NO: 63640 - RNA, 23 nt, Artificial Sequence
  RNA Oligomer
gaaugcucauugcucucaucauu

SEQ ID NO: 63641 - RNA, 23 nt, Artificial Sequence
  RNA Oligomer
aaugcucauugcucucaucauug

SEQ ID NO: 63642 - RNA, 23 nt, Artificial Sequence
  RNA Oligomer
uggguuucagcacucuggucauc

SEQ ID NO: 63643 - RNA, 23 nt, Artificial Sequence
  RNA Oligomer
ggguuucagcacucuggucaucc

SEQ ID NO: 63644 - RNA, 23 nt, Artificial Sequence
  RNA Oligomer
gguuucagcacucuggucaucca

SEQ ID NO: 63645 - RNA, 23 nt, Artificial Sequence
  RNA Oligomer
guuucagcacucuggucauccag

SEQ ID NO: 63646 - RNA, 23 nt, Artificial Sequence
  RNA Oligomer
uuucagcacucuggucauccagc

SEQ ID NO: 63647 - RNA, 23 nt, Artificial Sequence
  RNA Oligomer
ccucggccaucauaugugucuac

SEQ ID NO: 63648 - RNA, 23 nt, Artificial Sequence
  RNA Oligomer
cucggccaucauaugugucuacu

SEQ ID NO: 63649 - RNA, 23 nt, Artificial Sequence
  RNA Oligomer
ucggccaucauaugugucuacug

SEQ ID NO: 63650 - RNA, 23 nt, Artificial Sequence
  RNA Oligomer
uguggucauggcuuucguuggac

SEQ ID NO: 63651 - RNA, 23 nt, Artificial Sequence
  RNA Oligomer
guggucauggcuuucguuggacu

SEQ ID NO: 63652 - RNA, 23 nt, Artificial Sequence
  RNA Oligomer
uggucauggcuuucguuggacuu

SEQ ID NO: 63653 - RNA, 23 nt, Artificial Sequence
  RNA Oligomer
uucagcacucuggucauccagcu

SEQ ID NO: 63654 - RNA, 23 nt, Artificial Sequence
  RNA Oligomer
cuccucgcuuuccaugugugagg

SEQ ID NO: 63655 - RNA, 23 nt, Artificial Sequence
  RNA Oligomer
uccucgcuuuccaugugugaggu

SEQ ID NO: 63656 - RNA, 23 nt, Artificial Sequence
  RNA Oligomer
ccucgcuuuccaugugugaggug

SEQ ID NO: 63657 - RNA, 23 nt, Artificial Sequence
  RNA Oligomer
cucgcuuuccaugugugagguga

SEQ ID NO: 63658 - RNA, 23 nt, Artificial Sequence
  RNA Oligomer
ucgcuuuccaugugugaggugau

SEQ ID NO: 63659 - RNA, 23 nt, Artificial Sequence
  RNA Oligomer
cgucuguagcaucaggguacugg

SEQ ID NO: 63660 - RNA, 23 nt, Artificial Sequence
  RNA Oligomer
gucuguagcaucaggguacugga

SEQ ID NO: 63661 - RNA, 23 nt, Artificial Sequence
  RNA Oligomer
ucuguagcaucaggguacuggau

SEQ ID NO: 63662 - RNA, 23 nt, Artificial Sequence
  RNA Oligomer
cuguagcaucaggguacuggaug

SEQ ID NO: 63663 - RNA, 23 nt, Artificial Sequence
  RNA Oligomer
uguagcaucaggguacuggaugu

SEQ ID NO: 63664 - RNA, 23 nt, Artificial Sequence
  RNA Oligomer
cauaugugucuacuguggggaca

SEQ ID NO: 63665 - RNA, 23 nt, Artificial Sequence
  RNA Oligomer
gggacaacuggagugaaaacuuc

SEQ ID NO: 63666 - RNA, 23 nt, Artificial Sequence
  RNA Oligomer
ucgagucaauggaguccuggcug

SEQ ID NO: 63667 - RNA, 23 nt, Artificial Sequence
  RNA Oligomer
gaacuuccagaaucagccuguuu

SEQ ID NO: 63668 - RNA, 23 nt, Artificial Sequence
  RNA Oligomer
aacuuccagaaucagccuguuua

SEQ ID NO: 63669 - RNA, 23 nt, Artificial Sequence
  RNA Oligomer
ugccuaggaggcaaaagcaaauc

SEQ ID NO: 63670 - RNA, 23 nt, Artificial Sequence
  RNA Oligomer
gccuaggaggcaaaagcaaauca

SEQ ID NO: 63671 - RNA, 23 nt, Artificial Sequence
  RNA Oligomer
ccuaggaggcaaaagcaaaucac

SEQ ID NO: 63672 - RNA, 23 nt, Artificial Sequence
  RNA Oligomer
cuaggaggcaaaagcaaaucacu

SEQ ID NO: 63673 - RNA, 23 nt, Artificial Sequence
  RNA Oligomer
uaggaggcaaaagcaaaucacug

SEQ ID NO: 63674 - RNA, 23 nt, Artificial Sequence
  RNA Oligomer
auaucuucauggcugugaaauuc

SEQ ID NO: 63675 - RNA, 23 nt, Artificial Sequence
  RNA Oligomer
ugaaauucauggcuguggaauuc

SEQ ID NO: 63676 - RNA, 23 nt, Artificial Sequence
  RNA Oligomer
gaaauucauggcuguggaauuca

SEQ ID NO: 63677 - RNA, 23 nt, Artificial Sequence
  RNA Oligomer
aaauucauggcuguggaauucac

SEQ ID NO: 63678 - RNA, 23 nt, Artificial Sequence
  RNA Oligomer
aauucauggcuguggaauucacg

SEQ ID NO: 63679 - RNA, 23 nt, Artificial Sequence
  RNA Oligomer
auucauggcuguggaauucacgg

SEQ ID NO: 63680 - RNA, 23 nt, Artificial Sequence
  RNA Oligomer
acuccucgcuuuccaugugugag

SEQ ID NO: 63681 - RNA, 23 nt, Artificial Sequence
  RNA Oligomer
caucagacuggugagaaucauca

SEQ ID NO: 63682 - RNA, 23 nt, Artificial Sequence
  RNA Oligomer
aucagacuggugagaaucaucag

SEQ ID NO: 63683 - RNA, 23 nt, Artificial Sequence
  RNA Oligomer
ucagacuggugagaaucaucagu

SEQ ID NO: 63684 - RNA, 23 nt, Artificial Sequence
  RNA Oligomer
cagacuggugagaaucaucagug

SEQ ID NO: 63685 - RNA, 23 nt, Artificial Sequence
  RNA Oligomer
agacuggugagaaucaucagugu

SEQ ID NO: 63686 - RNA, 23 nt, Artificial Sequence
  RNA Oligomer
gacuggugagaaucaucaguguc

SEQ ID NO: 63687 - RNA, 23 nt, Artificial Sequence
  RNA Oligomer
acuggugagaaucaucaguguca

SEQ ID NO: 63688 - RNA, 23 nt, Artificial Sequence
  RNA Oligomer
cuggugagaaucaucagugucau

SEQ ID NO: 63689 - RNA, 23 nt, Artificial Sequence
  RNA Oligomer
uggugagaaucaucagugucauc

SEQ ID NO: 63690 - RNA, 23 nt, Artificial Sequence
  RNA Oligomer
ggucauggcuuucguuggacuua

SEQ ID NO: 63691 - RNA, 23 nt, Artificial Sequence
  RNA Oligomer
auucacggcugacuuuggaaagu

SEQ ID NO: 63692 - RNA, 23 nt, Artificial Sequence
  RNA Oligomer
guggcuguggguuucagcacucu

SEQ ID NO: 63693 - RNA, 23 nt, Artificial Sequence
  RNA Oligomer
uggcuguggguuucagcacucug

SEQ ID NO: 63694 - RNA, 23 nt, Artificial Sequence
  RNA Oligomer
ggcuguggguuucagcacucugg

SEQ ID NO: 63695 - RNA, 23 nt, Artificial Sequence
  RNA Oligomer
gcuguggguuucagcacucuggu

SEQ ID NO: 63696 - RNA, 23 nt, Artificial Sequence
  RNA Oligomer
cuguggguuucagcacucugguc

SEQ ID NO: 63697 - RNA, 23 nt, Artificial Sequence
  RNA Oligomer
acugcaauucucaugguagugag

SEQ ID NO: 63698 - RNA, 23 nt, Artificial Sequence
  RNA Oligomer
cugcaauucucaugguagugagu

SEQ ID NO: 63699 - RNA, 23 nt, Artificial Sequence
  RNA Oligomer
ugcaauucucaugguagugaguu

SEQ ID NO: 63700 - RNA, 23 nt, Artificial Sequence
  RNA Oligomer
gcaauucucaugguagugaguuu

SEQ ID NO: 63701 - RNA, 23 nt, Artificial Sequence
  RNA Oligomer
caauucucaugguagugaguuuu

SEQ ID NO: 63702 - RNA, 23 nt, Artificial Sequence
  RNA Oligomer
ugagacucaucagacuggugaga

SEQ ID NO: 63703 - RNA, 23 nt, Artificial Sequence
  RNA Oligomer
gagacucaucagacuggugagaa

SEQ ID NO: 63704 - RNA, 23 nt, Artificial Sequence
  RNA Oligomer
agacucaucagacuggugagaau

SEQ ID NO: 63705 - RNA, 23 nt, Artificial Sequence
  RNA Oligomer
gacaaccgugggaaaacaaauaa

SEQ ID NO: 63706 - RNA, 23 nt, Artificial Sequence
  RNA Oligomer
acaaccgugggaaaacaaauaag

SEQ ID NO: 63707 - RNA, 23 nt, Artificial Sequence
  RNA Oligomer
caaccgugggaaaacaaauaagc

SEQ ID NO: 63708 - RNA, 23 nt, Artificial Sequence
  RNA Oligomer
aaccgugggaaaacaaauaagca

SEQ ID NO: 63709 - RNA, 23 nt, Artificial Sequence
  RNA Oligomer
accgugggaaaacaaauaagcaa

SEQ ID NO: 63710 - RNA, 23 nt, Artificial Sequence
  RNA Oligomer
aggaggcaaaagcaaaucacugc

SEQ ID NO: 63711 - RNA, 23 nt, Artificial Sequence
  RNA Oligomer
ggaggcaaaagcaaaucacugca

SEQ ID NO: 63712 - RNA, 23 nt, Artificial Sequence
  RNA Oligomer
gaggcaaaagcaaaucacugcaa

SEQ ID NO: 63713 - RNA, 23 nt, Artificial Sequence
  RNA Oligomer
aggcaaaagcaaaucacugcaau

SEQ ID NO: 63714 - RNA, 23 nt, Artificial Sequence
  RNA Oligomer
ggcaaaagcaaaucacugcaauu

SEQ ID NO: 63715 - RNA, 23 nt, Artificial Sequence
  RNA Oligomer
cugcuuguggcuguggguuucag

SEQ ID NO: 63716 - RNA, 23 nt, Artificial Sequence
  RNA Oligomer
ugcuuguggcuguggguuucagc

SEQ ID NO: 63717 - RNA, 23 nt, Artificial Sequence
  RNA Oligomer
gcuuguggcuguggguuucagca

SEQ ID NO: 63718 - RNA, 23 nt, Artificial Sequence
  RNA Oligomer
cuuguggcuguggguuucagcac

SEQ ID NO: 63719 - RNA, 23 nt, Artificial Sequence
  RNA Oligomer
uuguggcuguggguuucagcacu

SEQ ID NO: 63720 - RNA, 23 nt, Artificial Sequence
  RNA Oligomer
ccucgucuguagcaucaggguac

SEQ ID NO: 63721 - RNA, 23 nt, Artificial Sequence
  RNA Oligomer
cucgucuguagcaucaggguacu

SEQ ID NO: 63722 - RNA, 23 nt, Artificial Sequence
  RNA Oligomer
ucgucuguagcaucaggguacug

SEQ ID NO: 63723 - RNA, 23 nt, Artificial Sequence
  RNA Oligomer
uagcaucaggguacuggauguca

SEQ ID NO: 63724 - RNA, 23 nt, Artificial Sequence
  RNA Oligomer
agcaucaggguacuggaugucag

SEQ ID NO: 63725 - RNA, 23 nt, Artificial Sequence
  RNA Oligomer
gcaucaggguacuggaugucagg

SEQ ID NO: 63726 - RNA, 23 nt, Artificial Sequence
  RNA Oligomer
caucaggguacuggaugucaggu

SEQ ID NO: 63727 - RNA, 23 nt, Artificial Sequence
  RNA Oligomer
aucaggguacuggaugucagguc

SEQ ID NO: 63728 - RNA, 23 nt, Artificial Sequence
  RNA Oligomer
acucaucagacuggugagaauca

SEQ ID NO: 63729 - RNA, 23 nt, Artificial Sequence
  RNA Oligomer
cucaucagacuggugagaaucau

SEQ ID NO: 63730 - RNA, 23 nt, Artificial Sequence
  RNA Oligomer
ucaucagacuggugagaaucauc

SEQ ID NO: 63731 - RNA, 23 nt, Artificial Sequence
  RNA Oligomer
ucaucagagucguucgagucaau

SEQ ID NO: 63732 - RNA, 23 nt, Artificial Sequence
  RNA Oligomer
caucagagucguucgagucaaug

SEQ ID NO: 63733 - RNA, 23 nt, Artificial Sequence
  RNA Oligomer
aucagagucguucgagucaaugg

SEQ ID NO: 63734 - RNA, 23 nt, Artificial Sequence
  RNA Oligomer
acuuccagaaucagccuguuuaa

SEQ ID NO: 63735 - RNA, 23 nt, Artificial Sequence
  RNA Oligomer
ggcugugaaauucauggcugugg

SEQ ID NO: 63736 - RNA, 23 nt, Artificial Sequence
  RNA Oligomer
gcugugaaauucauggcugugga

SEQ ID NO: 63737 - RNA, 23 nt, Artificial Sequence
  RNA Oligomer
cugugaaauucauggcuguggaa

SEQ ID NO: 63738 - RNA, 23 nt, Artificial Sequence
  RNA Oligomer
uucauggcuguggaauucacggc

SEQ ID NO: 63739 - RNA, 23 nt, Artificial Sequence
  RNA Oligomer
guagcaucaggguacuggauguc

SEQ ID NO: 63740 - RNA, 23 nt, Artificial Sequence
  RNA Oligomer
cagguccgugggaaaaucaguga

SEQ ID NO: 63741 - RNA, 23 nt, Artificial Sequence
  RNA Oligomer
agguccgugggaaaaucagugac

SEQ ID NO: 63742 - RNA, 23 nt, Artificial Sequence
  RNA Oligomer
gguccgugggaaaaucagugacc

SEQ ID NO: 63743 - RNA, 23 nt, Artificial Sequence
  RNA Oligomer
guccgugggaaaaucagugacca

SEQ ID NO: 63744 - RNA, 23 nt, Artificial Sequence
  RNA Oligomer
uccgugggaaaaucagugaccag

SEQ ID NO: 63745 - RNA, 23 nt, Artificial Sequence
  RNA Oligomer
ucagagucguucgagucaaugga

SEQ ID NO: 63746 - RNA, 23 nt, Artificial Sequence
  RNA Oligomer
cagagucguucgagucaauggag

SEQ ID NO: 63747 - RNA, 23 nt, Artificial Sequence
  RNA Oligomer
agagucguucgagucaauggagu

SEQ ID NO: 63748 - RNA, 23 nt, Artificial Sequence
  RNA Oligomer
gagucguucgagucaauggaguc

SEQ ID NO: 63749 - RNA, 23 nt, Artificial Sequence
  RNA Oligomer
auuucuauucaugagagaauaac

SEQ ID NO: 63750 - RNA, 23 nt, Artificial Sequence
  RNA Oligomer
uuucuauucaugagagaauaaca

SEQ ID NO: 63751 - RNA, 23 nt, Artificial Sequence
  RNA Oligomer
uucuauucaugagagaauaacaa

SEQ ID NO: 63752 - RNA, 23 nt, Artificial Sequence
  RNA Oligomer
ucuauucaugagagaauaacaaa

SEQ ID NO: 63753 - RNA, 23 nt, Artificial Sequence
  RNA Oligomer
cuauucaugagagaauaacaaau

SEQ ID NO: 63754 - RNA, 23 nt, Artificial Sequence
  RNA Oligomer
ggugaugccuaggaggcaaaagc

SEQ ID NO: 63755 - RNA, 23 nt, Artificial Sequence
  RNA Oligomer
gugaugccuaggaggcaaaagca

SEQ ID NO: 63756 - RNA, 23 nt, Artificial Sequence
  RNA Oligomer
ugaugccuaggaggcaaaagcaa

SEQ ID NO: 63757 - RNA, 23 nt, Artificial Sequence
  RNA Oligomer
gaugccuaggaggcaaaagcaaa

SEQ ID NO: 63758 - RNA, 23 nt, Artificial Sequence
  RNA Oligomer
augccuaggaggcaaaagcaaau

SEQ ID NO: 63759 - RNA, 23 nt, Artificial Sequence
  RNA Oligomer
uuuucuuuugacuaaaugcaaag

SEQ ID NO: 63760 - RNA, 23 nt, Artificial Sequence
  RNA Oligomer
uuucuuuugacuaaaugcaaagu

SEQ ID NO: 63761 - RNA, 23 nt, Artificial Sequence
  RNA Oligomer
ucauggcuguggaauucacggcu

SEQ ID NO: 63762 - RNA, 23 nt, Artificial Sequence
  RNA Oligomer
cauggcuguggaauucacggcug

SEQ ID NO: 63763 - RNA, 23 nt, Artificial Sequence
  RNA Oligomer
auggcuguggaauucacggcuga

SEQ ID NO: 63764 - RNA, 23 nt, Artificial Sequence
  RNA Oligomer
cauaacuguccuucccacggcug

SEQ ID NO: 63765 - RNA, 23 nt, Artificial Sequence
  RNA Oligomer
auaacuguccuucccacggcugu

SEQ ID NO: 63766 - RNA, 23 nt, Artificial Sequence
  RNA Oligomer
acagggaguuuccaugaagccac

SEQ ID NO: 63767 - RNA, 23 nt, Artificial Sequence
  RNA Oligomer
cagggaguuuccaugaagccaca

SEQ ID NO: 63768 - RNA, 23 nt, Artificial Sequence
  RNA Oligomer
agggaguuuccaugaagccacaa

SEQ ID NO: 63769 - RNA, 23 nt, Artificial Sequence
  RNA Oligomer
uuaaaugcugcugcagacauccu

SEQ ID NO: 63770 - RNA, 23 nt, Artificial Sequence
  RNA Oligomer
uaaaugcugcugcagacauccuc

SEQ ID NO: 63771 - RNA, 23 nt, Artificial Sequence
  RNA Oligomer
aaaugcugcugcagacauccucc

SEQ ID NO: 63772 - RNA, 23 nt, Artificial Sequence
  RNA Oligomer
aaugcugcugcagacauccucca

SEQ ID NO: 63773 - RNA, 23 nt, Artificial Sequence
  RNA Oligomer
gcagguccgugggaaaaucagug

SEQ ID NO: 63774 - RNA, 23 nt, Artificial Sequence
  RNA Oligomer
ggcguuuggcugagaaggcugca

SEQ ID NO: 63775 - RNA, 23 nt, Artificial Sequence
  RNA Oligomer
gcguuuggcugagaaggcugcaa

SEQ ID NO: 63776 - RNA, 23 nt, Artificial Sequence
  RNA Oligomer
cguuuggcugagaaggcugcaac

SEQ ID NO: 63777 - RNA, 23 nt, Artificial Sequence
  RNA Oligomer
guuuggcugagaaggcugcaacu

SEQ ID NO: 63778 - RNA, 23 nt, Artificial Sequence
  RNA Oligomer
uuuggcugagaaggcugcaacug

SEQ ID NO: 63779 - RNA, 23 nt, Artificial Sequence
  RNA Oligomer
ccgugggaaaacaaauaagcaau

SEQ ID NO: 63780 - RNA, 23 nt, Artificial Sequence
  RNA Oligomer
cgugggaaaacaaauaagcaauu

SEQ ID NO: 63781 - RNA, 23 nt, Artificial Sequence
  RNA Oligomer
aauucucaugguagugaguuuuc

SEQ ID NO: 63782 - RNA, 23 nt, Artificial Sequence
  RNA Oligomer
uaucuucauggcugugaaauuca

SEQ ID NO: 63783 - RNA, 23 nt, Artificial Sequence
  RNA Oligomer
aucuucauggcugugaaauucau

SEQ ID NO: 63784 - RNA, 23 nt, Artificial Sequence
  RNA Oligomer
ucuucauggcugugaaauucaug

SEQ ID NO: 63785 - RNA, 23 nt, Artificial Sequence
  RNA Oligomer
auuuugaccucaguccauaaacc

SEQ ID NO: 63786 - RNA, 23 nt, Artificial Sequence
  RNA Oligomer
uuuugaccucaguccauaaacca

SEQ ID NO: 63787 - RNA, 23 nt, Artificial Sequence
  RNA Oligomer
uuugaccucaguccauaaaccac

SEQ ID NO: 63788 - RNA, 23 nt, Artificial Sequence
  RNA Oligomer
uugaccucaguccauaaaccaca

SEQ ID NO: 63789 - RNA, 23 nt, Artificial Sequence
  RNA Oligomer
acugagaaagaagcauuucaugu

SEQ ID NO: 63790 - RNA, 23 nt, Artificial Sequence
  RNA Oligomer
cugagaaagaagcauuucauguu

SEQ ID NO: 63791 - RNA, 23 nt, Artificial Sequence
  RNA Oligomer
ugugaaauucauggcuguggaau

SEQ ID NO: 63792 - RNA, 23 nt, Artificial Sequence
  RNA Oligomer
gugaaauucauggcuguggaauu

SEQ ID NO: 63793 - RNA, 23 nt, Artificial Sequence
  RNA Oligomer
aucuggacugcuuguggcugugg

SEQ ID NO: 63794 - RNA, 23 nt, Artificial Sequence
  RNA Oligomer
ucugcgaaacuucuuagauuuug

SEQ ID NO: 63795 - RNA, 23 nt, Artificial Sequence
  RNA Oligomer
cugcgaaacuucuuagauuuuga

SEQ ID NO: 63796 - RNA, 23 nt, Artificial Sequence
  RNA Oligomer
ugcgaaacuucuuagauuuugac

SEQ ID NO: 63797 - RNA, 23 nt, Artificial Sequence
  RNA Oligomer
cugguauggcacaggugaugccu

SEQ ID NO: 63798 - RNA, 23 nt, Artificial Sequence
  RNA Oligomer
ugguauggcacaggugaugccua

SEQ ID NO: 63799 - RNA, 23 nt, Artificial Sequence
  RNA Oligomer
gguauggcacaggugaugccuag

SEQ ID NO: 63800 - RNA, 23 nt, Artificial Sequence
  RNA Oligomer
guauggcacaggugaugccuagg

SEQ ID NO: 63801 - RNA, 23 nt, Artificial Sequence
  RNA Oligomer
uauggcacaggugaugccuagga

SEQ ID NO: 63802 - RNA, 23 nt, Artificial Sequence
  RNA Oligomer
ugaccucagaagaugcacuaucu

SEQ ID NO: 63803 - RNA, 23 nt, Artificial Sequence
  RNA Oligomer
gaccucagaagaugcacuaucua

SEQ ID NO: 63804 - RNA, 23 nt, Artificial Sequence
  RNA Oligomer
accucagaagaugcacuaucuaa

SEQ ID NO: 63805 - RNA, 23 nt, Artificial Sequence
  RNA Oligomer
ccucagaagaugcacuaucuaau

SEQ ID NO: 63806 - RNA, 23 nt, Artificial Sequence
  RNA Oligomer
cucagaagaugcacuaucuaauu

SEQ ID NO: 63807 - RNA, 23 nt, Artificial Sequence
  RNA Oligomer
agccuguuuaacugguauggcac

SEQ ID NO: 63808 - RNA, 23 nt, Artificial Sequence
  RNA Oligomer
gccuguuuaacugguauggcaca

SEQ ID NO: 63809 - RNA, 23 nt, Artificial Sequence
  RNA Oligomer
ccuguuuaacugguauggcacag

SEQ ID NO: 63810 - RNA, 23 nt, Artificial Sequence
  RNA Oligomer
cuguuuaacugguauggcacagg

SEQ ID NO: 63811 - RNA, 23 nt, Artificial Sequence
  RNA Oligomer
uguuuaacugguauggcacaggu

SEQ ID NO: 63812 - RNA, 23 nt, Artificial Sequence
  RNA Oligomer
gguuauguuuuauuaauugcugg

SEQ ID NO: 63813 - RNA, 23 nt, Artificial Sequence
  RNA Oligomer
gaugucaggucugcgaaacuucu

SEQ ID NO: 63814 - RNA, 23 nt, Artificial Sequence
  RNA Oligomer
gaaaacaaauaagcaauugacac

SEQ ID NO: 63815 - RNA, 23 nt, Artificial Sequence
  RNA Oligomer
uugacaccaccaaauucuuauua

SEQ ID NO: 63816 - RNA, 23 nt, Artificial Sequence
  RNA Oligomer
ugggaaaacaaauaagcaauuga

SEQ ID NO: 63817 - RNA, 23 nt, Artificial Sequence
  RNA Oligomer
gugggaaaacaaauaagcaauug

SEQ ID NO: 63818 - RNA, 23 nt, Artificial Sequence
  RNA Oligomer
gccacaaacuaaacuaauuauca

SEQ ID NO: 63819 - RNA, 23 nt, Artificial Sequence
  RNA Oligomer
ucaguccauaaaccacacuauca

SEQ ID NO: 63820 - RNA, 23 nt, Artificial Sequence
  RNA Oligomer
uccaugaagccacaaacuaaacu

SEQ ID NO: 63821 - RNA, 23 nt, Artificial Sequence
  RNA Oligomer
aacccugaagcuuuuaguuuaca

SEQ ID NO: 63822 - RNA, 23 nt, Artificial Sequence
  RNA Oligomer
ucucuuucauuuugcuauaaagc

SEQ ID NO: 63823 - RNA, 23 nt, Artificial Sequence
  RNA Oligomer
cucuuucauuuugcuauaaagca

SEQ ID NO: 63824 - RNA, 23 nt, Artificial Sequence
  RNA Oligomer
aacugguauggcacaggugaugc

SEQ ID NO: 63825 - RNA, 23 nt, Artificial Sequence
  RNA Oligomer
ucaugagaaauacgaaauuucag

SEQ ID NO: 63826 - RNA, 23 nt, Artificial Sequence
  RNA Oligomer
cuucuauagaaugaacauagaca

SEQ ID NO: 63827 - RNA, 23 nt, Artificial Sequence
  RNA Oligomer
cacugcaauucucaugguaguga

SEQ ID NO: 63828 - RNA, 23 nt, Artificial Sequence
  RNA Oligomer
gauggccuuguaugcaccauuca

SEQ ID NO: 63829 - RNA, 23 nt, Artificial Sequence
  RNA Oligomer
auggccuuguaugcaccauucaa

SEQ ID NO: 63830 - RNA, 23 nt, Artificial Sequence
  RNA Oligomer
ucuucuauagaaugaacauagac

SEQ ID NO: 63831 - RNA, 23 nt, Artificial Sequence
  RNA Oligomer
gugagaaauuguauuuuuucucc

SEQ ID NO: 63832 - RNA, 23 nt, Artificial Sequence
  RNA Oligomer
uggguaaaaguauuuuguuugcu

SEQ ID NO: 63833 - RNA, 23 nt, Artificial Sequence
  RNA Oligomer
cuaucuaauucaugagaaauacg

SEQ ID NO: 63834 - RNA, 23 nt, Artificial Sequence
  RNA Oligomer
cacggcugacuuuggaaaguucc

SEQ ID NO: 63835 - RNA, 23 nt, Artificial Sequence
  RNA Oligomer
acggcugacuuuggaaaguuccu

SEQ ID NO: 63836 - RNA, 23 nt, Artificial Sequence
  RNA Oligomer
ucacggcugacuuuggaaaguuc

SEQ ID NO: 63837 - RNA, 23 nt, Artificial Sequence
  RNA Oligomer
ccacaguguuugagaacuaugug

SEQ ID NO: 63838 - RNA, 23 nt, Artificial Sequence
  RNA Oligomer
cccacaguguuugagaacuaugu

SEQ ID NO: 63839 - RNA, 23 nt, Artificial Sequence
  RNA Oligomer
gcccacaguguuugagaacuaug

SEQ ID NO: 63840 - RNA, 23 nt, Artificial Sequence
  RNA Oligomer
ugcccacaguguuugagaacuau

SEQ ID NO: 63841 - RNA, 23 nt, Artificial Sequence
  RNA Oligomer
gugcccacaguguuugagaacua

SEQ ID NO: 63842 - RNA, 23 nt, Artificial Sequence
  RNA Oligomer
ggccuuuuucauuuaucuauaau

SEQ ID NO: 63843 - RNA, 23 nt, Artificial Sequence
  RNA Oligomer
uggccuuuuucauuuaucuauaa

SEQ ID NO: 63844 - RNA, 23 nt, Artificial Sequence
  RNA Oligomer
cuggccuuuuucauuuaucuaua

SEQ ID NO: 63845 - RNA, 23 nt, Artificial Sequence
  RNA Oligomer
acuggccuuuuucauuuaucuau

SEQ ID NO: 63846 - RNA, 23 nt, Artificial Sequence
  RNA Oligomer
uacuggccuuuuucauuuaucua

SEQ ID NO: 63847 - RNA, 23 nt, Artificial Sequence
  RNA Oligomer
gggcaguuuuuugaaaaugggcu

SEQ ID NO: 63848 - RNA, 23 nt, Artificial Sequence
  RNA Oligomer
ugggcaguuuuuugaaaaugggc

SEQ ID NO: 63849 - RNA, 23 nt, Artificial Sequence
  RNA Oligomer
gugggcaguuuuuugaaaauggg

SEQ ID NO: 63850 - RNA, 23 nt, Artificial Sequence
  RNA Oligomer
ggugggcaguuuuuugaaaaugg

SEQ ID NO: 63851 - RNA, 23 nt, Artificial Sequence
  RNA Oligomer
gggugggcaguuuuuugaaaaug

SEQ ID NO: 63852 - RNA, 23 nt, Artificial Sequence
  RNA Oligomer
ccuuuugacacugcucuaacagc

SEQ ID NO: 63853 - RNA, 23 nt, Artificial Sequence
  RNA Oligomer
uccuuuugacacugcucuaacag

SEQ ID NO: 63854 - RNA, 23 nt, Artificial Sequence
  RNA Oligomer
guccuuuugacacugcucuaaca

SEQ ID NO: 63855 - RNA, 23 nt, Artificial Sequence
  RNA Oligomer
gguccuuuugacacugcucuaac

SEQ ID NO: 63856 - RNA, 23 nt, Artificial Sequence
  RNA Oligomer
ggguccuuuugacacugcucuaa

SEQ ID NO: 63857 - RNA, 23 nt, Artificial Sequence
  RNA Oligomer
uuacuggccuuuuucauuuaucu

SEQ ID NO: 63858 - RNA, 23 nt, Artificial Sequence
  RNA Oligomer
auuacuggccuuuuucauuuauc

SEQ ID NO: 63859 - RNA, 23 nt, Artificial Sequence
  RNA Oligomer
gauuacuggccuuuuucauuuau

SEQ ID NO: 63860 - RNA, 23 nt, Artificial Sequence
  RNA Oligomer
ggggugggcaguuuuuugaaaau

SEQ ID NO: 63861 - RNA, 23 nt, Artificial Sequence
  RNA Oligomer
ccaacuaugauuauuaacgaugu

SEQ ID NO: 63862 - RNA, 23 nt, Artificial Sequence
  RNA Oligomer
gccaacuaugauuauuaacgaug

SEQ ID NO: 63863 - RNA, 23 nt, Artificial Sequence
  RNA Oligomer
agccaacuaugauuauuaacgau

SEQ ID NO: 63864 - RNA, 23 nt, Artificial Sequence
  RNA Oligomer
aagccaacuaugauuauuaacga

SEQ ID NO: 63865 - RNA, 23 nt, Artificial Sequence
  RNA Oligomer
gaagccaacuaugauuauuaacg

SEQ ID NO: 63866 - RNA, 23 nt, Artificial Sequence
  RNA Oligomer
ugagagagguuuuugaaauggcu

SEQ ID NO: 63867 - RNA, 23 nt, Artificial Sequence
  RNA Oligomer
gugagagagguuuuugaaauggc

SEQ ID NO: 63868 - RNA, 23 nt, Artificial Sequence
  RNA Oligomer
agugagagagguuuuugaaaugg

SEQ ID NO: 63869 - RNA, 23 nt, Artificial Sequence
  RNA Oligomer
gagugagagagguuuuugaaaug

SEQ ID NO: 63870 - RNA, 23 nt, Artificial Sequence
  RNA Oligomer
ggagugagagagguuuuugaaau

SEQ ID NO: 63871 - RNA, 23 nt, Artificial Sequence
  RNA Oligomer
ggcuaaguaaauaggaauugguu

SEQ ID NO: 63872 - RNA, 23 nt, Artificial Sequence
  RNA Oligomer
gggcuaaguaaauaggaauuggu

SEQ ID NO: 63873 - RNA, 23 nt, Artificial Sequence
  RNA Oligomer
ugggcuaaguaaauaggaauugg

SEQ ID NO: 63874 - RNA, 23 nt, Artificial Sequence
  RNA Oligomer
cugggcuaaguaaauaggaauug

SEQ ID NO: 63875 - RNA, 23 nt, Artificial Sequence
  RNA Oligomer
gcugggcuaaguaaauaggaauu

SEQ ID NO: 63876 - RNA, 23 nt, Artificial Sequence
  RNA Oligomer
ggaaagacaugcuugcucauagu

SEQ ID NO: 63877 - RNA, 23 nt, Artificial Sequence
  RNA Oligomer
uggaaagacaugcuugcucauag

SEQ ID NO: 63878 - RNA, 23 nt, Artificial Sequence
  RNA Oligomer
guggaaagacaugcuugcucaua

SEQ ID NO: 63879 - RNA, 23 nt, Artificial Sequence
  RNA Oligomer
uguggaaagacaugcuugcucau

SEQ ID NO: 63880 - RNA, 23 nt, Artificial Sequence
  RNA Oligomer
cuguggaaagacaugcuugcuca

SEQ ID NO: 63881 - RNA, 23 nt, Artificial Sequence
  RNA Oligomer
ccuguggaaagacaugcuugcuc

SEQ ID NO: 63882 - RNA, 23 nt, Artificial Sequence
  RNA Oligomer
gccuguggaaagacaugcuugcu

SEQ ID NO: 63883 - RNA, 23 nt, Artificial Sequence
  RNA Oligomer
agccuguggaaagacaugcuugc

SEQ ID NO: 63884 - RNA, 23 nt, Artificial Sequence
  RNA Oligomer
gagccuguggaaagacaugcuug

SEQ ID NO: 63885 - RNA, 23 nt, Artificial Sequence
  RNA Oligomer
ggagccuguggaaagacaugcuu

SEQ ID NO: 63886 - RNA, 23 nt, Artificial Sequence
  RNA Oligomer
ugauuauuaacgauguccaaccc

SEQ ID NO: 63887 - RNA, 23 nt, Artificial Sequence
  RNA Oligomer
augauuauuaacgauguccaacc

SEQ ID NO: 63888 - RNA, 23 nt, Artificial Sequence
  RNA Oligomer
uaugauuauuaacgauguccaac

SEQ ID NO: 63889 - RNA, 23 nt, Artificial Sequence
  RNA Oligomer
cuaugauuauuaacgauguccaa

SEQ ID NO: 63890 - RNA, 23 nt, Artificial Sequence
  RNA Oligomer
acuaugauuauuaacgaugucca

SEQ ID NO: 63891 - RNA, 23 nt, Artificial Sequence
  RNA Oligomer
agaagccaacuaugauuauuaac

SEQ ID NO: 63892 - RNA, 23 nt, Artificial Sequence
  RNA Oligomer
uagaagccaacuaugauuauuaa

SEQ ID NO: 63893 - RNA, 23 nt, Artificial Sequence
  RNA Oligomer
uuagaagccaacuaugauuauua

SEQ ID NO: 63894 - RNA, 23 nt, Artificial Sequence
  RNA Oligomer
uuuagaagccaacuaugauuauu

SEQ ID NO: 63895 - RNA, 23 nt, Artificial Sequence
  RNA Oligomer
cuaauucacagugcucuuuucuc

SEQ ID NO: 63896 - RNA, 23 nt, Artificial Sequence
  RNA Oligomer
ucuaauucacagugcucuuuucu

SEQ ID NO: 63897 - RNA, 23 nt, Artificial Sequence
  RNA Oligomer
cucuaauucacagugcucuuuuc

SEQ ID NO: 63898 - RNA, 23 nt, Artificial Sequence
  RNA Oligomer
gcucuaauucacagugcucuuuu

SEQ ID NO: 63899 - RNA, 23 nt, Artificial Sequence
  RNA Oligomer
ggcucuaauucacagugcucuuu

SEQ ID NO: 63900 - RNA, 23 nt, Artificial Sequence
  RNA Oligomer
ccaaguucaugcagcuguggcag

SEQ ID NO: 63901 - RNA, 23 nt, Artificial Sequence
  RNA Oligomer
cccaaguucaugcagcuguggca

SEQ ID NO: 63902 - RNA, 23 nt, Artificial Sequence
  RNA Oligomer
gcccaaguucaugcagcuguggc

SEQ ID NO: 63903 - RNA, 23 nt, Artificial Sequence
  RNA Oligomer
agcccaaguucaugcagcugugg

SEQ ID NO: 63904 - RNA, 23 nt, Artificial Sequence
  RNA Oligomer
aagcccaaguucaugcagcugug

SEQ ID NO: 63905 - RNA, 23 nt, Artificial Sequence
  RNA Oligomer
gcaguuuuuugaaaaugggcuca

SEQ ID NO: 63906 - RNA, 23 nt, Artificial Sequence
  RNA Oligomer
ggcaguuuuuugaaaaugggcuc

SEQ ID NO: 63907 - RNA, 23 nt, Artificial Sequence
  RNA Oligomer
uuaggcuguaacuacuuuauaac

SEQ ID NO: 63908 - RNA, 23 nt, Artificial Sequence
  RNA Oligomer
ugauuacuggccuuuuucauuua

SEQ ID NO: 63909 - RNA, 23 nt, Artificial Sequence
  RNA Oligomer
gauggagugagagagguuuuuga

SEQ ID NO: 63910 - RNA, 23 nt, Artificial Sequence
  RNA Oligomer
agauggagugagagagguuuuug

SEQ ID NO: 63911 - RNA, 23 nt, Artificial Sequence
  RNA Oligomer
aagauggagugagagagguuuuu

SEQ ID NO: 63912 - RNA, 23 nt, Artificial Sequence
  RNA Oligomer
uccggaagaaacuggugauuguu

SEQ ID NO: 63913 - RNA, 23 nt, Artificial Sequence
  RNA Oligomer
auccggaagaaacuggugauugu

SEQ ID NO: 63914 - RNA, 23 nt, Artificial Sequence
  RNA Oligomer
cauccggaagaaacuggugauug

SEQ ID NO: 63915 - RNA, 23 nt, Artificial Sequence
  RNA Oligomer
ccauccggaagaaacuggugauu

SEQ ID NO: 63916 - RNA, 23 nt, Artificial Sequence
  RNA Oligomer
gugcucuuuucuccucacuguau

SEQ ID NO: 63917 - RNA, 23 nt, Artificial Sequence
  RNA Oligomer
agugcucuuuucuccucacugua

SEQ ID NO: 63918 - RNA, 23 nt, Artificial Sequence
  RNA Oligomer
cagugcucuuuucuccucacugu

SEQ ID NO: 63919 - RNA, 23 nt, Artificial Sequence
  RNA Oligomer
acagugcucuuuucuccucacug

SEQ ID NO: 63920 - RNA, 23 nt, Artificial Sequence
  RNA Oligomer
cacagugcucuuuucuccucacu

SEQ ID NO: 63921 - RNA, 23 nt, Artificial Sequence
  RNA Oligomer
agcugggcuaaguaaauaggaau

SEQ ID NO: 63922 - RNA, 23 nt, Artificial Sequence
  RNA Oligomer
uggggugggcaguuuuuugaaaa

SEQ ID NO: 63923 - RNA, 23 nt, Artificial Sequence
  RNA Oligomer
ggcgcuaauucaaggaauuucuu

SEQ ID NO: 63924 - RNA, 23 nt, Artificial Sequence
  RNA Oligomer
aggcgcuaauucaaggaauuucu

SEQ ID NO: 63925 - RNA, 23 nt, Artificial Sequence
  RNA Oligomer
caggcgcuaauucaaggaauuuc

SEQ ID NO: 63926 - RNA, 23 nt, Artificial Sequence
  RNA Oligomer
ccaggcgcuaauucaaggaauuu

SEQ ID NO: 63927 - RNA, 23 nt, Artificial Sequence
  RNA Oligomer
accaggcgcuaauucaaggaauu

SEQ ID NO: 63928 - RNA, 23 nt, Artificial Sequence
  RNA Oligomer
augauuacuggccuuuuucauuu

SEQ ID NO: 63929 - RNA, 23 nt, Artificial Sequence
  RNA Oligomer
ggugccuugucuugugaaaccuu

SEQ ID NO: 63930 - RNA, 23 nt, Artificial Sequence
  RNA Oligomer
gggugccuugucuugugaaaccu

SEQ ID NO: 63931 - RNA, 23 nt, Artificial Sequence
  RNA Oligomer
ugggugccuugucuugugaaacc

SEQ ID NO: 63932 - RNA, 23 nt, Artificial Sequence
  RNA Oligomer
cugggugccuugucuugugaaac

SEQ ID NO: 63933 - RNA, 23 nt, Artificial Sequence
  RNA Oligomer
ucugggugccuugucuugugaaa

SEQ ID NO: 63934 - RNA, 23 nt, Artificial Sequence
  RNA Oligomer
aaagauggagugagagagguuuu

SEQ ID NO: 63935 - RNA, 23 nt, Artificial Sequence
  RNA Oligomer
caaagauggagugagagagguuu

SEQ ID NO: 63936 - RNA, 23 nt, Artificial Sequence
  RNA Oligomer
ccaaagauggagugagagagguu

SEQ ID NO: 63937 - RNA, 23 nt, Artificial Sequence
  RNA Oligomer
ggaaugaugagcacacaaggcgg

SEQ ID NO: 63938 - RNA, 23 nt, Artificial Sequence
  RNA Oligomer
cggaaugaugagcacacaaggcg

SEQ ID NO: 63939 - RNA, 23 nt, Artificial Sequence
  RNA Oligomer
ucggaaugaugagcacacaaggc

SEQ ID NO: 63940 - RNA, 23 nt, Artificial Sequence
  RNA Oligomer
uucggaaugaugagcacacaagg

SEQ ID NO: 63941 - RNA, 23 nt, Artificial Sequence
  RNA Oligomer
cuucggaaugaugagcacacaag

SEQ ID NO: 63942 - RNA, 23 nt, Artificial Sequence
  RNA Oligomer
accccagaagucaagcauuucug

SEQ ID NO: 63943 - RNA, 23 nt, Artificial Sequence
  RNA Oligomer
gaccccagaagucaagcauuucu

SEQ ID NO: 63944 - RNA, 23 nt, Artificial Sequence
  RNA Oligomer
ggaagauuaugaucgccugaggc

SEQ ID NO: 63945 - RNA, 23 nt, Artificial Sequence
  RNA Oligomer
aggaagauuaugaucgccugagg

SEQ ID NO: 63946 - RNA, 23 nt, Artificial Sequence
  RNA Oligomer
caggaagauuaugaucgccugag

SEQ ID NO: 63947 - RNA, 23 nt, Artificial Sequence
  RNA Oligomer
gcaggaagauuaugaucgccuga

SEQ ID NO: 63948 - RNA, 23 nt, Artificial Sequence
  RNA Oligomer
ggcaggaagauuaugaucgccug

SEQ ID NO: 63949 - RNA, 23 nt, Artificial Sequence
  RNA Oligomer
ucacagugcucuuuucuccucac

SEQ ID NO: 63950 - RNA, 23 nt, Artificial Sequence
  RNA Oligomer
uucacagugcucuuuucuccuca

SEQ ID NO: 63951 - RNA, 23 nt, Artificial Sequence
  RNA Oligomer
auucacagugcucuuuucuccuc

SEQ ID NO: 63952 - RNA, 23 nt, Artificial Sequence
  RNA Oligomer
gcaucuggcucuaauucacagug

SEQ ID NO: 63953 - RNA, 23 nt, Artificial Sequence
  RNA Oligomer
agcaucuggcucuaauucacagu

SEQ ID NO: 63954 - RNA, 23 nt, Artificial Sequence
  RNA Oligomer
aagcaucuggcucuaauucacag

SEQ ID NO: 63955 - RNA, 23 nt, Artificial Sequence
  RNA Oligomer
uaagcaucuggcucuaauucaca

SEQ ID NO: 63956 - RNA, 23 nt, Artificial Sequence
  RNA Oligomer
uuaagcaucuggcucuaauucac

SEQ ID NO: 63957 - RNA, 23 nt, Artificial Sequence
  RNA Oligomer
acacuuuggaagauggcauaacc

SEQ ID NO: 63958 - RNA, 23 nt, Artificial Sequence
  RNA Oligomer
gacacuuuggaagauggcauaac

SEQ ID NO: 63959 - RNA, 23 nt, Artificial Sequence
  RNA Oligomer
agacacuuuggaagauggcauaa

SEQ ID NO: 63960 - RNA, 23 nt, Artificial Sequence
  RNA Oligomer
uagacacuuuggaagauggcaua

SEQ ID NO: 63961 - RNA, 23 nt, Artificial Sequence
  RNA Oligomer
uuagacacuuuggaagauggcau

SEQ ID NO: 63962 - RNA, 23 nt, Artificial Sequence
  RNA Oligomer
gcaauuagacacuuuggaagaug

SEQ ID NO: 63963 - RNA, 23 nt, Artificial Sequence
  RNA Oligomer
ggcaauuagacacuuuggaagau

SEQ ID NO: 63964 - RNA, 23 nt, Artificial Sequence
  RNA Oligomer
aggcaauuagacacuuuggaaga

SEQ ID NO: 63965 - RNA, 23 nt, Artificial Sequence
  RNA Oligomer
gaggcaauuagacacuuuggaag

SEQ ID NO: 63966 - RNA, 23 nt, Artificial Sequence
  RNA Oligomer
ugaggcaauuagacacuuuggaa

SEQ ID NO: 63967 - RNA, 23 nt, Artificial Sequence
  RNA Oligomer
cugaggcaauuagacacuuugga

SEQ ID NO: 63968 - RNA, 23 nt, Artificial Sequence
  RNA Oligomer
ggauuuccuaauacugucauccu

SEQ ID NO: 63969 - RNA, 23 nt, Artificial Sequence
  RNA Oligomer
uggauuuccuaauacugucaucc

SEQ ID NO: 63970 - RNA, 23 nt, Artificial Sequence
  RNA Oligomer
uuggauuuccuaauacugucauc

SEQ ID NO: 63971 - RNA, 23 nt, Artificial Sequence
  RNA Oligomer
auuggauuuccuaauacugucau

SEQ ID NO: 63972 - RNA, 23 nt, Artificial Sequence
  RNA Oligomer
aauuggauuuccuaauacuguca

SEQ ID NO: 63973 - RNA, 23 nt, Artificial Sequence
  RNA Oligomer
aaagcccaaguucaugcagcugu

SEQ ID NO: 63974 - RNA, 23 nt, Artificial Sequence
  RNA Oligomer
ccagaaaagcccaaguucaugca

SEQ ID NO: 63975 - RNA, 23 nt, Artificial Sequence
  RNA Oligomer
accagaaaagcccaaguucaugc

SEQ ID NO: 63976 - RNA, 23 nt, Artificial Sequence
  RNA Oligomer
aaccagaaaagcccaaguucaug

SEQ ID NO: 63977 - RNA, 23 nt, Artificial Sequence
  RNA Oligomer
caaccagaaaagcccaaguucau

SEQ ID NO: 63978 - RNA, 23 nt, Artificial Sequence
  RNA Oligomer
ucaaccagaaaagcccaaguuca

SEQ ID NO: 63979 - RNA, 23 nt, Artificial Sequence
  RNA Oligomer
cuggggugggcaguuuuuugaaa

SEQ ID NO: 63980 - RNA, 23 nt, Artificial Sequence
  RNA Oligomer
aggguccuuuugacacugcucua

SEQ ID NO: 63981 - RNA, 23 nt, Artificial Sequence
  RNA Oligomer
auuuagaagccaacuaugauuau

SEQ ID NO: 63982 - RNA, 23 nt, Artificial Sequence
  RNA Oligomer
ggaagaaaaaaucugggugccuu

SEQ ID NO: 63983 - RNA, 23 nt, Artificial Sequence
  RNA Oligomer
gggaagaaaaaaucugggugccu

SEQ ID NO: 63984 - RNA, 23 nt, Artificial Sequence
  RNA Oligomer
ugggaagaaaaaaucugggugcc

SEQ ID NO: 63985 - RNA, 23 nt, Artificial Sequence
  RNA Oligomer
gugggaagaaaaaaucugggugc

SEQ ID NO: 63986 - RNA, 23 nt, Artificial Sequence
  RNA Oligomer
cgugggaagaaaaaaucugggug

SEQ ID NO: 63987 - RNA, 23 nt, Artificial Sequence
  RNA Oligomer
ucuucggaaugaugagcacacaa

SEQ ID NO: 63988 - RNA, 23 nt, Artificial Sequence
  RNA Oligomer
ugagaacuauguggcagauaucg

SEQ ID NO: 63989 - RNA, 23 nt, Artificial Sequence
  RNA Oligomer
uugagaacuauguggcagauauc

SEQ ID NO: 63990 - RNA, 23 nt, Artificial Sequence
  RNA Oligomer
uuugagaacuauguggcagauau

SEQ ID NO: 63991 - RNA, 23 nt, Artificial Sequence
  RNA Oligomer
guuugagaacuauguggcagaua

SEQ ID NO: 63992 - RNA, 23 nt, Artificial Sequence
  RNA Oligomer
uguuugagaacuauguggcagau

SEQ ID NO: 63993 - RNA, 23 nt, Artificial Sequence
  RNA Oligomer
uuucuguaccaguuaauuuuucc

SEQ ID NO: 63994 - RNA, 23 nt, Artificial Sequence
  RNA Oligomer
uuuucuguaccaguuaauuuuuc

SEQ ID NO: 63995 - RNA, 23 nt, Artificial Sequence
  RNA Oligomer
ggcacucagucucucuucucucc

SEQ ID NO: 63996 - RNA, 23 nt, Artificial Sequence
  RNA Oligomer
uggcacucagucucucuucucuc

SEQ ID NO: 63997 - RNA, 23 nt, Artificial Sequence
  RNA Oligomer
guggcacucagucucucuucucu

SEQ ID NO: 63998 - RNA, 23 nt, Artificial Sequence
  RNA Oligomer
gguggcacucagucucucuucuc

SEQ ID NO: 63999 - RNA, 23 nt, Artificial Sequence
  RNA Oligomer
ggguggcacucagucucucuucu

SEQ ID NO: 64000 - RNA, 23 nt, Artificial Sequence
  RNA Oligomer
cacuuuggaagauggcauaaccu

SEQ ID NO: 64001 - RNA, 23 nt, Artificial Sequence
  RNA Oligomer
ccugaggcaauuagacacuuugg

SEQ ID NO: 64002 - RNA, 23 nt, Artificial Sequence
  RNA Oligomer
gccugaggcaauuagacacuuug

SEQ ID NO: 64003 - RNA, 23 nt, Artificial Sequence
  RNA Oligomer
cgccugaggcaauuagacacuuu

SEQ ID NO: 64004 - RNA, 23 nt, Artificial Sequence
  RNA Oligomer
ugauaaaagauggccauauuacc

SEQ ID NO: 64005 - RNA, 23 nt, Artificial Sequence
  RNA Oligomer
cugauaaaagauggccauauuac

SEQ ID NO: 64006 - RNA, 23 nt, Artificial Sequence
  RNA Oligomer
ucugauaaaagauggccauauua

SEQ ID NO: 64007 - RNA, 23 nt, Artificial Sequence
  RNA Oligomer
uucugauaaaagauggccauauu

SEQ ID NO: 64008 - RNA, 23 nt, Artificial Sequence
  RNA Oligomer
uuucugauaaaagauggccauau

SEQ ID NO: 64009 - RNA, 23 nt, Artificial Sequence
  RNA Oligomer
gggcuuuacuccguaacagauuu

SEQ ID NO: 64010 - RNA, 23 nt, Artificial Sequence
  RNA Oligomer
agggcuuuacuccguaacagauu

SEQ ID NO: 64011 - RNA, 23 nt, Artificial Sequence
  RNA Oligomer
cagggcuuuacuccguaacagau

SEQ ID NO: 64012 - RNA, 23 nt, Artificial Sequence
  RNA Oligomer
ucagggcuuuacuccguaacaga

SEQ ID NO: 64013 - RNA, 23 nt, Artificial Sequence
  RNA Oligomer
uucagggcuuuacuccguaacag

SEQ ID NO: 64014 - RNA, 23 nt, Artificial Sequence
  RNA Oligomer
acgugggaagaaaaaaucugggu

SEQ ID NO: 64015 - RNA, 23 nt, Artificial Sequence
  RNA Oligomer
agacgugggaagaaaaaaucugg

SEQ ID NO: 64016 - RNA, 23 nt, Artificial Sequence
  RNA Oligomer
uagacgugggaagaaaaaaucug

SEQ ID NO: 64017 - RNA, 23 nt, Artificial Sequence
  RNA Oligomer
cuagacgugggaagaaaaaaucu

SEQ ID NO: 64018 - RNA, 23 nt, Artificial Sequence
  RNA Oligomer
gcuagacgugggaagaaaaaauc

SEQ ID NO: 64019 - RNA, 23 nt, Artificial Sequence
  RNA Oligomer
agcuagacgugggaagaaaaaau

SEQ ID NO: 64020 - RNA, 23 nt, Artificial Sequence
  RNA Oligomer
gagagagguuuuugaaauggcua

SEQ ID NO: 64021 - RNA, 23 nt, Artificial Sequence
  RNA Oligomer
cgacagcccugauaguuuagaaa

SEQ ID NO: 64022 - RNA, 23 nt, Artificial Sequence
  RNA Oligomer
ucgacagcccugauaguuuagaa

SEQ ID NO: 64023 - RNA, 23 nt, Artificial Sequence
  RNA Oligomer
aucgacagcccugauaguuuaga

SEQ ID NO: 64024 - RNA, 23 nt, Artificial Sequence
  RNA Oligomer
caucgacagcccugauaguuuag

SEQ ID NO: 64025 - RNA, 23 nt, Artificial Sequence
  RNA Oligomer
ccaucgacagcccugauaguuua

SEQ ID NO: 64026 - RNA, 23 nt, Artificial Sequence
  RNA Oligomer
agaacuauguggcagauaucgag

SEQ ID NO: 64027 - RNA, 23 nt, Artificial Sequence
  RNA Oligomer
gagaacuauguggcagauaucga

SEQ ID NO: 64028 - RNA, 23 nt, Artificial Sequence
  RNA Oligomer
caguguuugagaacuauguggca

SEQ ID NO: 64029 - RNA, 23 nt, Artificial Sequence
  RNA Oligomer
acaguguuugagaacuauguggc

SEQ ID NO: 64030 - RNA, 23 nt, Artificial Sequence
  RNA Oligomer
cacaguguuugagaacuaugugg

SEQ ID NO: 64031 - RNA, 23 nt, Artificial Sequence
  RNA Oligomer
gaauaaaggcaguuuucuaaaaa

SEQ ID NO: 64032 - RNA, 23 nt, Artificial Sequence
  RNA Oligomer
agaauaaaggcaguuuucuaaaa

SEQ ID NO: 64033 - RNA, 23 nt, Artificial Sequence
  RNA Oligomer
uagaauaaaggcaguuuucuaaa

SEQ ID NO: 64034 - RNA, 23 nt, Artificial Sequence
  RNA Oligomer
guaaauaggaauugguuucacgc

SEQ ID NO: 64035 - RNA, 23 nt, Artificial Sequence
  RNA Oligomer
aguaaauaggaauugguuucacg

SEQ ID NO: 64036 - RNA, 23 nt, Artificial Sequence
  RNA Oligomer
aaguaaauaggaauugguuucac

SEQ ID NO: 64037 - RNA, 23 nt, Artificial Sequence
  RNA Oligomer
uaaguaaauaggaauugguuuca

SEQ ID NO: 64038 - RNA, 23 nt, Artificial Sequence
  RNA Oligomer
cuaaguaaauaggaauugguuuc

SEQ ID NO: 64039 - RNA, 23 nt, Artificial Sequence
  RNA Oligomer
cagaaaagcccaaguucaugcag

SEQ ID NO: 64040 - RNA, 23 nt, Artificial Sequence
  RNA Oligomer
ggaauuucuuaacuucuugcuuc

SEQ ID NO: 64041 - RNA, 23 nt, Artificial Sequence
  RNA Oligomer
aggaauuucuuaacuucuugcuu

SEQ ID NO: 64042 - RNA, 23 nt, Artificial Sequence
  RNA Oligomer
aaggaauuucuuaacuucuugcu

SEQ ID NO: 64043 - RNA, 23 nt, Artificial Sequence
  RNA Oligomer
caaggaauuucuuaacuucuugc

SEQ ID NO: 64044 - RNA, 23 nt, Artificial Sequence
  RNA Oligomer
ucaaggaauuucuuaacuucuug

SEQ ID NO: 64045 - RNA, 23 nt, Artificial Sequence
  RNA Oligomer
agauuacaaaucagaagucaucu

SEQ ID NO: 64046 - RNA, 23 nt, Artificial Sequence
  RNA Oligomer
aagauuacaaaucagaagucauc

SEQ ID NO: 64047 - RNA, 23 nt, Artificial Sequence
  RNA Oligomer
uaagauuacaaaucagaagucau

SEQ ID NO: 64048 - RNA, 23 nt, Artificial Sequence
  RNA Oligomer
cuaagauuacaaaucagaaguca

SEQ ID NO: 64049 - RNA, 23 nt, Artificial Sequence
  RNA Oligomer
ccuaagauuacaaaucagaaguc

SEQ ID NO: 64050 - RNA, 23 nt, Artificial Sequence
  RNA Oligomer
cgguuaauuuugaagugcuguuu

SEQ ID NO: 64051 - RNA, 23 nt, Artificial Sequence
  RNA Oligomer
gcgguuaauuuugaagugcuguu

SEQ ID NO: 64052 - RNA, 23 nt, Artificial Sequence
  RNA Oligomer
ugcgguuaauuuugaagugcugu

SEQ ID NO: 64053 - RNA, 23 nt, Artificial Sequence
  RNA Oligomer
augcgguuaauuuugaagugcug

SEQ ID NO: 64054 - RNA, 23 nt, Artificial Sequence
  RNA Oligomer
uaugcgguuaauuuugaagugcu

SEQ ID NO: 64055 - RNA, 23 nt, Artificial Sequence
  RNA Oligomer
gucuugugaaaccuugcugcaag

SEQ ID NO: 64056 - RNA, 23 nt, Artificial Sequence
  RNA Oligomer
ugucuugugaaaccuugcugcaa

SEQ ID NO: 64057 - RNA, 23 nt, Artificial Sequence
  RNA Oligomer
uugucuugugaaaccuugcugca

SEQ ID NO: 64058 - RNA, 23 nt, Artificial Sequence
  RNA Oligomer
cuugucuugugaaaccuugcugc

SEQ ID NO: 64059 - RNA, 23 nt, Artificial Sequence
  RNA Oligomer
ccuugucuugugaaaccuugcug

SEQ ID NO: 64060 - RNA, 23 nt, Artificial Sequence
  RNA Oligomer
aucugggugccuugucuugugaa

SEQ ID NO: 64061 - RNA, 23 nt, Artificial Sequence
  RNA Oligomer
gaaaaaaucugggugccuugucu

SEQ ID NO: 64062 - RNA, 23 nt, Artificial Sequence
  RNA Oligomer
agaaaaaaucugggugccuuguc

SEQ ID NO: 64063 - RNA, 23 nt, Artificial Sequence
  RNA Oligomer
aagaaaaaaucugggugccuugu

SEQ ID NO: 64064 - RNA, 23 nt, Artificial Sequence
  RNA Oligomer
gaagaaaaaaucugggugccuug

SEQ ID NO: 64065 - RNA, 23 nt, Artificial Sequence
  RNA Oligomer
cgauguuauacugauguguuuuu

SEQ ID NO: 64066 - RNA, 23 nt, Artificial Sequence
  RNA Oligomer
ccgauguuauacugauguguuuu

SEQ ID NO: 64067 - RNA, 23 nt, Artificial Sequence
  RNA Oligomer
accgauguuauacugauguguuu

SEQ ID NO: 64068 - RNA, 23 nt, Artificial Sequence
  RNA Oligomer
uaccgauguuauacugauguguu

SEQ ID NO: 64069 - RNA, 23 nt, Artificial Sequence
  RNA Oligomer
auaccgauguuauacugaugugu

SEQ ID NO: 64070 - RNA, 23 nt, Artificial Sequence
  RNA Oligomer
gauaccgauguuauacugaugug

SEQ ID NO: 64071 - RNA, 23 nt, Artificial Sequence
  RNA Oligomer
cccagauaccgauguuauacuga

SEQ ID NO: 64072 - RNA, 23 nt, Artificial Sequence
  RNA Oligomer
acccagauaccgauguuauacug

SEQ ID NO: 64073 - RNA, 23 nt, Artificial Sequence
  RNA Oligomer
uacccagauaccgauguuauacu

SEQ ID NO: 64074 - RNA, 23 nt, Artificial Sequence
  RNA Oligomer
cuacccagauaccgauguuauac

SEQ ID NO: 64075 - RNA, 23 nt, Artificial Sequence
  RNA Oligomer
ccuacccagauaccgauguuaua

SEQ ID NO: 64076 - RNA, 23 nt, Artificial Sequence
  RNA Oligomer
uggguggcacucagucucucuuc

SEQ ID NO: 64077 - RNA, 23 nt, Artificial Sequence
  RNA Oligomer
auggguggcacucagucucucuu

SEQ ID NO: 64078 - RNA, 23 nt, Artificial Sequence
  RNA Oligomer
gcuaaguaaauaggaauugguuu

SEQ ID NO: 64079 - RNA, 23 nt, Artificial Sequence
  RNA Oligomer
gauaaaagauggccauauuaccc

SEQ ID NO: 64080 - RNA, 23 nt, Artificial Sequence
  RNA Oligomer
cuaauacugucauccucaaagaa

SEQ ID NO: 64081 - RNA, 23 nt, Artificial Sequence
  RNA Oligomer
ccuaauacugucauccucaaaga

SEQ ID NO: 64082 - RNA, 23 nt, Artificial Sequence
  RNA Oligomer
uccuaauacugucauccucaaag

SEQ ID NO: 64083 - RNA, 23 nt, Artificial Sequence
  RNA Oligomer
uuccuaauacugucauccucaaa

SEQ ID NO: 64084 - RNA, 23 nt, Artificial Sequence
  RNA Oligomer
uuuccuaauacugucauccucaa

SEQ ID NO: 64085 - RNA, 23 nt, Artificial Sequence
  RNA Oligomer
guggcagaguuacaguucugugg

SEQ ID NO: 64086 - RNA, 23 nt, Artificial Sequence
  RNA Oligomer
uguggcagaguuacaguucugug

SEQ ID NO: 64087 - RNA, 23 nt, Artificial Sequence
  RNA Oligomer
cuguggcagaguuacaguucugu

SEQ ID NO: 64088 - RNA, 23 nt, Artificial Sequence
  RNA Oligomer
gcuguggcagaguuacaguucug

SEQ ID NO: 64089 - RNA, 23 nt, Artificial Sequence
  RNA Oligomer
agcuguggcagaguuacaguucu

SEQ ID NO: 64090 - RNA, 23 nt, Artificial Sequence
  RNA Oligomer
ucuggggugggcaguuuuuugaa

SEQ ID NO: 64091 - RNA, 23 nt, Artificial Sequence
  RNA Oligomer
uccugccuauuaucugucagcug

SEQ ID NO: 64092 - RNA, 23 nt, Artificial Sequence
  RNA Oligomer
guccugccuauuaucugucagcu

SEQ ID NO: 64093 - RNA, 23 nt, Artificial Sequence
  RNA Oligomer
uguccugccuauuaucugucagc

SEQ ID NO: 64094 - RNA, 23 nt, Artificial Sequence
  RNA Oligomer
auguccugccuauuaucugucag

SEQ ID NO: 64095 - RNA, 23 nt, Artificial Sequence
  RNA Oligomer
cauguccugccuauuaucuguca

SEQ ID NO: 64096 - RNA, 23 nt, Artificial Sequence
  RNA Oligomer
caccaggcgcuaauucaaggaau

SEQ ID NO: 64097 - RNA, 23 nt, Artificial Sequence
  RNA Oligomer
ccaguauuuagaagccaacuaug

SEQ ID NO: 64098 - RNA, 23 nt, Artificial Sequence
  RNA Oligomer
accaguauuuagaagccaacuau

SEQ ID NO: 64099 - RNA, 23 nt, Artificial Sequence
  RNA Oligomer
guaugauuacuggccuuuuucau

SEQ ID NO: 64100 - RNA, 23 nt, Artificial Sequence
  RNA Oligomer
uguaugauuacuggccuuuuuca

SEQ ID NO: 64101 - RNA, 23 nt, Artificial Sequence
  RNA Oligomer
aagcuagacgugggaagaaaaaa

SEQ ID NO: 64102 - RNA, 23 nt, Artificial Sequence
  RNA Oligomer
caagcuagacgugggaagaaaaa

SEQ ID NO: 64103 - RNA, 23 nt, Artificial Sequence
  RNA Oligomer
gcaagcuagacgugggaagaaaa

SEQ ID NO: 64104 - RNA, 23 nt, Artificial Sequence
  RNA Oligomer
ugcaagcuagacgugggaagaaa

SEQ ID NO: 64105 - RNA, 23 nt, Artificial Sequence
  RNA Oligomer
gaaggaucuucggaaugaugagc

SEQ ID NO: 64106 - RNA, 23 nt, Artificial Sequence
  RNA Oligomer
agaaggaucuucggaaugaugag

SEQ ID NO: 64107 - RNA, 23 nt, Artificial Sequence
  RNA Oligomer
aagaaggaucuucggaaugauga

SEQ ID NO: 64108 - RNA, 23 nt, Artificial Sequence
  RNA Oligomer
uaagaaggaucuucggaaugaug

SEQ ID NO: 64109 - RNA, 23 nt, Artificial Sequence
  RNA Oligomer
auaagaaggaucuucggaaugau

SEQ ID NO: 64110 - RNA, 23 nt, Artificial Sequence
  RNA Oligomer
gguugggaauaagaaggaucuuc

SEQ ID NO: 64111 - RNA, 23 nt, Artificial Sequence
  RNA Oligomer
ugguugggaauaagaaggaucuu

SEQ ID NO: 64112 - RNA, 23 nt, Artificial Sequence
  RNA Oligomer
cugguugggaauaagaaggaucu

SEQ ID NO: 64113 - RNA, 23 nt, Artificial Sequence
  RNA Oligomer
ccugguugggaauaagaaggauc

SEQ ID NO: 64114 - RNA, 23 nt, Artificial Sequence
  RNA Oligomer
uccugguugggaauaagaaggau

SEQ ID NO: 64115 - RNA, 23 nt, Artificial Sequence
  RNA Oligomer
cuaauagaauaaaggcaguuuuc

SEQ ID NO: 64116 - RNA, 23 nt, Artificial Sequence
  RNA Oligomer
acuaauagaauaaaggcaguuuu

SEQ ID NO: 64117 - RNA, 23 nt, Artificial Sequence
  RNA Oligomer
uacuaauagaauaaaggcaguuu

SEQ ID NO: 64118 - RNA, 23 nt, Artificial Sequence
  RNA Oligomer
cuacuaauagaauaaaggcaguu

SEQ ID NO: 64119 - RNA, 23 nt, Artificial Sequence
  RNA Oligomer
acuacuaauagaauaaaggcagu

SEQ ID NO: 64120 - RNA, 23 nt, Artificial Sequence
  RNA Oligomer
gcacucagucucucuucucucca

SEQ ID NO: 64121 - RNA, 23 nt, Artificial Sequence
  RNA Oligomer
gagcugggcuaaguaaauaggaa

SEQ ID NO: 64122 - RNA, 23 nt, Artificial Sequence
  RNA Oligomer
gucagauggaaaauucauuuuuu

SEQ ID NO: 64123 - RNA, 23 nt, Artificial Sequence
  RNA Oligomer
agucagauggaaaauucauuuuu

SEQ ID NO: 64124 - RNA, 23 nt, Artificial Sequence
  RNA Oligomer
aagucagauggaaaauucauuuu

SEQ ID NO: 64125 - RNA, 23 nt, Artificial Sequence
  RNA Oligomer
aaagucagauggaaaauucauuu

SEQ ID NO: 64126 - RNA, 23 nt, Artificial Sequence
  RNA Oligomer
uaaagucagauggaaaauucauu

SEQ ID NO: 64127 - RNA, 23 nt, Artificial Sequence
  RNA Oligomer
caaagaaaguguauugguuuuuu

SEQ ID NO: 64128 - RNA, 23 nt, Artificial Sequence
  RNA Oligomer
ucaaagaaaguguauugguuuuu

SEQ ID NO: 64129 - RNA, 23 nt, Artificial Sequence
  RNA Oligomer
cucaaagaaaguguauugguuuu

SEQ ID NO: 64130 - RNA, 23 nt, Artificial Sequence
  RNA Oligomer
ccucaaagaaaguguauugguuu

SEQ ID NO: 64131 - RNA, 23 nt, Artificial Sequence
  RNA Oligomer
uccucaaagaaaguguauugguu

SEQ ID NO: 64132 - RNA, 23 nt, Artificial Sequence
  RNA Oligomer
gauuuccuaauacugucauccuc

SEQ ID NO: 64133 - RNA, 23 nt, Artificial Sequence
  RNA Oligomer
agauuuuguuggcauagcucugg

SEQ ID NO: 64134 - RNA, 23 nt, Artificial Sequence
  RNA Oligomer
cagauuuuguuggcauagcucug

SEQ ID NO: 64135 - RNA, 23 nt, Artificial Sequence
  RNA Oligomer
acagauuuuguuggcauagcucu

SEQ ID NO: 64136 - RNA, 23 nt, Artificial Sequence
  RNA Oligomer
aacagauuuuguuggcauagcuc

SEQ ID NO: 64137 - RNA, 23 nt, Artificial Sequence
  RNA Oligomer
uaacagauuuuguuggcauagcu

SEQ ID NO: 64138 - RNA, 23 nt, Artificial Sequence
  RNA Oligomer
uauuuagaagccaacuaugauua

SEQ ID NO: 64139 - RNA, 23 nt, Artificial Sequence
  RNA Oligomer
guauuuagaagccaacuaugauu

SEQ ID NO: 64140 - RNA, 23 nt, Artificial Sequence
  RNA Oligomer
cagaagucaucuugcuaccagua

SEQ ID NO: 64141 - RNA, 23 nt, Artificial Sequence
  RNA Oligomer
ucagaagucaucuugcuaccagu

SEQ ID NO: 64142 - RNA, 23 nt, Artificial Sequence
  RNA Oligomer
aucagaagucaucuugcuaccag

SEQ ID NO: 64143 - RNA, 23 nt, Artificial Sequence
  RNA Oligomer
uaugauuacuggccuuuuucauu

SEQ ID NO: 64144 - RNA, 23 nt, Artificial Sequence
  RNA Oligomer
uuugaagugcuguuuauuaaucu

SEQ ID NO: 64145 - RNA, 23 nt, Artificial Sequence
  RNA Oligomer
uuuugaagugcuguuuauuaauc

SEQ ID NO: 64146 - RNA, 23 nt, Artificial Sequence
  RNA Oligomer
uuaugcgguuaauuuugaagugc

SEQ ID NO: 64147 - RNA, 23 nt, Artificial Sequence
  RNA Oligomer
cuuaugcgguuaauuuugaagug

SEQ ID NO: 64148 - RNA, 23 nt, Artificial Sequence
  RNA Oligomer
gacgugggaagaaaaaaucuggg

SEQ ID NO: 64149 - RNA, 23 nt, Artificial Sequence
  RNA Oligomer
agagguuuuugaaauggcuacga

SEQ ID NO: 64150 - RNA, 23 nt, Artificial Sequence
  RNA Oligomer
gagagguuuuugaaauggcuacg

SEQ ID NO: 64151 - RNA, 23 nt, Artificial Sequence
  RNA Oligomer
agagagguuuuugaaauggcuac

SEQ ID NO: 64152 - RNA, 23 nt, Artificial Sequence
  RNA Oligomer
aucuucggaaugaugagcacaca

SEQ ID NO: 64153 - RNA, 23 nt, Artificial Sequence
  RNA Oligomer
ggaccccagaagucaagcauuuc

SEQ ID NO: 64154 - RNA, 23 nt, Artificial Sequence
  RNA Oligomer
agauuaugaucgccugaggcccc

SEQ ID NO: 64155 - RNA, 23 nt, Artificial Sequence
  RNA Oligomer
aagauuaugaucgccugaggccc

SEQ ID NO: 64156 - RNA, 23 nt, Artificial Sequence
  RNA Oligomer
gaagauuaugaucgccugaggcc

SEQ ID NO: 64157 - RNA, 23 nt, Artificial Sequence
  RNA Oligomer
ugggcaggaagauuaugaucgcc

SEQ ID NO: 64158 - RNA, 23 nt, Artificial Sequence
  RNA Oligomer
cugggcaggaagauuaugaucgc

SEQ ID NO: 64159 - RNA, 23 nt, Artificial Sequence
  RNA Oligomer
gcugggcaggaagauuaugaucg

SEQ ID NO: 64160 - RNA, 23 nt, Artificial Sequence
  RNA Oligomer
agcugggcaggaagauuaugauc

SEQ ID NO: 64161 - RNA, 23 nt, Artificial Sequence
  RNA Oligomer
cagcugggcaggaagauuaugau

SEQ ID NO: 64162 - RNA, 23 nt, Artificial Sequence
  RNA Oligomer
acagcugggcaggaagauuauga

SEQ ID NO: 64163 - RNA, 23 nt, Artificial Sequence
  RNA Oligomer
cacagcugggcaggaagauuaug

SEQ ID NO: 64164 - RNA, 23 nt, Artificial Sequence
  RNA Oligomer
acacagcugggcaggaagauuau

SEQ ID NO: 64165 - RNA, 23 nt, Artificial Sequence
  RNA Oligomer
gacacagcugggcaggaagauua

SEQ ID NO: 64166 - RNA, 23 nt, Artificial Sequence
  RNA Oligomer
cagguagaguuggcuuuguggga

SEQ ID NO: 64167 - RNA, 23 nt, Artificial Sequence
  RNA Oligomer
gcagguagaguuggcuuuguggg

SEQ ID NO: 64168 - RNA, 23 nt, Artificial Sequence
  RNA Oligomer
agcagguagaguuggcuuugugg

SEQ ID NO: 64169 - RNA, 23 nt, Artificial Sequence
  RNA Oligomer
aagcagguagaguuggcuuugug

SEQ ID NO: 64170 - RNA, 23 nt, Artificial Sequence
  RNA Oligomer
ggcagauaucgagguggauggaa

SEQ ID NO: 64171 - RNA, 23 nt, Artificial Sequence
  RNA Oligomer
uggcagauaucgagguggaugga

SEQ ID NO: 64172 - RNA, 23 nt, Artificial Sequence
  RNA Oligomer
guggcagauaucgagguggaugg

SEQ ID NO: 64173 - RNA, 23 nt, Artificial Sequence
  RNA Oligomer
uguggcagauaucgagguggaug

SEQ ID NO: 64174 - RNA, 23 nt, Artificial Sequence
  RNA Oligomer
auguggcagauaucgagguggau

SEQ ID NO: 64175 - RNA, 23 nt, Artificial Sequence
  RNA Oligomer
caauuagacacuuuggaagaugg

SEQ ID NO: 64176 - RNA, 23 nt, Artificial Sequence
  RNA Oligomer
acgccugaggcaauuagacacuu

SEQ ID NO: 64177 - RNA, 23 nt, Artificial Sequence
  RNA Oligomer
ggagcugggcuaaguaaauagga

SEQ ID NO: 64178 - RNA, 23 nt, Artificial Sequence
  RNA Oligomer
uggagcugggcuaaguaaauagg

SEQ ID NO: 64179 - RNA, 23 nt, Artificial Sequence
  RNA Oligomer
auggagcugggcuaaguaaauag

SEQ ID NO: 64180 - RNA, 23 nt, Artificial Sequence
  RNA Oligomer
cauggagcugggcuaaguaaaua

SEQ ID NO: 64181 - RNA, 23 nt, Artificial Sequence
  RNA Oligomer
ccauggagcugggcuaaguaaau

SEQ ID NO: 64182 - RNA, 23 nt, Artificial Sequence
  RNA Oligomer
guucugugguuucauguuaguua

SEQ ID NO: 64183 - RNA, 23 nt, Artificial Sequence
  RNA Oligomer
aguucugugguuucauguuaguu

SEQ ID NO: 64184 - RNA, 23 nt, Artificial Sequence
  RNA Oligomer
caguucugugguuucauguuagu

SEQ ID NO: 64185 - RNA, 23 nt, Artificial Sequence
  RNA Oligomer
acaguucugugguuucauguuag

SEQ ID NO: 64186 - RNA, 23 nt, Artificial Sequence
  RNA Oligomer
uacaguucugugguuucauguua

SEQ ID NO: 64187 - RNA, 23 nt, Artificial Sequence
  RNA Oligomer
uuacaguucugugguuucauguu

SEQ ID NO: 64188 - RNA, 23 nt, Artificial Sequence
  RNA Oligomer
guuacaguucugugguuucaugu

SEQ ID NO: 64189 - RNA, 23 nt, Artificial Sequence
  RNA Oligomer
aguuacaguucugugguuucaug

SEQ ID NO: 64190 - RNA, 23 nt, Artificial Sequence
  RNA Oligomer
guaacagauuuuguuggcauagc

SEQ ID NO: 64191 - RNA, 23 nt, Artificial Sequence
  RNA Oligomer
cguaacagauuuuguuggcauag

SEQ ID NO: 64192 - RNA, 23 nt, Artificial Sequence
  RNA Oligomer
ccguaacagauuuuguuggcaua

SEQ ID NO: 64193 - RNA, 23 nt, Artificial Sequence
  RNA Oligomer
acauguccugccuauuaucuguc

SEQ ID NO: 64194 - RNA, 23 nt, Artificial Sequence
  RNA Oligomer
cuuaacuucuugcuucuuucuag

SEQ ID NO: 64195 - RNA, 23 nt, Artificial Sequence
  RNA Oligomer
ucuuaacuucuugcuucuuucua

SEQ ID NO: 64196 - RNA, 23 nt, Artificial Sequence
  RNA Oligomer
uucuuaacuucuugcuucuuucu

SEQ ID NO: 64197 - RNA, 23 nt, Artificial Sequence
  RNA Oligomer
uuucuuaacuucuugcuucuuuc

SEQ ID NO: 64198 - RNA, 23 nt, Artificial Sequence
  RNA Oligomer
auuucuuaacuucuugcuucuuu

SEQ ID NO: 64199 - RNA, 23 nt, Artificial Sequence
  RNA Oligomer
acaccaggcgcuaauucaaggaa

SEQ ID NO: 64200 - RNA, 23 nt, Artificial Sequence
  RNA Oligomer
cacaccaggcgcuaauucaagga

SEQ ID NO: 64201 - RNA, 23 nt, Artificial Sequence
  RNA Oligomer
accuaagauuacaaaucagaagu

SEQ ID NO: 64202 - RNA, 23 nt, Artificial Sequence
  RNA Oligomer
uaccuaagauuacaaaucagaag

SEQ ID NO: 64203 - RNA, 23 nt, Artificial Sequence
  RNA Oligomer
uuaccuaagauuacaaaucagaa

SEQ ID NO: 64204 - RNA, 23 nt, Artificial Sequence
  RNA Oligomer
aaucugggugccuugucuuguga

SEQ ID NO: 64205 - RNA, 23 nt, Artificial Sequence
  RNA Oligomer
agauaccgauguuauacugaugu

SEQ ID NO: 64206 - RNA, 23 nt, Artificial Sequence
  RNA Oligomer
cagauaccgauguuauacugaug

SEQ ID NO: 64207 - RNA, 23 nt, Artificial Sequence
  RNA Oligomer
ccagauaccgauguuauacugau

SEQ ID NO: 64208 - RNA, 23 nt, Artificial Sequence
  RNA Oligomer
uccuacccagauaccgauguuau

SEQ ID NO: 64209 - RNA, 23 nt, Artificial Sequence
  RNA Oligomer
agaguuggcuuugugggacacag

SEQ ID NO: 64210 - RNA, 23 nt, Artificial Sequence
  RNA Oligomer
uagaguuggcuuugugggacaca

SEQ ID NO: 64211 - RNA, 23 nt, Artificial Sequence
  RNA Oligomer
guagaguuggcuuugugggacac

SEQ ID NO: 64212 - RNA, 23 nt, Artificial Sequence
  RNA Oligomer
gguagaguuggcuuugugggaca

SEQ ID NO: 64213 - RNA, 23 nt, Artificial Sequence
  RNA Oligomer
agguagaguuggcuuugugggac

SEQ ID NO: 64214 - RNA, 23 nt, Artificial Sequence
  RNA Oligomer
ggaaagcagguagaguuggcuuu

SEQ ID NO: 64215 - RNA, 23 nt, Artificial Sequence
  RNA Oligomer
uauguggcagauaucgaggugga

SEQ ID NO: 64216 - RNA, 23 nt, Artificial Sequence
  RNA Oligomer
gcauaaccugucucaccuggacu

SEQ ID NO: 64217 - RNA, 23 nt, Artificial Sequence
  RNA Oligomer
ggcauaaccugucucaccuggac

SEQ ID NO: 64218 - RNA, 23 nt, Artificial Sequence
  RNA Oligomer
uggcauaaccugucucaccugga

SEQ ID NO: 64219 - RNA, 23 nt, Artificial Sequence
  RNA Oligomer
auggcauaaccugucucaccugg

SEQ ID NO: 64220 - RNA, 23 nt, Artificial Sequence
  RNA Oligomer
gauggcauaaccugucucaccug

SEQ ID NO: 64221 - RNA, 23 nt, Artificial Sequence
  RNA Oligomer
auaaagucagauggaaaauucau

SEQ ID NO: 64222 - RNA, 23 nt, Artificial Sequence
  RNA Oligomer
aauaaagucagauggaaaauuca

SEQ ID NO: 64223 - RNA, 23 nt, Artificial Sequence
  RNA Oligomer
aaauaaagucagauggaaaauuc

SEQ ID NO: 64224 - RNA, 23 nt, Artificial Sequence
  RNA Oligomer
auuuccuaauacugucauccuca

SEQ ID NO: 64225 - RNA, 23 nt, Artificial Sequence
  RNA Oligomer
guuucauguuaguuaccuuauag

SEQ ID NO: 64226 - RNA, 23 nt, Artificial Sequence
  RNA Oligomer
gguuucauguuaguuaccuuaua

SEQ ID NO: 64227 - RNA, 23 nt, Artificial Sequence
  RNA Oligomer
ugguuucauguuaguuaccuuau

SEQ ID NO: 64228 - RNA, 23 nt, Artificial Sequence
  RNA Oligomer
gugguuucauguuaguuaccuua

SEQ ID NO: 64229 - RNA, 23 nt, Artificial Sequence
  RNA Oligomer
ugugguuucauguuaguuaccuu

SEQ ID NO: 64230 - RNA, 23 nt, Artificial Sequence
  RNA Oligomer
gccuauuaucugucagcugcaag

SEQ ID NO: 64231 - RNA, 23 nt, Artificial Sequence
  RNA Oligomer
ugccuauuaucugucagcugcaa

SEQ ID NO: 64232 - RNA, 23 nt, Artificial Sequence
  RNA Oligomer
cugccuauuaucugucagcugca

SEQ ID NO: 64233 - RNA, 23 nt, Artificial Sequence
  RNA Oligomer
ccugccuauuaucugucagcugc

SEQ ID NO: 64234 - RNA, 23 nt, Artificial Sequence
  RNA Oligomer
uucaaggaauuucuuaacuucuu

SEQ ID NO: 64235 - RNA, 23 nt, Artificial Sequence
  RNA Oligomer
auucaaggaauuucuuaacuucu

SEQ ID NO: 64236 - RNA, 23 nt, Artificial Sequence
  RNA Oligomer
aauucaaggaauuucuuaacuuc

SEQ ID NO: 64237 - RNA, 23 nt, Artificial Sequence
  RNA Oligomer
agguuuuugaaauggcuacgaga

SEQ ID NO: 64238 - RNA, 23 nt, Artificial Sequence
  RNA Oligomer
gagguuuuugaaauggcuacgag

SEQ ID NO: 64239 - RNA, 23 nt, Artificial Sequence
  RNA Oligomer
gggagcuagccaagaugaagcag

SEQ ID NO: 64240 - RNA, 23 nt, Artificial Sequence
  RNA Oligomer
cgggagcuagccaagaugaagca

SEQ ID NO: 64241 - RNA, 23 nt, Artificial Sequence
  RNA Oligomer
gcgggagcuagccaagaugaagc

SEQ ID NO: 64242 - RNA, 23 nt, Artificial Sequence
  RNA Oligomer
ggcgggagcuagccaagaugaag

SEQ ID NO: 64243 - RNA, 23 nt, Artificial Sequence
  RNA Oligomer
aggcgggagcuagccaagaugaa

SEQ ID NO: 64244 - RNA, 23 nt, Artificial Sequence
  RNA Oligomer
auccugguugggaauaagaagga

SEQ ID NO: 64245 - RNA, 23 nt, Artificial Sequence
  RNA Oligomer
uccaucgacagcccugauaguuu

SEQ ID NO: 64246 - RNA, 23 nt, Artificial Sequence
  RNA Oligomer
uuccaucgacagcccugauaguu

SEQ ID NO: 64247 - RNA, 23 nt, Artificial Sequence
  RNA Oligomer
uuuccaucgacagcccugauagu

SEQ ID NO: 64248 - RNA, 23 nt, Artificial Sequence
  RNA Oligomer
uuuuccaucgacagcccugauag

SEQ ID NO: 64249 - RNA, 23 nt, Artificial Sequence
  RNA Oligomer
uuuuuccaucgacagcccugaua

SEQ ID NO: 64250 - RNA, 23 nt, Artificial Sequence
  RNA Oligomer
gcugacuaaacuuuuuuucugua

SEQ ID NO: 64251 - RNA, 23 nt, Artificial Sequence
  RNA Oligomer
agcugacuaaacuuuuuuucugu

SEQ ID NO: 64252 - RNA, 23 nt, Artificial Sequence
  RNA Oligomer
cagcugacuaaacuuuuuuucug

SEQ ID NO: 64253 - RNA, 23 nt, Artificial Sequence
  RNA Oligomer
ccagcugacuaaacuuuuuuucu

SEQ ID NO: 64254 - RNA, 23 nt, Artificial Sequence
  RNA Oligomer
uccagcugacuaaacuuuuuuuc

SEQ ID NO: 64255 - RNA, 23 nt, Artificial Sequence
  RNA Oligomer
cacucagucucucuucucuccag

SEQ ID NO: 64256 - RNA, 23 nt, Artificial Sequence
  RNA Oligomer
ccaguucccagagguguaugugc

SEQ ID NO: 64257 - RNA, 23 nt, Artificial Sequence
  RNA Oligomer
accaguucccagagguguaugug

SEQ ID NO: 64258 - RNA, 23 nt, Artificial Sequence
  RNA Oligomer
gaccaguucccagagguguaugu

SEQ ID NO: 64259 - RNA, 23 nt, Artificial Sequence
  RNA Oligomer
ggaccaguucccagagguguaug

SEQ ID NO: 64260 - RNA, 23 nt, Artificial Sequence
  RNA Oligomer
aggaccaguucccagagguguau

SEQ ID NO: 64261 - RNA, 23 nt, Artificial Sequence
  RNA Oligomer
gguuaauuuugaagugcuguuua

SEQ ID NO: 64262 - RNA, 23 nt, Artificial Sequence
  RNA Oligomer
cuccuacccagauaccgauguua

SEQ ID NO: 64263 - RNA, 23 nt, Artificial Sequence
  RNA Oligomer
ucuccuacccagauaccgauguu

SEQ ID NO: 64264 - RNA, 23 nt, Artificial Sequence
  RNA Oligomer
cucuccuacccagauaccgaugu

SEQ ID NO: 64265 - RNA, 23 nt, Artificial Sequence
  RNA Oligomer
gguggauggaaagcagguagagu

SEQ ID NO: 64266 - RNA, 23 nt, Artificial Sequence
  RNA Oligomer
agguggauggaaagcagguagag

SEQ ID NO: 64267 - RNA, 23 nt, Artificial Sequence
  RNA Oligomer
gagguggauggaaagcagguaga

SEQ ID NO: 64268 - RNA, 23 nt, Artificial Sequence
  RNA Oligomer
cgagguggauggaaagcagguag

SEQ ID NO: 64269 - RNA, 23 nt, Artificial Sequence
  RNA Oligomer
ucgagguggauggaaagcaggua

SEQ ID NO: 64270 - RNA, 23 nt, Artificial Sequence
  RNA Oligomer
gcagauaucgagguggauggaaa

SEQ ID NO: 64271 - RNA, 23 nt, Artificial Sequence
  RNA Oligomer
gcucuuuucuccucacuguaucc

SEQ ID NO: 64272 - RNA, 23 nt, Artificial Sequence
  RNA Oligomer
ugcucuuuucuccucacuguauc

SEQ ID NO: 64273 - RNA, 23 nt, Artificial Sequence
  RNA Oligomer
cacgccugaggcaauuagacacu

SEQ ID NO: 64274 - RNA, 23 nt, Artificial Sequence
  RNA Oligomer
gaaauaaagucagauggaaaauu

SEQ ID NO: 64275 - RNA, 23 nt, Artificial Sequence
  RNA Oligomer
ggaaauaaagucagauggaaaau

SEQ ID NO: 64276 - RNA, 23 nt, Artificial Sequence
  RNA Oligomer
cugugguuucauguuaguuaccu

SEQ ID NO: 64277 - RNA, 23 nt, Artificial Sequence
  RNA Oligomer
ucugugguuucauguuaguuacc

SEQ ID NO: 64278 - RNA, 23 nt, Artificial Sequence
  RNA Oligomer
uucugugguuucauguuaguuac

SEQ ID NO: 64279 - RNA, 23 nt, Artificial Sequence
  RNA Oligomer
ggaucuucggaaugaugagcaca

SEQ ID NO: 64280 - RNA, 23 nt, Artificial Sequence
  RNA Oligomer
aggaucuucggaaugaugagcac

SEQ ID NO: 64281 - RNA, 23 nt, Artificial Sequence
  RNA Oligomer
aaggaucuucggaaugaugagca

SEQ ID NO: 64282 - RNA, 23 nt, Artificial Sequence
  RNA Oligomer
gauguuauacugauguguuuuuc

SEQ ID NO: 64283 - RNA, 23 nt, Artificial Sequence
  RNA Oligomer
gaacuauguggcagauaucgagg

SEQ ID NO: 64284 - RNA, 23 nt, Artificial Sequence
  RNA Oligomer
cgucgguucucucguuaguccac

SEQ ID NO: 64285 - RNA, 23 nt, Artificial Sequence
  RNA Oligomer
ccgucgguucucucguuagucca

SEQ ID NO: 64286 - RNA, 23 nt, Artificial Sequence
  RNA Oligomer
uccgucgguucucucguuagucc

SEQ ID NO: 64287 - RNA, 23 nt, Artificial Sequence
  RNA Oligomer
cuccgucgguucucucguuaguc

SEQ ID NO: 64288 - RNA, 23 nt, Artificial Sequence
  RNA Oligomer
ccuccgucgguucucucguuagu

SEQ ID NO: 64289 - RNA, 23 nt, Artificial Sequence
  RNA Oligomer
cugucauccucaaagaaagugua

SEQ ID NO: 64290 - RNA, 23 nt, Artificial Sequence
  RNA Oligomer
acugucauccucaaagaaagugu

SEQ ID NO: 64291 - RNA, 23 nt, Artificial Sequence
  RNA Oligomer
uacugucauccucaaagaaagug

SEQ ID NO: 64292 - RNA, 23 nt, Artificial Sequence
  RNA Oligomer
auacugucauccucaaagaaagu

SEQ ID NO: 64293 - RNA, 23 nt, Artificial Sequence
  RNA Oligomer
aauacugucauccucaaagaaag

SEQ ID NO: 64294 - RNA, 23 nt, Artificial Sequence
  RNA Oligomer
uaauacugucauccucaaagaaa

SEQ ID NO: 64295 - RNA, 23 nt, Artificial Sequence
  RNA Oligomer
ggauggaaagcagguagaguugg

SEQ ID NO: 64296 - RNA, 23 nt, Artificial Sequence
  RNA Oligomer
uggauggaaagcagguagaguug

SEQ ID NO: 64297 - RNA, 23 nt, Artificial Sequence
  RNA Oligomer
guggauggaaagcagguagaguu

SEQ ID NO: 64298 - RNA, 23 nt, Artificial Sequence
  RNA Oligomer
auaucgagguggauggaaagcag

SEQ ID NO: 64299 - RNA, 23 nt, Artificial Sequence
  RNA Oligomer
gauaucgagguggauggaaagca

SEQ ID NO: 64300 - RNA, 23 nt, Artificial Sequence
  RNA Oligomer
agauaucgagguggauggaaagc

SEQ ID NO: 64301 - RNA, 23 nt, Artificial Sequence
  RNA Oligomer
cagauaucgagguggauggaaag

SEQ ID NO: 64302 - RNA, 23 nt, Artificial Sequence
  RNA Oligomer
cagucucucuucucuccagcuga

SEQ ID NO: 64303 - RNA, 23 nt, Artificial Sequence
  RNA Oligomer
ucagucucucuucucuccagcug

SEQ ID NO: 64304 - RNA, 23 nt, Artificial Sequence
  RNA Oligomer
cucagucucucuucucuccagcu

SEQ ID NO: 64305 - RNA, 23 nt, Artificial Sequence
  RNA Oligomer
acucagucucucuucucuccagc

SEQ ID NO: 64306 - RNA, 23 nt, Artificial Sequence
  RNA Oligomer
cucuuuucuccucacuguaucca

SEQ ID NO: 64307 - RNA, 23 nt, Artificial Sequence
  RNA Oligomer
gaccaaagauggagugagagagg

SEQ ID NO: 64308 - RNA, 23 nt, Artificial Sequence
  RNA Oligomer
agaccaaagauggagugagagag

SEQ ID NO: 64309 - RNA, 23 nt, Artificial Sequence
  RNA Oligomer
aagaccaaagauggagugagaga

SEQ ID NO: 64310 - RNA, 23 nt, Artificial Sequence
  RNA Oligomer
aaagaccaaagauggagugagag

SEQ ID NO: 64311 - RNA, 23 nt, Artificial Sequence
  RNA Oligomer
caaagaccaaagauggagugaga

SEQ ID NO: 64312 - RNA, 23 nt, Artificial Sequence
  RNA Oligomer
ggagcuagccaagaugaagcagg

SEQ ID NO: 64313 - RNA, 23 nt, Artificial Sequence
  RNA Oligomer
auccucaaagaaaguguauuggu

SEQ ID NO: 64314 - RNA, 23 nt, Artificial Sequence
  RNA Oligomer
cugcaagguacucuggugaguca

SEQ ID NO: 64315 - RNA, 23 nt, Artificial Sequence
  RNA Oligomer
gcugcaagguacucuggugaguc

SEQ ID NO: 64316 - RNA, 23 nt, Artificial Sequence
  RNA Oligomer
agcugcaagguacucuggugagu

SEQ ID NO: 64317 - RNA, 23 nt, Artificial Sequence
  RNA Oligomer
cagcugcaagguacucuggugag

SEQ ID NO: 64318 - RNA, 23 nt, Artificial Sequence
  RNA Oligomer
ucagcugcaagguacucugguga

SEQ ID NO: 64319 - RNA, 23 nt, Artificial Sequence
  RNA Oligomer
caggguccuuuugacacugcucu

SEQ ID NO: 64320 - RNA, 23 nt, Artificial Sequence
  RNA Oligomer
ccaggguccuuuugacacugcuc

SEQ ID NO: 64321 - RNA, 23 nt, Artificial Sequence
  RNA Oligomer
accaggguccuuuugacacugcu

SEQ ID NO: 64322 - RNA, 23 nt, Artificial Sequence
  RNA Oligomer
acagcccuuaugcgguuaauuuu

SEQ ID NO: 64323 - RNA, 23 nt, Artificial Sequence
  RNA Oligomer
cacagcccuuaugcgguuaauuu

SEQ ID NO: 64324 - RNA, 23 nt, Artificial Sequence
  RNA Oligomer
gcacagcccuuaugcgguuaauu

SEQ ID NO: 64325 - RNA, 23 nt, Artificial Sequence
  RNA Oligomer
agcacagcccuuaugcgguuaau

SEQ ID NO: 64326 - RNA, 23 nt, Artificial Sequence
  RNA Oligomer
aagcacagcccuuaugcgguuaa

SEQ ID NO: 64327 - RNA, 23 nt, Artificial Sequence
  RNA Oligomer
ucauccugguugggaauaagaag

SEQ ID NO: 64328 - RNA, 23 nt, Artificial Sequence
  RNA Oligomer
aucauccugguugggaauaagaa

SEQ ID NO: 64329 - RNA, 23 nt, Artificial Sequence
  RNA Oligomer
caucauccugguugggaauaaga

SEQ ID NO: 64330 - RNA, 23 nt, Artificial Sequence
  RNA Oligomer
ccaucauccugguugggaauaag

SEQ ID NO: 64331 - RNA, 23 nt, Artificial Sequence
  RNA Oligomer
cccaucauccugguugggaauaa

SEQ ID NO: 64332 - RNA, 23 nt, Artificial Sequence
  RNA Oligomer
auggaaagcagguagaguuggcu

SEQ ID NO: 64333 - RNA, 23 nt, Artificial Sequence
  RNA Oligomer
gauggaaagcagguagaguuggc

SEQ ID NO: 64334 - RNA, 23 nt, Artificial Sequence
  RNA Oligomer
ggaauugguuucacgccugaggc

SEQ ID NO: 64335 - RNA, 23 nt, Artificial Sequence
  RNA Oligomer
aggaauugguuucacgccugagg

SEQ ID NO: 64336 - RNA, 23 nt, Artificial Sequence
  RNA Oligomer
uaggaauugguuucacgccugag

SEQ ID NO: 64337 - RNA, 23 nt, Artificial Sequence
  RNA Oligomer
auaggaauugguuucacgccuga

SEQ ID NO: 64338 - RNA, 23 nt, Artificial Sequence
  RNA Oligomer
aauaggaauugguuucacgccug

SEQ ID NO: 64339 - RNA, 23 nt, Artificial Sequence
  RNA Oligomer
aguauuuagaagccaacuaugau

SEQ ID NO: 64340 - RNA, 23 nt, Artificial Sequence
  RNA Oligomer
caguauuuagaagccaacuauga

SEQ ID NO: 64341 - RNA, 23 nt, Artificial Sequence
  RNA Oligomer
cagcccuuaugcgguuaauuuug

SEQ ID NO: 64342 - RNA, 23 nt, Artificial Sequence
  RNA Oligomer
gccuugucuugugaaaccuugcu

SEQ ID NO: 64343 - RNA, 23 nt, Artificial Sequence
  RNA Oligomer
ugccuugucuugugaaaccuugc

SEQ ID NO: 64344 - RNA, 23 nt, Artificial Sequence
  RNA Oligomer
gugccuugucuugugaaaccuug

SEQ ID NO: 64345 - RNA, 23 nt, Artificial Sequence
  RNA Oligomer
cgguucucucguuaguccacggu

SEQ ID NO: 64346 - RNA, 23 nt, Artificial Sequence
  RNA Oligomer
ucgguucucucguuaguccacgg

SEQ ID NO: 64347 - RNA, 23 nt, Artificial Sequence
  RNA Oligomer
gucgguucucucguuaguccacg

SEQ ID NO: 64348 - RNA, 23 nt, Artificial Sequence
  RNA Oligomer
gccggugaaaccugaagaaggca

SEQ ID NO: 64349 - RNA, 23 nt, Artificial Sequence
  RNA Oligomer
agccggugaaaccugaagaaggc

SEQ ID NO: 64350 - RNA, 23 nt, Artificial Sequence
  RNA Oligomer
gagccggugaaaccugaagaagg

SEQ ID NO: 64351 - RNA, 23 nt, Artificial Sequence
  RNA Oligomer
ggagccggugaaaccugaagaag

SEQ ID NO: 64352 - RNA, 23 nt, Artificial Sequence
  RNA Oligomer
aggagccggugaaaccugaagaa

SEQ ID NO: 64353 - RNA, 23 nt, Artificial Sequence
  RNA Oligomer
gggcaggaagauuaugaucgccu

SEQ ID NO: 64354 - RNA, 23 nt, Artificial Sequence
  RNA Oligomer
ccaguuaauuuuuccaacuacua

SEQ ID NO: 64355 - RNA, 23 nt, Artificial Sequence
  RNA Oligomer
uggagccuguggaaagacaugcu

SEQ ID NO: 64356 - RNA, 23 nt, Artificial Sequence
  RNA Oligomer
auggagccuguggaaagacaugc

SEQ ID NO: 64357 - RNA, 23 nt, Artificial Sequence
  RNA Oligomer
gauggagccuguggaaagacaug

SEQ ID NO: 64358 - RNA, 23 nt, Artificial Sequence
  RNA Oligomer
ugauggagccuguggaaagacau

SEQ ID NO: 64359 - RNA, 23 nt, Artificial Sequence
  RNA Oligomer
gcccuuaugcgguuaauuuugaa

SEQ ID NO: 64360 - RNA, 23 nt, Artificial Sequence
  RNA Oligomer
agcccuuaugcgguuaauuuuga

SEQ ID NO: 64361 - RNA, 23 nt, Artificial Sequence
  RNA Oligomer
gcaaagaccaaagauggagugag

SEQ ID NO: 64362 - RNA, 23 nt, Artificial Sequence
  RNA Oligomer
gcccaucauccugguugggaaua

SEQ ID NO: 64363 - RNA, 23 nt, Artificial Sequence
  RNA Oligomer
ugcccaucauccugguugggaau

SEQ ID NO: 64364 - RNA, 23 nt, Artificial Sequence
  RNA Oligomer
gugcccaucauccugguugggaa

SEQ ID NO: 64365 - RNA, 23 nt, Artificial Sequence
  RNA Oligomer
cuccagcugacuaaacuuuuuuu

SEQ ID NO: 64366 - RNA, 23 nt, Artificial Sequence
  RNA Oligomer
ucuccagcugacuaaacuuuuuu

SEQ ID NO: 64367 - RNA, 23 nt, Artificial Sequence
  RNA Oligomer
cucuccagcugacuaaacuuuuu

SEQ ID NO: 64368 - RNA, 23 nt, Artificial Sequence
  RNA Oligomer
cccguuuugucacuuuuucugau

SEQ ID NO: 64369 - RNA, 23 nt, Artificial Sequence
  RNA Oligomer
ucccguuuugucacuuuuucuga

SEQ ID NO: 64370 - RNA, 23 nt, Artificial Sequence
  RNA Oligomer
uucccguuuugucacuuuuucug

SEQ ID NO: 64371 - RNA, 23 nt, Artificial Sequence
  RNA Oligomer
auucccguuuugucacuuuuucu

SEQ ID NO: 64372 - RNA, 23 nt, Artificial Sequence
  RNA Oligomer
aauucccguuuugucacuuuuuc

SEQ ID NO: 64373 - RNA, 23 nt, Artificial Sequence
  RNA Oligomer
gaguuacaguucugugguuucau

SEQ ID NO: 64374 - RNA, 23 nt, Artificial Sequence
  RNA Oligomer
agaguuacaguucugugguuuca

SEQ ID NO: 64375 - RNA, 23 nt, Artificial Sequence
  RNA Oligomer
cagaguuacaguucugugguuuc

SEQ ID NO: 64376 - RNA, 23 nt, Artificial Sequence
  RNA Oligomer
caccaggguccuuuugacacugc

SEQ ID NO: 64377 - RNA, 23 nt, Artificial Sequence
  RNA Oligomer
ccaccaggguccuuuugacacug

SEQ ID NO: 64378 - RNA, 23 nt, Artificial Sequence
  RNA Oligomer
cccaccaggguccuuuugacacu

SEQ ID NO: 64379 - RNA, 23 nt, Artificial Sequence
  RNA Oligomer
accaaagauggagugagagaggu

SEQ ID NO: 64380 - RNA, 23 nt, Artificial Sequence
  RNA Oligomer
gaguuggcuuugugggacacagc

SEQ ID NO: 64381 - RNA, 23 nt, Artificial Sequence
  RNA Oligomer
ugugcccacaguguuugagaacu

SEQ ID NO: 64382 - RNA, 23 nt, Artificial Sequence
  RNA Oligomer
augugcccacaguguuugagaac

SEQ ID NO: 64383 - RNA, 23 nt, Artificial Sequence
  RNA Oligomer
uaugugcccacaguguuugagaa

SEQ ID NO: 64384 - RNA, 23 nt, Artificial Sequence
  RNA Oligomer
ccucacuguauccagguucccuc

SEQ ID NO: 64385 - RNA, 23 nt, Artificial Sequence
  RNA Oligomer
uccucacuguauccagguucccu

SEQ ID NO: 64386 - RNA, 23 nt, Artificial Sequence
  RNA Oligomer
cuccucacuguauccagguuccc

SEQ ID NO: 64387 - RNA, 23 nt, Artificial Sequence
  RNA Oligomer
ucuccucacuguauccagguucc

SEQ ID NO: 64388 - RNA, 23 nt, Artificial Sequence
  RNA Oligomer
uucuccucacuguauccagguuc

SEQ ID NO: 64389 - RNA, 23 nt, Artificial Sequence
  RNA Oligomer
uuuucugauaaaagauggccaua

SEQ ID NO: 64390 - RNA, 23 nt, Artificial Sequence
  RNA Oligomer
uuuuucugauaaaagauggccau

SEQ ID NO: 64391 - RNA, 23 nt, Artificial Sequence
  RNA Oligomer
caaaucagaagucaucuugcuac

SEQ ID NO: 64392 - RNA, 23 nt, Artificial Sequence
  RNA Oligomer
acaaaucagaagucaucuugcua

SEQ ID NO: 64393 - RNA, 23 nt, Artificial Sequence
  RNA Oligomer
uacaaaucagaagucaucuugcu

SEQ ID NO: 64394 - RNA, 23 nt, Artificial Sequence
  RNA Oligomer
uuacaaaucagaagucaucuugc

SEQ ID NO: 64395 - RNA, 23 nt, Artificial Sequence
  RNA Oligomer
auuacaaaucagaagucaucuug

SEQ ID NO: 64396 - RNA, 23 nt, Artificial Sequence
  RNA Oligomer
caagcacagcccuuaugcgguua

SEQ ID NO: 64397 - RNA, 23 nt, Artificial Sequence
  RNA Oligomer
agcaaagaccaaagauggaguga

SEQ ID NO: 64398 - RNA, 23 nt, Artificial Sequence
  RNA Oligomer
cagcaaagaccaaagauggagug

SEQ ID NO: 64399 - RNA, 23 nt, Artificial Sequence
  RNA Oligomer
ucagcaaagaccaaagauggagu

SEQ ID NO: 64400 - RNA, 23 nt, Artificial Sequence
  RNA Oligomer
uucagcaaagaccaaagauggag

SEQ ID NO: 64401 - RNA, 23 nt, Artificial Sequence
  RNA Oligomer
gaauugguuucacgccugaggca

SEQ ID NO: 64402 - RNA, 23 nt, Artificial Sequence
  RNA Oligomer
uuacuccguaacagauuuuguug

SEQ ID NO: 64403 - RNA, 23 nt, Artificial Sequence
  RNA Oligomer
uuuacuccguaacagauuuuguu

SEQ ID NO: 64404 - RNA, 23 nt, Artificial Sequence
  RNA Oligomer
cuuuacuccguaacagauuuugu

SEQ ID NO: 64405 - RNA, 23 nt, Artificial Sequence
  RNA Oligomer
gcuuuacuccguaacagauuuug

SEQ ID NO: 64406 - RNA, 23 nt, Artificial Sequence
  RNA Oligomer
ggcuuuacuccguaacagauuuu

SEQ ID NO: 64407 - RNA, 23 nt, Artificial Sequence
  RNA Oligomer
cgcuaauucaaggaauuucuuaa

SEQ ID NO: 64408 - RNA, 23 nt, Artificial Sequence
  RNA Oligomer
gcgcuaauucaaggaauuucuua

SEQ ID NO: 64409 - RNA, 23 nt, Artificial Sequence
  RNA Oligomer
ugacacaccaggcgcuaauucaa

SEQ ID NO: 64410 - RNA, 23 nt, Artificial Sequence
  RNA Oligomer
cugacacaccaggcgcuaauuca

SEQ ID NO: 64411 - RNA, 23 nt, Artificial Sequence
  RNA Oligomer
ccugacacaccaggcgcuaauuc

SEQ ID NO: 64412 - RNA, 23 nt, Artificial Sequence
  RNA Oligomer
accugacacaccaggcgcuaauu

SEQ ID NO: 64413 - RNA, 23 nt, Artificial Sequence
  RNA Oligomer
caccugacacaccaggcgcuaau

SEQ ID NO: 64414 - RNA, 23 nt, Artificial Sequence
  RNA Oligomer
gauuacaaaucagaagucaucuu

SEQ ID NO: 64415 - RNA, 23 nt, Artificial Sequence
  RNA Oligomer
uuucuccucacuguauccagguu

SEQ ID NO: 64416 - RNA, 23 nt, Artificial Sequence
  RNA Oligomer
cuuaagcaucuggcucuaauuca

SEQ ID NO: 64417 - RNA, 23 nt, Artificial Sequence
  RNA Oligomer
acuuaagcaucuggcucuaauuc

SEQ ID NO: 64418 - RNA, 23 nt, Artificial Sequence
  RNA Oligomer
gacuuaagcaucuggcucuaauu

SEQ ID NO: 64419 - RNA, 23 nt, Artificial Sequence
  RNA Oligomer
ggacuuaagcaucuggcucuaau

SEQ ID NO: 64420 - RNA, 23 nt, Artificial Sequence
  RNA Oligomer
aaauucccguuuugucacuuuuu

SEQ ID NO: 64421 - RNA, 23 nt, Artificial Sequence
  RNA Oligomer
ucuugcuucuuucuagaaagaga

SEQ ID NO: 64422 - RNA, 23 nt, Artificial Sequence
  RNA Oligomer
acacugcucuaacagcccuccuc

SEQ ID NO: 64423 - RNA, 23 nt, Artificial Sequence
  RNA Oligomer
gacacugcucuaacagcccuccu

SEQ ID NO: 64424 - RNA, 23 nt, Artificial Sequence
  RNA Oligomer
ugacacugcucuaacagcccucc

SEQ ID NO: 64425 - RNA, 23 nt, Artificial Sequence
  RNA Oligomer
uugacacugcucuaacagcccuc

SEQ ID NO: 64426 - RNA, 23 nt, Artificial Sequence
  RNA Oligomer
uuugacacugcucuaacagcccu

SEQ ID NO: 64427 - RNA, 23 nt, Artificial Sequence
  RNA Oligomer
ggauucguugccugagcaauggc

SEQ ID NO: 64428 - RNA, 23 nt, Artificial Sequence
  RNA Oligomer
cggauucguugccugagcaaugg

SEQ ID NO: 64429 - RNA, 23 nt, Artificial Sequence
  RNA Oligomer
ucggauucguugccugagcaaug

SEQ ID NO: 64430 - RNA, 23 nt, Artificial Sequence
  RNA Oligomer
cucggauucguugccugagcaau

SEQ ID NO: 64431 - RNA, 23 nt, Artificial Sequence
  RNA Oligomer
acucggauucguugccugagcaa

SEQ ID NO: 64432 - RNA, 23 nt, Artificial Sequence
  RNA Oligomer
uccuccgucgguucucucguuag

SEQ ID NO: 64433 - RNA, 23 nt, Artificial Sequence
  RNA Oligomer
guccuccgucgguucucucguua

SEQ ID NO: 64434 - RNA, 23 nt, Artificial Sequence
  RNA Oligomer
uggcucuaauucacagugcucuu

SEQ ID NO: 64435 - RNA, 23 nt, Artificial Sequence
  RNA Oligomer
cuggcucuaauucacagugcucu

SEQ ID NO: 64436 - RNA, 23 nt, Artificial Sequence
  RNA Oligomer
gaagauggcauaaccugucucac

SEQ ID NO: 64437 - RNA, 23 nt, Artificial Sequence
  RNA Oligomer
ggaagauggcauaaccugucuca

SEQ ID NO: 64438 - RNA, 23 nt, Artificial Sequence
  RNA Oligomer
uggaagauggcauaaccugucuc

SEQ ID NO: 64439 - RNA, 23 nt, Artificial Sequence
  RNA Oligomer
uuggaagauggcauaaccugucu

SEQ ID NO: 64440 - RNA, 23 nt, Artificial Sequence
  RNA Oligomer
uuuggaagauggcauaaccuguc

SEQ ID NO: 64441 - RNA, 23 nt, Artificial Sequence
  RNA Oligomer
cuuuggaagauggcauaaccugu

SEQ ID NO: 64442 - RNA, 23 nt, Artificial Sequence
  RNA Oligomer
uaaauucccguuuugucacuuuu

SEQ ID NO: 64443 - RNA, 23 nt, Artificial Sequence
  RNA Oligomer
ugcagcuguggcagaguuacagu

SEQ ID NO: 64444 - RNA, 23 nt, Artificial Sequence
  RNA Oligomer
augcagcuguggcagaguuacag

SEQ ID NO: 64445 - RNA, 23 nt, Artificial Sequence
  RNA Oligomer
caugcagcuguggcagaguuaca

SEQ ID NO: 64446 - RNA, 23 nt, Artificial Sequence
  RNA Oligomer
ucaugcagcuguggcagaguuac

SEQ ID NO: 64447 - RNA, 23 nt, Artificial Sequence
  RNA Oligomer
uucaugcagcuguggcagaguua

SEQ ID NO: 64448 - RNA, 23 nt, Artificial Sequence
  RNA Oligomer
uccguaacagauuuuguuggcau

SEQ ID NO: 64449 - RNA, 23 nt, Artificial Sequence
  RNA Oligomer
cuccguaacagauuuuguuggca

SEQ ID NO: 64450 - RNA, 23 nt, Artificial Sequence
  RNA Oligomer
cuaacauguccugccuauuaucu

SEQ ID NO: 64451 - RNA, 23 nt, Artificial Sequence
  RNA Oligomer
acuaacauguccugccuauuauc

SEQ ID NO: 64452 - RNA, 23 nt, Artificial Sequence
  RNA Oligomer
aacuaacauguccugccuauuau

SEQ ID NO: 64453 - RNA, 23 nt, Artificial Sequence
  RNA Oligomer
uaacuaacauguccugccuauua

SEQ ID NO: 64454 - RNA, 23 nt, Artificial Sequence
  RNA Oligomer
gcuaauucaaggaauuucuuaac

SEQ ID NO: 64455 - RNA, 23 nt, Artificial Sequence
  RNA Oligomer
cccuuaugcgguuaauuuugaag

SEQ ID NO: 64456 - RNA, 23 nt, Artificial Sequence
  RNA Oligomer
ggaauaagaaggaucuucggaau

SEQ ID NO: 64457 - RNA, 23 nt, Artificial Sequence
  RNA Oligomer
gggaauaagaaggaucuucggaa

SEQ ID NO: 64458 - RNA, 23 nt, Artificial Sequence
  RNA Oligomer
ugggaauaagaaggaucuucgga

SEQ ID NO: 64459 - RNA, 23 nt, Artificial Sequence
  RNA Oligomer
uugggaauaagaaggaucuucgg

SEQ ID NO: 64460 - RNA, 23 nt, Artificial Sequence
  RNA Oligomer
guugggaauaagaaggaucuucg

SEQ ID NO: 64461 - RNA, 23 nt, Artificial Sequence
  RNA Oligomer
uagaaaacaucccagaaaagugg

SEQ ID NO: 64462 - RNA, 23 nt, Artificial Sequence
  RNA Oligomer
uuagaaaacaucccagaaaagug

SEQ ID NO: 64463 - RNA, 23 nt, Artificial Sequence
  RNA Oligomer
ucuggcucuaauucacagugcuc

SEQ ID NO: 64464 - RNA, 23 nt, Artificial Sequence
  RNA Oligomer
aucuggcucuaauucacagugcu

SEQ ID NO: 64465 - RNA, 23 nt, Artificial Sequence
  RNA Oligomer
caucuggcucuaauucacagugc

SEQ ID NO: 64466 - RNA, 23 nt, Artificial Sequence
  RNA Oligomer
ucacgccugaggcaauuagacac

SEQ ID NO: 64467 - RNA, 23 nt, Artificial Sequence
  RNA Oligomer
uucacgccugaggcaauuagaca

SEQ ID NO: 64468 - RNA, 23 nt, Artificial Sequence
  RNA Oligomer
uuucacgccugaggcaauuagac

SEQ ID NO: 64469 - RNA, 23 nt, Artificial Sequence
  RNA Oligomer
guuucacgccugaggcaauuaga

SEQ ID NO: 64470 - RNA, 23 nt, Artificial Sequence
  RNA Oligomer
gguuucacgccugaggcaauuag

SEQ ID NO: 64471 - RNA, 23 nt, Artificial Sequence
  RNA Oligomer
ccguuuugucacuuuuucugaua

SEQ ID NO: 64472 - RNA, 23 nt, Artificial Sequence
  RNA Oligomer
aaaaugggcucaaccagaaaagc

SEQ ID NO: 64473 - RNA, 23 nt, Artificial Sequence
  RNA Oligomer
gaaaaugggcucaaccagaaaag

SEQ ID NO: 64474 - RNA, 23 nt, Artificial Sequence
  RNA Oligomer
ugaaaaugggcucaaccagaaaa

SEQ ID NO: 64475 - RNA, 23 nt, Artificial Sequence
  RNA Oligomer
uugaaaaugggcucaaccagaaa

SEQ ID NO: 64476 - RNA, 23 nt, Artificial Sequence
  RNA Oligomer
uuugaaaaugggcucaaccagaa

SEQ ID NO: 64477 - RNA, 23 nt, Artificial Sequence
  RNA Oligomer
cuucagggcuuuacuccguaaca

SEQ ID NO: 64478 - RNA, 23 nt, Artificial Sequence
  RNA Oligomer
acuucagggcuuuacuccguaac

SEQ ID NO: 64479 - RNA, 23 nt, Artificial Sequence
  RNA Oligomer
gaaauggcuacgagagcugcucu

SEQ ID NO: 64480 - RNA, 23 nt, Artificial Sequence
  RNA Oligomer
ugaaauggcuacgagagcugcuc

SEQ ID NO: 64481 - RNA, 23 nt, Artificial Sequence
  RNA Oligomer
uugaaauggcuacgagagcugcu

SEQ ID NO: 64482 - RNA, 23 nt, Artificial Sequence
  RNA Oligomer
uuugaaauggcuacgagagcugc

SEQ ID NO: 64483 - RNA, 23 nt, Artificial Sequence
  RNA Oligomer
uuuugaaauggcuacgagagcug

SEQ ID NO: 64484 - RNA, 23 nt, Artificial Sequence
  RNA Oligomer
ccggugaaaccugaagaaggcag

SEQ ID NO: 64485 - RNA, 23 nt, Artificial Sequence
  RNA Oligomer
caggagccggugaaaccugaaga

SEQ ID NO: 64486 - RNA, 23 nt, Artificial Sequence
  RNA Oligomer
aauaagaaggaucuucggaauga

SEQ ID NO: 64487 - RNA, 23 nt, Artificial Sequence
  RNA Oligomer
gaauaagaaggaucuucggaaug

SEQ ID NO: 64488 - RNA, 23 nt, Artificial Sequence
  RNA Oligomer
gcauuucugucccaacgugccca

SEQ ID NO: 64489 - RNA, 23 nt, Artificial Sequence
  RNA Oligomer
agcauuucugucccaacgugccc

SEQ ID NO: 64490 - RNA, 23 nt, Artificial Sequence
  RNA Oligomer
aagcauuucugucccaacgugcc

SEQ ID NO: 64491 - RNA, 23 nt, Artificial Sequence
  RNA Oligomer
caagcauuucugucccaacgugc

SEQ ID NO: 64492 - RNA, 23 nt, Artificial Sequence
  RNA Oligomer
ucaagcauuucugucccaacgug

SEQ ID NO: 64493 - RNA, 23 nt, Artificial Sequence
  RNA Oligomer
acggucuggucuucagcuacccg

SEQ ID NO: 64494 - RNA, 23 nt, Artificial Sequence
  RNA Oligomer
cacggucuggucuucagcuaccc

SEQ ID NO: 64495 - RNA, 23 nt, Artificial Sequence
  RNA Oligomer
ccacggucuggucuucagcuacc

SEQ ID NO: 64496 - RNA, 23 nt, Artificial Sequence
  RNA Oligomer
uccacggucuggucuucagcuac

SEQ ID NO: 64497 - RNA, 23 nt, Artificial Sequence
  RNA Oligomer
guccacggucuggucuucagcua

SEQ ID NO: 64498 - RNA, 23 nt, Artificial Sequence
  RNA Oligomer
uggacuuaagcaucuggcucuaa

SEQ ID NO: 64499 - RNA, 23 nt, Artificial Sequence
  RNA Oligomer
cuggacuuaagcaucuggcucua

SEQ ID NO: 64500 - RNA, 23 nt, Artificial Sequence
  RNA Oligomer
accuggacuuaagcaucuggcuc

SEQ ID NO: 64501 - RNA, 23 nt, Artificial Sequence
  RNA Oligomer
caccuggacuuaagcaucuggcu

SEQ ID NO: 64502 - RNA, 23 nt, Artificial Sequence
  RNA Oligomer
ucaccuggacuuaagcaucuggc

SEQ ID NO: 64503 - RNA, 23 nt, Artificial Sequence
  RNA Oligomer
cucaccuggacuuaagcaucugg

SEQ ID NO: 64504 - RNA, 23 nt, Artificial Sequence
  RNA Oligomer
ucucaccuggacuuaagcaucug

SEQ ID NO: 64505 - RNA, 23 nt, Artificial Sequence
  RNA Oligomer
gucucaccuggacuuaagcaucu

SEQ ID NO: 64506 - RNA, 23 nt, Artificial Sequence
  RNA Oligomer
ugucucaccuggacuuaagcauc

SEQ ID NO: 64507 - RNA, 23 nt, Artificial Sequence
  RNA Oligomer
cugucucaccuggacuuaagcau

SEQ ID NO: 64508 - RNA, 23 nt, Artificial Sequence
  RNA Oligomer
accugucucaccuggacuuaagc

SEQ ID NO: 64509 - RNA, 23 nt, Artificial Sequence
  RNA Oligomer
aaccugucucaccuggacuuaag

SEQ ID NO: 64510 - RNA, 23 nt, Artificial Sequence
  RNA Oligomer
uaaccugucucaccuggacuuaa

SEQ ID NO: 64511 - RNA, 23 nt, Artificial Sequence
  RNA Oligomer
auaaccugucucaccuggacuua

SEQ ID NO: 64512 - RNA, 23 nt, Artificial Sequence
  RNA Oligomer
cauaaccugucucaccuggacuu

SEQ ID NO: 64513 - RNA, 23 nt, Artificial Sequence
  RNA Oligomer
cauccucaaagaaaguguauugg

SEQ ID NO: 64514 - RNA, 23 nt, Artificial Sequence
  RNA Oligomer
ucauccucaaagaaaguguauug

SEQ ID NO: 64515 - RNA, 23 nt, Artificial Sequence
  RNA Oligomer
gucauccucaaagaaaguguauu

SEQ ID NO: 64516 - RNA, 23 nt, Artificial Sequence
  RNA Oligomer
cucaaccagaaaagcccaaguuc

SEQ ID NO: 64517 - RNA, 23 nt, Artificial Sequence
  RNA Oligomer
gcucaaccagaaaagcccaaguu

SEQ ID NO: 64518 - RNA, 23 nt, Artificial Sequence
  RNA Oligomer
acuccguaacagauuuuguuggc

SEQ ID NO: 64519 - RNA, 23 nt, Artificial Sequence
  RNA Oligomer
uacuccguaacagauuuuguugg

SEQ ID NO: 64520 - RNA, 23 nt, Artificial Sequence
  RNA Oligomer
cacuucagggcuuuacuccguaa

SEQ ID NO: 64521 - RNA, 23 nt, Artificial Sequence
  RNA Oligomer
gugaaaccugaagaaggcagaga

SEQ ID NO: 64522 - RNA, 23 nt, Artificial Sequence
  RNA Oligomer
ggugaaaccugaagaaggcagag

SEQ ID NO: 64523 - RNA, 23 nt, Artificial Sequence
  RNA Oligomer
cggugaaaccugaagaaggcaga

SEQ ID NO: 64524 - RNA, 23 nt, Artificial Sequence
  RNA Oligomer
gucaagcauuucugucccaacgu

SEQ ID NO: 64525 - RNA, 23 nt, Artificial Sequence
  RNA Oligomer
agucaagcauuucugucccaacg

SEQ ID NO: 64526 - RNA, 23 nt, Artificial Sequence
  RNA Oligomer
aagucaagcauuucugucccaac

SEQ ID NO: 64527 - RNA, 23 nt, Artificial Sequence
  RNA Oligomer
gaagucaagcauuucugucccaa

SEQ ID NO: 64528 - RNA, 23 nt, Artificial Sequence
  RNA Oligomer
cuuuuuuucuguaccaguuaauu

SEQ ID NO: 64529 - RNA, 23 nt, Artificial Sequence
  RNA Oligomer
acuuuuuuucuguaccaguuaau

SEQ ID NO: 64530 - RNA, 23 nt, Artificial Sequence
  RNA Oligomer
aacuuuuuuucuguaccaguuaa

SEQ ID NO: 64531 - RNA, 23 nt, Artificial Sequence
  RNA Oligomer
aaacuuuuuuucuguaccaguua

SEQ ID NO: 64532 - RNA, 23 nt, Artificial Sequence
  RNA Oligomer
uaaacuuuuuuucuguaccaguu

SEQ ID NO: 64533 - RNA, 23 nt, Artificial Sequence
  RNA Oligomer
ccugucucaccuggacuuaagca

SEQ ID NO: 64534 - RNA, 23 nt, Artificial Sequence
  RNA Oligomer
agauggcauaaccugucucaccu

SEQ ID NO: 64535 - RNA, 23 nt, Artificial Sequence
  RNA Oligomer
aagauggcauaaccugucucacc

SEQ ID NO: 64536 - RNA, 23 nt, Artificial Sequence
  RNA Oligomer
aaauaggaauugguuucacgccu

SEQ ID NO: 64537 - RNA, 23 nt, Artificial Sequence
  RNA Oligomer
gucaccacuucagggcuuuacuc

SEQ ID NO: 64538 - RNA, 23 nt, Artificial Sequence
  RNA Oligomer
agucaccacuucagggcuuuacu

SEQ ID NO: 64539 - RNA, 23 nt, Artificial Sequence
  RNA Oligomer
gagucaccacuucagggcuuuac

SEQ ID NO: 64540 - RNA, 23 nt, Artificial Sequence
  RNA Oligomer
ugagucaccacuucagggcuuua

SEQ ID NO: 64541 - RNA, 23 nt, Artificial Sequence
  RNA Oligomer
gugagucaccacuucagggcuuu

SEQ ID NO: 64542 - RNA, 23 nt, Artificial Sequence
  RNA Oligomer
aacauguccugccuauuaucugu

SEQ ID NO: 64543 - RNA, 23 nt, Artificial Sequence
  RNA Oligomer
uaacauguccugccuauuaucug

SEQ ID NO: 64544 - RNA, 23 nt, Artificial Sequence
  RNA Oligomer
aaucagaagucaucuugcuacca

SEQ ID NO: 64545 - RNA, 23 nt, Artificial Sequence
  RNA Oligomer
aaaucagaagucaucuugcuacc

SEQ ID NO: 64546 - RNA, 23 nt, Artificial Sequence
  RNA Oligomer
gugauggagccuguggaaagaca

SEQ ID NO: 64547 - RNA, 23 nt, Artificial Sequence
  RNA Oligomer
ugcaagcacagcccuuaugcggu

SEQ ID NO: 64548 - RNA, 23 nt, Artificial Sequence
  RNA Oligomer
cugcaagcacagcccuuaugcgg

SEQ ID NO: 64549 - RNA, 23 nt, Artificial Sequence
  RNA Oligomer
gcugcaagcacagcccuuaugcg

SEQ ID NO: 64550 - RNA, 23 nt, Artificial Sequence
  RNA Oligomer
ugcugcaagcacagcccuuaugc

SEQ ID NO: 64551 - RNA, 23 nt, Artificial Sequence
  RNA Oligomer
uugcugcaagcacagcccuuaug

SEQ ID NO: 64552 - RNA, 23 nt, Artificial Sequence
  RNA Oligomer
guucagcaaagaccaaagaugga

SEQ ID NO: 64553 - RNA, 23 nt, Artificial Sequence
  RNA Oligomer
uguucagcaaagaccaaagaugg

SEQ ID NO: 64554 - RNA, 23 nt, Artificial Sequence
  RNA Oligomer
gccauccggaagaaacuggugau

SEQ ID NO: 64555 - RNA, 23 nt, Artificial Sequence
  RNA Oligomer
agguguaugugcccacaguguuu

SEQ ID NO: 64556 - RNA, 23 nt, Artificial Sequence
  RNA Oligomer
gagguguaugugcccacaguguu

SEQ ID NO: 64557 - RNA, 23 nt, Artificial Sequence
  RNA Oligomer
agagguguaugugcccacagugu

SEQ ID NO: 64558 - RNA, 23 nt, Artificial Sequence
  RNA Oligomer
cagagguguaugugcccacagug

SEQ ID NO: 64559 - RNA, 23 nt, Artificial Sequence
  RNA Oligomer
ccagagguguaugugcccacagu

SEQ ID NO: 64560 - RNA, 23 nt, Artificial Sequence
  RNA Oligomer
cagcuguggcagaguuacaguuc

SEQ ID NO: 64561 - RNA, 23 nt, Artificial Sequence
  RNA Oligomer
gcagcuguggcagaguuacaguu

SEQ ID NO: 64562 - RNA, 23 nt, Artificial Sequence
  RNA Oligomer
aaaagcccaaguucaugcagcug

SEQ ID NO: 64563 - RNA, 23 nt, Artificial Sequence
  RNA Oligomer
gaaaagcccaaguucaugcagcu

SEQ ID NO: 64564 - RNA, 23 nt, Artificial Sequence
  RNA Oligomer
ucaccacuucagggcuuuacucc

SEQ ID NO: 64565 - RNA, 23 nt, Artificial Sequence
  RNA Oligomer
uucuugcuucuuucuagaaagag

SEQ ID NO: 64566 - RNA, 23 nt, Artificial Sequence
  RNA Oligomer
cuucuugcuucuuucuagaaaga

SEQ ID NO: 64567 - RNA, 23 nt, Artificial Sequence
  RNA Oligomer
acuucuugcuucuuucuagaaag

SEQ ID NO: 64568 - RNA, 23 nt, Artificial Sequence
  RNA Oligomer
aacuucuugcuucuuucuagaaa

SEQ ID NO: 64569 - RNA, 23 nt, Artificial Sequence
  RNA Oligomer
cuugcugcaagcacagcccuuau

SEQ ID NO: 64570 - RNA, 23 nt, Artificial Sequence
  RNA Oligomer
ucucuccagcugacuaaacuuuu

SEQ ID NO: 64571 - RNA, 23 nt, Artificial Sequence
  RNA Oligomer
uucucuccagcugacuaaacuuu

SEQ ID NO: 64572 - RNA, 23 nt, Artificial Sequence
  RNA Oligomer
ucuucucuccagcugacuaaacu

SEQ ID NO: 64573 - RNA, 23 nt, Artificial Sequence
  RNA Oligomer
uaauuggauuuccuaauacuguc

SEQ ID NO: 64574 - RNA, 23 nt, Artificial Sequence
  RNA Oligomer
ugccauccggaagaaacugguga

SEQ ID NO: 64575 - RNA, 23 nt, Artificial Sequence
  RNA Oligomer
cugccauccggaagaaacuggug

SEQ ID NO: 64576 - RNA, 23 nt, Artificial Sequence
  RNA Oligomer
gcugccauccggaagaaacuggu

SEQ ID NO: 64577 - RNA, 23 nt, Artificial Sequence
  RNA Oligomer
ugucauccucaaagaaaguguau

SEQ ID NO: 64578 - RNA, 23 nt, Artificial Sequence
  RNA Oligomer
ggugagucaccacuucagggcuu

SEQ ID NO: 64579 - RNA, 23 nt, Artificial Sequence
  RNA Oligomer
gcaagguacucuggugagucacc

SEQ ID NO: 64580 - RNA, 23 nt, Artificial Sequence
  RNA Oligomer
ugcaagguacucuggugagucac

SEQ ID NO: 64581 - RNA, 23 nt, Artificial Sequence
  RNA Oligomer
uuuuugaaauggcuacgagagcu

SEQ ID NO: 64582 - RNA, 23 nt, Artificial Sequence
  RNA Oligomer
cauccugguugggaauaagaagg

SEQ ID NO: 64583 - RNA, 23 nt, Artificial Sequence
  RNA Oligomer
ugauguguuuuuccaucgacagc

SEQ ID NO: 64584 - RNA, 23 nt, Artificial Sequence
  RNA Oligomer
cugauguguuuuuccaucgacag

SEQ ID NO: 64585 - RNA, 23 nt, Artificial Sequence
  RNA Oligomer
acugauguguuuuuccaucgaca

SEQ ID NO: 64586 - RNA, 23 nt, Artificial Sequence
  RNA Oligomer
uacugauguguuuuuccaucgac

SEQ ID NO: 64587 - RNA, 23 nt, Artificial Sequence
  RNA Oligomer
auacugauguguuuuuccaucga

SEQ ID NO: 64588 - RNA, 23 nt, Artificial Sequence
  RNA Oligomer
ccucuccuacccagauaccgaug

SEQ ID NO: 64589 - RNA, 23 nt, Artificial Sequence
  RNA Oligomer
cccucuccuacccagauaccgau

SEQ ID NO: 64590 - RNA, 23 nt, Artificial Sequence
  RNA Oligomer
ccuggacuuaagcaucuggcucu

SEQ ID NO: 64591 - RNA, 23 nt, Artificial Sequence
  RNA Oligomer
cguuuugucacuuuuucugauaa

SEQ ID NO: 64592 - RNA, 23 nt, Artificial Sequence
  RNA Oligomer
ccacuucagggcuuuacuccgua

SEQ ID NO: 64593 - RNA, 23 nt, Artificial Sequence
  RNA Oligomer
accacuucagggcuuuacuccgu

SEQ ID NO: 64594 - RNA, 23 nt, Artificial Sequence
  RNA Oligomer
caccacuucagggcuuuacuccg

SEQ ID NO: 64595 - RNA, 23 nt, Artificial Sequence
  RNA Oligomer
cucuggugagucaccacuucagg

SEQ ID NO: 64596 - RNA, 23 nt, Artificial Sequence
  RNA Oligomer
acucuggugagucaccacuucag

SEQ ID NO: 64597 - RNA, 23 nt, Artificial Sequence
  RNA Oligomer
uacucuggugagucaccacuuca

SEQ ID NO: 64598 - RNA, 23 nt, Artificial Sequence
  RNA Oligomer
guacucuggugagucaccacuuc

SEQ ID NO: 64599 - RNA, 23 nt, Artificial Sequence
  RNA Oligomer
gguacucuggugagucaccacuu

SEQ ID NO: 64600 - RNA, 23 nt, Artificial Sequence
  RNA Oligomer
gcuacgagagcugcucugcaagc

SEQ ID NO: 64601 - RNA, 23 nt, Artificial Sequence
  RNA Oligomer
ggcuacgagagcugcucugcaag

SEQ ID NO: 64602 - RNA, 23 nt, Artificial Sequence
  RNA Oligomer
uggcuacgagagcugcucugcaa

SEQ ID NO: 64603 - RNA, 23 nt, Artificial Sequence
  RNA Oligomer
guaugugcccacaguguuugaga

SEQ ID NO: 64604 - RNA, 23 nt, Artificial Sequence
  RNA Oligomer
uguaugugcccacaguguuugag

SEQ ID NO: 64605 - RNA, 23 nt, Artificial Sequence
  RNA Oligomer
guguaugugcccacaguguuuga

SEQ ID NO: 64606 - RNA, 23 nt, Artificial Sequence
  RNA Oligomer
gguguaugugcccacaguguuug

SEQ ID NO: 64607 - RNA, 23 nt, Artificial Sequence
  RNA Oligomer
gacacaccaggcgcuaauucaag

SEQ ID NO: 64608 - RNA, 23 nt, Artificial Sequence
  RNA Oligomer
cccagagguguaugugcccacag

SEQ ID NO: 64609 - RNA, 23 nt, Artificial Sequence
  RNA Oligomer
ucccagagguguaugugcccaca

SEQ ID NO: 64610 - RNA, 23 nt, Artificial Sequence
  RNA Oligomer
acacaccaggcgcuaauucaagg

SEQ ID NO: 64611 - RNA, 23 nt, Artificial Sequence
  RNA Oligomer
agcuagccaagaugaagcaggag

SEQ ID NO: 64612 - RNA, 23 nt, Artificial Sequence
  RNA Oligomer
gagcuagccaagaugaagcagga

SEQ ID NO: 64613 - RNA, 23 nt, Artificial Sequence
  RNA Oligomer
gauguguuuuuccaucgacagcc

SEQ ID NO: 64614 - RNA, 23 nt, Artificial Sequence
  RNA Oligomer
cucuucucuccagcugacuaaac

SEQ ID NO: 64615 - RNA, 23 nt, Artificial Sequence
  RNA Oligomer
ucucuucucuccagcugacuaaa

SEQ ID NO: 64616 - RNA, 23 nt, Artificial Sequence
  RNA Oligomer
cucucuucucuccagcugacuaa

SEQ ID NO: 64617 - RNA, 23 nt, Artificial Sequence
  RNA Oligomer
agguacucuggugagucaccacu

SEQ ID NO: 64618 - RNA, 23 nt, Artificial Sequence
  RNA Oligomer
aagguacucuggugagucaccac

SEQ ID NO: 64619 - RNA, 23 nt, Artificial Sequence
  RNA Oligomer
caagguacucuggugagucacca

SEQ ID NO: 64620 - RNA, 23 nt, Artificial Sequence
  RNA Oligomer
gucagcugcaagguacucuggug

SEQ ID NO: 64621 - RNA, 23 nt, Artificial Sequence
  RNA Oligomer
ugucagcugcaagguacucuggu

SEQ ID NO: 64622 - RNA, 23 nt, Artificial Sequence
  RNA Oligomer
cugucagcugcaagguacucugg

SEQ ID NO: 64623 - RNA, 23 nt, Artificial Sequence
  RNA Oligomer
ucugucagcugcaagguacucug

SEQ ID NO: 64624 - RNA, 23 nt, Artificial Sequence
  RNA Oligomer
ggcucaaccagaaaagcccaagu

SEQ ID NO: 64625 - RNA, 23 nt, Artificial Sequence
  RNA Oligomer
uggugagucaccacuucagggcu

SEQ ID NO: 64626 - RNA, 23 nt, Artificial Sequence
  RNA Oligomer
cuggugagucaccacuucagggc

SEQ ID NO: 64627 - RNA, 23 nt, Artificial Sequence
  RNA Oligomer
ucuggugagucaccacuucaggg

SEQ ID NO: 64628 - RNA, 23 nt, Artificial Sequence
  RNA Oligomer
agaaaacaucccagaaaagugga

SEQ ID NO: 64629 - RNA, 23 nt, Artificial Sequence
  RNA Oligomer
gggcucaaccagaaaagcccaag

SEQ ID NO: 64630 - RNA, 23 nt, Artificial Sequence
  RNA Oligomer
ugggcucaaccagaaaagcccaa

SEQ ID NO: 64631 - RNA, 23 nt, Artificial Sequence
  RNA Oligomer
guucaugcagcuguggcagaguu

SEQ ID NO: 64632 - RNA, 23 nt, Artificial Sequence
  RNA Oligomer
caacuaugauuauuaacgauguc

SEQ ID NO: 64633 - RNA, 23 nt, Artificial Sequence
  RNA Oligomer
gcagagauauggcaaacaggauu

SEQ ID NO: 64634 - RNA, 23 nt, Artificial Sequence
  RNA Oligomer
guguauuuggaaauaaagucaga

SEQ ID NO: 64635 - RNA, 23 nt, Artificial Sequence
  RNA Oligomer
cugcaagcuagacgugggaagaa

SEQ ID NO: 64636 - RNA, 23 nt, Artificial Sequence
  RNA Oligomer
guaauuagugccacuuaauguau

SEQ ID NO: 64637 - RNA, 23 nt, Artificial Sequence
  RNA Oligomer
ccuuauaguuacuguguaauuag

SEQ ID NO: 64638 - RNA, 23 nt, Artificial Sequence
  RNA Oligomer
ggcagagauauggcaaacaggau

SEQ ID NO: 64639 - RNA, 23 nt, Artificial Sequence
  RNA Oligomer
ccaacuacuaauagaauaaaggc

SEQ ID NO: 64640 - RNA, 23 nt, Artificial Sequence
  RNA Oligomer
gacuaaacuuuuuuucuguacca

SEQ ID NO: 64641 - RNA, 23 nt, Artificial Sequence
  RNA Oligomer
uuagugccacuuaauguauguua

SEQ ID NO: 64642 - RNA, 23 nt, Artificial Sequence
  RNA Oligomer
gguuuuugaaauggcuacgagag

SEQ ID NO: 64643 - RNA, 23 nt, Artificial Sequence
  RNA Oligomer
caacuacuaauagaauaaaggca

SEQ ID NO: 64644 - RNA, 23 nt, Artificial Sequence
  RNA Oligomer
cugacuaaacuuuuuuucuguac

SEQ ID NO: 64645 - RNA, 23 nt, Artificial Sequence
  RNA Oligomer
gaagaaggcagagauauggcaaa

SEQ ID NO: 64646 - RNA, 23 nt, Artificial Sequence
  RNA Oligomer
ugacuaaacuuuuuuucuguacc

SEQ ID NO: 64647 - RNA, 23 nt, Artificial Sequence
  RNA Oligomer
aggcagagauauggcaaacagga

SEQ ID NO: 64648 - RNA, 23 nt, Artificial Sequence
  RNA Oligomer
gaaggcagagauauggcaaacag

SEQ ID NO: 64649 - RNA, 23 nt, Artificial Sequence
  RNA Oligomer
agaaggcagagauauggcaaaca

SEQ ID NO: 64650 - RNA, 23 nt, Artificial Sequence
  RNA Oligomer
guguuuuuccaucgacagcccug

SEQ ID NO: 64651 - RNA, 23 nt, Artificial Sequence
  RNA Oligomer
uguuauacugauguguuuuucca

SEQ ID NO: 64652 - RNA, 23 nt, Artificial Sequence
  RNA Oligomer
ugguuucacgccugaggcaauua

SEQ ID NO: 64653 - RNA, 23 nt, Artificial Sequence
  RNA Oligomer
gaauuucuuaacuucuugcuucu

SEQ ID NO: 64654 - RNA, 23 nt, Artificial Sequence
  RNA Oligomer
cugaagaaggcagagauauggca

SEQ ID NO: 64655 - RNA, 23 nt, Artificial Sequence
  RNA Oligomer
agaugaagcaggagccggugaaa

SEQ ID NO: 64656 - RNA, 23 nt, Artificial Sequence
  RNA Oligomer
ggcagaguuacaguucugugguu

SEQ ID NO: 64657 - RNA, 23 nt, Artificial Sequence
  RNA Oligomer
gaaacuggugauuguuggugaug

SEQ ID NO: 64658 - RNA, 23 nt, Artificial Sequence
  RNA Oligomer
ucucucuucucuccagcugacua

SEQ ID NO: 64659 - RNA, 23 nt, Artificial Sequence
  RNA Oligomer
gaaagacaugcuugcucauaguc

SEQ ID NO: 64660 - RNA, 23 nt, Artificial Sequence
  RNA Oligomer
gaaaccugaagaaggcagagaua

SEQ ID NO: 64661 - RNA, 23 nt, Artificial Sequence
  RNA Oligomer
cuguguaauuagugccacuuaau

SEQ ID NO: 64662 - RNA, 23 nt, Artificial Sequence
  RNA Oligomer
caguuuuuugaaaaugggcucaa

SEQ ID NO: 64663 - RNA, 23 nt, Artificial Sequence
  RNA Oligomer
acuguguaauuagugccacuuaa

SEQ ID NO: 64664 - RNA, 23 nt, Artificial Sequence
  RNA Oligomer
gcagaguuacaguucugugguuu

SEQ ID NO: 64665 - RNA, 23 nt, Artificial Sequence
  RNA Oligomer
caauggcugccauccggaagaaa

SEQ ID NO: 64666 - RNA, 23 nt, Artificial Sequence
  RNA Oligomer
uacuguguaauuagugccacuua

SEQ ID NO: 64667 - RNA, 23 nt, Artificial Sequence
  RNA Oligomer
uuacuguguaauuagugccacuu

SEQ ID NO: 64668 - RNA, 23 nt, Artificial Sequence
  RNA Oligomer
cuugugaaaccuugcugcaagca

SEQ ID NO: 64669 - RNA, 23 nt, Artificial Sequence
  RNA Oligomer
aaaccugaagaaggcagagauau

SEQ ID NO: 64670 - RNA, 23 nt, Artificial Sequence
  RNA Oligomer
ugaaaccugaagaaggcagagau

SEQ ID NO: 64671 - RNA, 23 nt, Artificial Sequence
  RNA Oligomer
uuaaauucccguuuugucacuuu

SEQ ID NO: 64672 - RNA, 23 nt, Artificial Sequence
  RNA Oligomer
gacaugcuugcucauagucuuca

SEQ ID NO: 64673 - RNA, 23 nt, Artificial Sequence
  RNA Oligomer
uaacuucuugcuucuuucuagaa

SEQ ID NO: 64674 - RNA, 23 nt, Artificial Sequence
  RNA Oligomer
ccuuaugcgguuaauuuugaagu

SEQ ID NO: 64675 - RNA, 23 nt, Artificial Sequence
  RNA Oligomer
gugauuguuggugauggagccug

SEQ ID NO: 64676 - RNA, 23 nt, Artificial Sequence
  RNA Oligomer
gucacuuuuucugauaaaagaug

SEQ ID NO: 64677 - RNA, 23 nt, Artificial Sequence
  RNA Oligomer
cuaaacuuuuuuucuguaccagu

SEQ ID NO: 64678 - RNA, 23 nt, Artificial Sequence
  RNA Oligomer
uguguaauuagugccacuuaaug

SEQ ID NO: 64679 - RNA, 23 nt, Artificial Sequence
  RNA Oligomer
ugcucauagucuucagcaaggac

SEQ ID NO: 64680 - RNA, 23 nt, Artificial Sequence
  RNA Oligomer
ugcuugcucauagucuucagcaa

SEQ ID NO: 64681 - RNA, 23 nt, Artificial Sequence
  RNA Oligomer
uggaaagcagguagaguuggcuu

SEQ ID NO: 64682 - RNA, 23 nt, Artificial Sequence
  RNA Oligomer
cccauggagcugggcuaaguaaa

SEQ ID NO: 64683 - RNA, 23 nt, Artificial Sequence
  RNA Oligomer
guguaauuagugccacuuaaugu

SEQ ID NO: 64684 - RNA, 23 nt, Artificial Sequence
  RNA Oligomer
uguuaguuaccuuauaguuacug

SEQ ID NO: 64685 - RNA, 23 nt, Artificial Sequence
  RNA Oligomer
ucauagucuucagcaaggaccag

SEQ ID NO: 64686 - RNA, 23 nt, Artificial Sequence
  RNA Oligomer
ccuauuaucugucagcugcaagg

SEQ ID NO: 64687 - RNA, 23 nt, Artificial Sequence
  RNA Oligomer
guuggugauggagccuguggaaa

SEQ ID NO: 64688 - RNA, 23 nt, Artificial Sequence
  RNA Oligomer
caaguucaugcagcuguggcaga

SEQ ID NO: 64689 - RNA, 23 nt, Artificial Sequence
  RNA Oligomer
gaaaacaucccagaaaaguggac

SEQ ID NO: 64690 - RNA, 23 nt, Artificial Sequence
  RNA Oligomer
ucguuaguccacggucuggucuu

SEQ ID NO: 64691 - RNA, 23 nt, Artificial Sequence
  RNA Oligomer
uccaacuacuaauagaauaaagg

SEQ ID NO: 64692 - RNA, 23 nt, Artificial Sequence
  RNA Oligomer
uuccaacuacuaauagaauaaag

SEQ ID NO: 64693 - RNA, 23 nt, Artificial Sequence
  RNA Oligomer
uuuccaacuacuaauagaauaaa

SEQ ID NO: 64694 - RNA, 23 nt, Artificial Sequence
  RNA Oligomer
uuuuccaacuacuaauagaauaa

SEQ ID NO: 64695 - RNA, 23 nt, Artificial Sequence
  RNA Oligomer
ccuuuuucauuuaucuauaauuu

SEQ ID NO: 64696 - RNA, 23 nt, Artificial Sequence
  RNA Oligomer
gccuuuuucauuuaucuauaauu

SEQ ID NO: 64697 - RNA, 23 nt, Artificial Sequence
  RNA Oligomer
guguauugguuuuuuaaaaaaga

SEQ ID NO: 64698 - RNA, 23 nt, Artificial Sequence
  RNA Oligomer
aguguauugguuuuuuaaaaaag

SEQ ID NO: 64699 - RNA, 23 nt, Artificial Sequence
  RNA Oligomer
aaguguauugguuuuuuaaaaaa

SEQ ID NO: 64700 - RNA, 23 nt, Artificial Sequence
  RNA Oligomer
aaaguguauugguuuuuuaaaaa

SEQ ID NO: 64701 - RNA, 23 nt, Artificial Sequence
  RNA Oligomer
gaaaguguauugguuuuuuaaaa

SEQ ID NO: 64702 - RNA, 23 nt, Artificial Sequence
  RNA Oligomer
gauggaaaauucauuuuuuaaau

SEQ ID NO: 64703 - RNA, 23 nt, Artificial Sequence
  RNA Oligomer
cagauggaaaauucauuuuuuaa

SEQ ID NO: 64704 - RNA, 23 nt, Artificial Sequence
  RNA Oligomer
ucagauggaaaauucauuuuuua

SEQ ID NO: 64705 - RNA, 23 nt, Artificial Sequence
  RNA Oligomer
caguuaauuuuuccaacuacuaa

SEQ ID NO: 64706 - RNA, 23 nt, Artificial Sequence
  RNA Oligomer
cacauaguucucaaacacugugg

SEQ ID NO: 64707 - RNA, 23 nt, Artificial Sequence
  RNA Oligomer
acauaguucucaaacacuguggg

SEQ ID NO: 64708 - RNA, 23 nt, Artificial Sequence
  RNA Oligomer
cauaguucucaaacacugugggc

SEQ ID NO: 64709 - RNA, 23 nt, Artificial Sequence
  RNA Oligomer
auaguucucaaacacugugggca

SEQ ID NO: 64710 - RNA, 23 nt, Artificial Sequence
  RNA Oligomer
uaguucucaaacacugugggcac

SEQ ID NO: 64711 - RNA, 23 nt, Artificial Sequence
  RNA Oligomer
auuauagauaaaugaaaaaggcc

SEQ ID NO: 64712 - RNA, 23 nt, Artificial Sequence
  RNA Oligomer
uuauagauaaaugaaaaaggcca

SEQ ID NO: 64713 - RNA, 23 nt, Artificial Sequence
  RNA Oligomer
uauagauaaaugaaaaaggccag

SEQ ID NO: 64714 - RNA, 23 nt, Artificial Sequence
  RNA Oligomer
auagauaaaugaaaaaggccagu

SEQ ID NO: 64715 - RNA, 23 nt, Artificial Sequence
  RNA Oligomer
uagauaaaugaaaaaggccagua

SEQ ID NO: 64716 - RNA, 23 nt, Artificial Sequence
  RNA Oligomer
agcccauuuucaaaaaacugccc

SEQ ID NO: 64717 - RNA, 23 nt, Artificial Sequence
  RNA Oligomer
gcccauuuucaaaaaacugccca

SEQ ID NO: 64718 - RNA, 23 nt, Artificial Sequence
  RNA Oligomer
cccauuuucaaaaaacugcccac

SEQ ID NO: 64719 - RNA, 23 nt, Artificial Sequence
  RNA Oligomer
ccauuuucaaaaaacugcccacc

SEQ ID NO: 64720 - RNA, 23 nt, Artificial Sequence
  RNA Oligomer
cauuuucaaaaaacugcccaccc

SEQ ID NO: 64721 - RNA, 23 nt, Artificial Sequence
  RNA Oligomer
gcuguuagagcagugucaaaagg

SEQ ID NO: 64722 - RNA, 23 nt, Artificial Sequence
  RNA Oligomer
cuguuagagcagugucaaaagga

SEQ ID NO: 64723 - RNA, 23 nt, Artificial Sequence
  RNA Oligomer
uguuagagcagugucaaaaggac

SEQ ID NO: 64724 - RNA, 23 nt, Artificial Sequence
  RNA Oligomer
guuagagcagugucaaaaggacc

SEQ ID NO: 64725 - RNA, 23 nt, Artificial Sequence
  RNA Oligomer
uuagagcagugucaaaaggaccc

SEQ ID NO: 64726 - RNA, 23 nt, Artificial Sequence
  RNA Oligomer
agauaaaugaaaaaggccaguaa

SEQ ID NO: 64727 - RNA, 23 nt, Artificial Sequence
  RNA Oligomer
gauaaaugaaaaaggccaguaau

SEQ ID NO: 64728 - RNA, 23 nt, Artificial Sequence
  RNA Oligomer
auaaaugaaaaaggccaguaauc

SEQ ID NO: 64729 - RNA, 23 nt, Artificial Sequence
  RNA Oligomer
auuuucaaaaaacugcccacccc

SEQ ID NO: 64730 - RNA, 23 nt, Artificial Sequence
  RNA Oligomer
acaucguuaauaaucauaguugg

SEQ ID NO: 64731 - RNA, 23 nt, Artificial Sequence
  RNA Oligomer
caucguuaauaaucauaguuggc

SEQ ID NO: 64732 - RNA, 23 nt, Artificial Sequence
  RNA Oligomer
aucguuaauaaucauaguuggcu

SEQ ID NO: 64733 - RNA, 23 nt, Artificial Sequence
  RNA Oligomer
ucguuaauaaucauaguuggcuu

SEQ ID NO: 64734 - RNA, 23 nt, Artificial Sequence
  RNA Oligomer
cguuaauaaucauaguuggcuuc

SEQ ID NO: 64735 - RNA, 23 nt, Artificial Sequence
  RNA Oligomer
agccauuucaaaaaccucucuca

SEQ ID NO: 64736 - RNA, 23 nt, Artificial Sequence
  RNA Oligomer
gccauuucaaaaaccucucucac

SEQ ID NO: 64737 - RNA, 23 nt, Artificial Sequence
  RNA Oligomer
ccauuucaaaaaccucucucacu

SEQ ID NO: 64738 - RNA, 23 nt, Artificial Sequence
  RNA Oligomer
cauuucaaaaaccucucucacuc

SEQ ID NO: 64739 - RNA, 23 nt, Artificial Sequence
  RNA Oligomer
auuucaaaaaccucucucacucc

SEQ ID NO: 64740 - RNA, 23 nt, Artificial Sequence
  RNA Oligomer
aaccaauuccuauuuacuuagcc

SEQ ID NO: 64741 - RNA, 23 nt, Artificial Sequence
  RNA Oligomer
accaauuccuauuuacuuagccc

SEQ ID NO: 64742 - RNA, 23 nt, Artificial Sequence
  RNA Oligomer
ccaauuccuauuuacuuagccca

SEQ ID NO: 64743 - RNA, 23 nt, Artificial Sequence
  RNA Oligomer
caauuccuauuuacuuagcccag

SEQ ID NO: 64744 - RNA, 23 nt, Artificial Sequence
  RNA Oligomer
aauuccuauuuacuuagcccagc

SEQ ID NO: 64745 - RNA, 23 nt, Artificial Sequence
  RNA Oligomer
acuaugagcaagcaugucuuucc

SEQ ID NO: 64746 - RNA, 23 nt, Artificial Sequence
  RNA Oligomer
cuaugagcaagcaugucuuucca

SEQ ID NO: 64747 - RNA, 23 nt, Artificial Sequence
  RNA Oligomer
uaugagcaagcaugucuuuccac

SEQ ID NO: 64748 - RNA, 23 nt, Artificial Sequence
  RNA Oligomer
augagcaagcaugucuuuccaca

SEQ ID NO: 64749 - RNA, 23 nt, Artificial Sequence
  RNA Oligomer
ugagcaagcaugucuuuccacag

SEQ ID NO: 64750 - RNA, 23 nt, Artificial Sequence
  RNA Oligomer
gagcaagcaugucuuuccacagg

SEQ ID NO: 64751 - RNA, 23 nt, Artificial Sequence
  RNA Oligomer
agcaagcaugucuuuccacaggc

SEQ ID NO: 64752 - RNA, 23 nt, Artificial Sequence
  RNA Oligomer
gcaagcaugucuuuccacaggcu

SEQ ID NO: 64753 - RNA, 23 nt, Artificial Sequence
  RNA Oligomer
caagcaugucuuuccacaggcuc

SEQ ID NO: 64754 - RNA, 23 nt, Artificial Sequence
  RNA Oligomer
aagcaugucuuuccacaggcucc

SEQ ID NO: 64755 - RNA, 23 nt, Artificial Sequence
  RNA Oligomer
ggguuggacaucguuaauaauca

SEQ ID NO: 64756 - RNA, 23 nt, Artificial Sequence
  RNA Oligomer
gguuggacaucguuaauaaucau

SEQ ID NO: 64757 - RNA, 23 nt, Artificial Sequence
  RNA Oligomer
guuggacaucguuaauaaucaua

SEQ ID NO: 64758 - RNA, 23 nt, Artificial Sequence
  RNA Oligomer
uuggacaucguuaauaaucauag

SEQ ID NO: 64759 - RNA, 23 nt, Artificial Sequence
  RNA Oligomer
uggacaucguuaauaaucauagu

SEQ ID NO: 64760 - RNA, 23 nt, Artificial Sequence
  RNA Oligomer
guuaauaaucauaguuggcuucu

SEQ ID NO: 64761 - RNA, 23 nt, Artificial Sequence
  RNA Oligomer
uuaauaaucauaguuggcuucua

SEQ ID NO: 64762 - RNA, 23 nt, Artificial Sequence
  RNA Oligomer
uaauaaucauaguuggcuucuaa

SEQ ID NO: 64763 - RNA, 23 nt, Artificial Sequence
  RNA Oligomer
aauaaucauaguuggcuucuaaa

SEQ ID NO: 64764 - RNA, 23 nt, Artificial Sequence
  RNA Oligomer
gagaaaagagcacugugaauuag

SEQ ID NO: 64765 - RNA, 23 nt, Artificial Sequence
  RNA Oligomer
agaaaagagcacugugaauuaga

SEQ ID NO: 64766 - RNA, 23 nt, Artificial Sequence
  RNA Oligomer
gaaaagagcacugugaauuagag

SEQ ID NO: 64767 - RNA, 23 nt, Artificial Sequence
  RNA Oligomer
aaaagagcacugugaauuagagc

SEQ ID NO: 64768 - RNA, 23 nt, Artificial Sequence
  RNA Oligomer
aaagagcacugugaauuagagcc

SEQ ID NO: 64769 - RNA, 23 nt, Artificial Sequence
  RNA Oligomer
cugccacagcugcaugaacuugg

SEQ ID NO: 64770 - RNA, 23 nt, Artificial Sequence
  RNA Oligomer
ugccacagcugcaugaacuuggg

SEQ ID NO: 64771 - RNA, 23 nt, Artificial Sequence
  RNA Oligomer
gccacagcugcaugaacuugggc

SEQ ID NO: 64772 - RNA, 23 nt, Artificial Sequence
  RNA Oligomer
ccacagcugcaugaacuugggcu

SEQ ID NO: 64773 - RNA, 23 nt, Artificial Sequence
  RNA Oligomer
cacagcugcaugaacuugggcuu

SEQ ID NO: 64774 - RNA, 23 nt, Artificial Sequence
  RNA Oligomer
ugagcccauuuucaaaaaacugc

SEQ ID NO: 64775 - RNA, 23 nt, Artificial Sequence
  RNA Oligomer
gagcccauuuucaaaaaacugcc

SEQ ID NO: 64776 - RNA, 23 nt, Artificial Sequence
  RNA Oligomer
guuauaaaguaguuacagccuaa

SEQ ID NO: 64777 - RNA, 23 nt, Artificial Sequence
  RNA Oligomer
uaaaugaaaaaggccaguaauca

SEQ ID NO: 64778 - RNA, 23 nt, Artificial Sequence
  RNA Oligomer
ucaaaaaccucucucacuccauc

SEQ ID NO: 64779 - RNA, 23 nt, Artificial Sequence
  RNA Oligomer
caaaaaccucucucacuccaucu

SEQ ID NO: 64780 - RNA, 23 nt, Artificial Sequence
  RNA Oligomer
aaaaaccucucucacuccaucuu

SEQ ID NO: 64781 - RNA, 23 nt, Artificial Sequence
  RNA Oligomer
aacaaucaccaguuucuuccgga

SEQ ID NO: 64782 - RNA, 23 nt, Artificial Sequence
  RNA Oligomer
acaaucaccaguuucuuccggau

SEQ ID NO: 64783 - RNA, 23 nt, Artificial Sequence
  RNA Oligomer
caaucaccaguuucuuccggaug

SEQ ID NO: 64784 - RNA, 23 nt, Artificial Sequence
  RNA Oligomer
aaucaccaguuucuuccggaugg

SEQ ID NO: 64785 - RNA, 23 nt, Artificial Sequence
  RNA Oligomer
auacagugaggagaaaagagcac

SEQ ID NO: 64786 - RNA, 23 nt, Artificial Sequence
  RNA Oligomer
uacagugaggagaaaagagcacu

SEQ ID NO: 64787 - RNA, 23 nt, Artificial Sequence
  RNA Oligomer
acagugaggagaaaagagcacug

SEQ ID NO: 64788 - RNA, 23 nt, Artificial Sequence
  RNA Oligomer
cagugaggagaaaagagcacugu

SEQ ID NO: 64789 - RNA, 23 nt, Artificial Sequence
  RNA Oligomer
agugaggagaaaagagcacugug

SEQ ID NO: 64790 - RNA, 23 nt, Artificial Sequence
  RNA Oligomer
auuccuauuuacuuagcccagcu

SEQ ID NO: 64791 - RNA, 23 nt, Artificial Sequence
  RNA Oligomer
uuuucaaaaaacugcccacccca

SEQ ID NO: 64792 - RNA, 23 nt, Artificial Sequence
  RNA Oligomer
aagaaauuccuugaauuagcgcc

SEQ ID NO: 64793 - RNA, 23 nt, Artificial Sequence
  RNA Oligomer
agaaauuccuugaauuagcgccu

SEQ ID NO: 64794 - RNA, 23 nt, Artificial Sequence
  RNA Oligomer
gaaauuccuugaauuagcgccug

SEQ ID NO: 64795 - RNA, 23 nt, Artificial Sequence
  RNA Oligomer
aaauuccuugaauuagcgccugg

SEQ ID NO: 64796 - RNA, 23 nt, Artificial Sequence
  RNA Oligomer
aauuccuugaauuagcgccuggu

SEQ ID NO: 64797 - RNA, 23 nt, Artificial Sequence
  RNA Oligomer
aaaugaaaaaggccaguaaucau

SEQ ID NO: 64798 - RNA, 23 nt, Artificial Sequence
  RNA Oligomer
aagguuucacaagacaaggcacc

SEQ ID NO: 64799 - RNA, 23 nt, Artificial Sequence
  RNA Oligomer
agguuucacaagacaaggcaccc

SEQ ID NO: 64800 - RNA, 23 nt, Artificial Sequence
  RNA Oligomer
gguuucacaagacaaggcaccca

SEQ ID NO: 64801 - RNA, 23 nt, Artificial Sequence
  RNA Oligomer
guuucacaagacaaggcacccag

SEQ ID NO: 64802 - RNA, 23 nt, Artificial Sequence
  RNA Oligomer
uuucacaagacaaggcacccaga

SEQ ID NO: 64803 - RNA, 23 nt, Artificial Sequence
  RNA Oligomer
aaaaccucucucacuccaucuuu

SEQ ID NO: 64804 - RNA, 23 nt, Artificial Sequence
  RNA Oligomer
aaaccucucucacuccaucuuug

SEQ ID NO: 64805 - RNA, 23 nt, Artificial Sequence
  RNA Oligomer
aaccucucucacuccaucuuugg

SEQ ID NO: 64806 - RNA, 23 nt, Artificial Sequence
  RNA Oligomer
ccgccuugugugcucaucauucc

SEQ ID NO: 64807 - RNA, 23 nt, Artificial Sequence
  RNA Oligomer
cgccuugugugcucaucauuccg

SEQ ID NO: 64808 - RNA, 23 nt, Artificial Sequence
  RNA Oligomer
gccuugugugcucaucauuccga

SEQ ID NO: 64809 - RNA, 23 nt, Artificial Sequence
  RNA Oligomer
ccuugugugcucaucauuccgaa

SEQ ID NO: 64810 - RNA, 23 nt, Artificial Sequence
  RNA Oligomer
cuugugugcucaucauuccgaag

SEQ ID NO: 64811 - RNA, 23 nt, Artificial Sequence
  RNA Oligomer
cagaaaugcuugacuucuggggu

SEQ ID NO: 64812 - RNA, 23 nt, Artificial Sequence
  RNA Oligomer
agaaaugcuugacuucugggguc

SEQ ID NO: 64813 - RNA, 23 nt, Artificial Sequence
  RNA Oligomer
gccucaggcgaucauaaucuucc

SEQ ID NO: 64814 - RNA, 23 nt, Artificial Sequence
  RNA Oligomer
ccucaggcgaucauaaucuuccu

SEQ ID NO: 64815 - RNA, 23 nt, Artificial Sequence
  RNA Oligomer
cucaggcgaucauaaucuuccug

SEQ ID NO: 64816 - RNA, 23 nt, Artificial Sequence
  RNA Oligomer
ucaggcgaucauaaucuuccugc

SEQ ID NO: 64817 - RNA, 23 nt, Artificial Sequence
  RNA Oligomer
caggcgaucauaaucuuccugcc

SEQ ID NO: 64818 - RNA, 23 nt, Artificial Sequence
  RNA Oligomer
gugaggagaaaagagcacuguga

SEQ ID NO: 64819 - RNA, 23 nt, Artificial Sequence
  RNA Oligomer
ugaggagaaaagagcacugugaa

SEQ ID NO: 64820 - RNA, 23 nt, Artificial Sequence
  RNA Oligomer
gaggagaaaagagcacugugaau

SEQ ID NO: 64821 - RNA, 23 nt, Artificial Sequence
  RNA Oligomer
cacugugaauuagagccagaugc

SEQ ID NO: 64822 - RNA, 23 nt, Artificial Sequence
  RNA Oligomer
acugugaauuagagccagaugcu

SEQ ID NO: 64823 - RNA, 23 nt, Artificial Sequence
  RNA Oligomer
cugugaauuagagccagaugcuu

SEQ ID NO: 64824 - RNA, 23 nt, Artificial Sequence
  RNA Oligomer
ugugaauuagagccagaugcuua

SEQ ID NO: 64825 - RNA, 23 nt, Artificial Sequence
  RNA Oligomer
gugaauuagagccagaugcuuaa

SEQ ID NO: 64826 - RNA, 23 nt, Artificial Sequence
  RNA Oligomer
gguuaugccaucuuccaaagugu

SEQ ID NO: 64827 - RNA, 23 nt, Artificial Sequence
  RNA Oligomer
guuaugccaucuuccaaaguguc

SEQ ID NO: 64828 - RNA, 23 nt, Artificial Sequence
  RNA Oligomer
uuaugccaucuuccaaagugucu

SEQ ID NO: 64829 - RNA, 23 nt, Artificial Sequence
  RNA Oligomer
uaugccaucuuccaaagugucua

SEQ ID NO: 64830 - RNA, 23 nt, Artificial Sequence
  RNA Oligomer
augccaucuuccaaagugucuaa

SEQ ID NO: 64831 - RNA, 23 nt, Artificial Sequence
  RNA Oligomer
caucuuccaaagugucuaauugc

SEQ ID NO: 64832 - RNA, 23 nt, Artificial Sequence
  RNA Oligomer
aucuuccaaagugucuaauugcc

SEQ ID NO: 64833 - RNA, 23 nt, Artificial Sequence
  RNA Oligomer
ucuuccaaagugucuaauugccu

SEQ ID NO: 64834 - RNA, 23 nt, Artificial Sequence
  RNA Oligomer
cuuccaaagugucuaauugccuc

SEQ ID NO: 64835 - RNA, 23 nt, Artificial Sequence
  RNA Oligomer
uuccaaagugucuaauugccuca

SEQ ID NO: 64836 - RNA, 23 nt, Artificial Sequence
  RNA Oligomer
uccaaagugucuaauugccucag

SEQ ID NO: 64837 - RNA, 23 nt, Artificial Sequence
  RNA Oligomer
aggaugacaguauuaggaaaucc

SEQ ID NO: 64838 - RNA, 23 nt, Artificial Sequence
  RNA Oligomer
ggaugacaguauuaggaaaucca

SEQ ID NO: 64839 - RNA, 23 nt, Artificial Sequence
  RNA Oligomer
gaugacaguauuaggaaauccaa

SEQ ID NO: 64840 - RNA, 23 nt, Artificial Sequence
  RNA Oligomer
augacaguauuaggaaauccaau

SEQ ID NO: 64841 - RNA, 23 nt, Artificial Sequence
  RNA Oligomer
ugacaguauuaggaaauccaauu

SEQ ID NO: 64842 - RNA, 23 nt, Artificial Sequence
  RNA Oligomer
acagcugcaugaacuugggcuuu

SEQ ID NO: 64843 - RNA, 23 nt, Artificial Sequence
  RNA Oligomer
ugcaugaacuugggcuuuucugg

SEQ ID NO: 64844 - RNA, 23 nt, Artificial Sequence
  RNA Oligomer
gcaugaacuugggcuuuucuggu

SEQ ID NO: 64845 - RNA, 23 nt, Artificial Sequence
  RNA Oligomer
caugaacuugggcuuuucugguu

SEQ ID NO: 64846 - RNA, 23 nt, Artificial Sequence
  RNA Oligomer
augaacuugggcuuuucugguug

SEQ ID NO: 64847 - RNA, 23 nt, Artificial Sequence
  RNA Oligomer
ugaacuugggcuuuucugguuga

SEQ ID NO: 64848 - RNA, 23 nt, Artificial Sequence
  RNA Oligomer
uuucaaaaaacugcccaccccag

SEQ ID NO: 64849 - RNA, 23 nt, Artificial Sequence
  RNA Oligomer
uagagcagugucaaaaggacccu

SEQ ID NO: 64850 - RNA, 23 nt, Artificial Sequence
  RNA Oligomer
auaaucauaguuggcuucuaaau

SEQ ID NO: 64851 - RNA, 23 nt, Artificial Sequence
  RNA Oligomer
aaggcacccagauuuuuucuucc

SEQ ID NO: 64852 - RNA, 23 nt, Artificial Sequence
  RNA Oligomer
aggcacccagauuuuuucuuccc

SEQ ID NO: 64853 - RNA, 23 nt, Artificial Sequence
  RNA Oligomer
ggcacccagauuuuuucuuccca

SEQ ID NO: 64854 - RNA, 23 nt, Artificial Sequence
  RNA Oligomer
gcacccagauuuuuucuucccac

SEQ ID NO: 64855 - RNA, 23 nt, Artificial Sequence
  RNA Oligomer
cacccagauuuuuucuucccacg

SEQ ID NO: 64856 - RNA, 23 nt, Artificial Sequence
  RNA Oligomer
uugugugcucaucauuccgaaga

SEQ ID NO: 64857 - RNA, 23 nt, Artificial Sequence
  RNA Oligomer
cgauaucugccacauaguucuca

SEQ ID NO: 64858 - RNA, 23 nt, Artificial Sequence
  RNA Oligomer
gauaucugccacauaguucucaa

SEQ ID NO: 64859 - RNA, 23 nt, Artificial Sequence
  RNA Oligomer
auaucugccacauaguucucaaa

SEQ ID NO: 64860 - RNA, 23 nt, Artificial Sequence
  RNA Oligomer
uaucugccacauaguucucaaac

SEQ ID NO: 64861 - RNA, 23 nt, Artificial Sequence
  RNA Oligomer
aucugccacauaguucucaaaca

SEQ ID NO: 64862 - RNA, 23 nt, Artificial Sequence
  RNA Oligomer
ggaaaaauuaacugguacagaaa

SEQ ID NO: 64863 - RNA, 23 nt, Artificial Sequence
  RNA Oligomer
gaaaaauuaacugguacagaaaa

SEQ ID NO: 64864 - RNA, 23 nt, Artificial Sequence
  RNA Oligomer
ggagagaagagagacugagugcc

SEQ ID NO: 64865 - RNA, 23 nt, Artificial Sequence
  RNA Oligomer
gagagaagagagacugagugcca

SEQ ID NO: 64866 - RNA, 23 nt, Artificial Sequence
  RNA Oligomer
agagaagagagacugagugccac

SEQ ID NO: 64867 - RNA, 23 nt, Artificial Sequence
  RNA Oligomer
gagaagagagacugagugccacc

SEQ ID NO: 64868 - RNA, 23 nt, Artificial Sequence
  RNA Oligomer
agaagagagacugagugccaccc

SEQ ID NO: 64869 - RNA, 23 nt, Artificial Sequence
  RNA Oligomer
agguuaugccaucuuccaaagug

SEQ ID NO: 64870 - RNA, 23 nt, Artificial Sequence
  RNA Oligomer
ccaaagugucuaauugccucagg

SEQ ID NO: 64871 - RNA, 23 nt, Artificial Sequence
  RNA Oligomer
caaagugucuaauugccucaggc

SEQ ID NO: 64872 - RNA, 23 nt, Artificial Sequence
  RNA Oligomer
aaagugucuaauugccucaggcg

SEQ ID NO: 64873 - RNA, 23 nt, Artificial Sequence
  RNA Oligomer
gguaauauggccaucuuuuauca

SEQ ID NO: 64874 - RNA, 23 nt, Artificial Sequence
  RNA Oligomer
guaauauggccaucuuuuaucag

SEQ ID NO: 64875 - RNA, 23 nt, Artificial Sequence
  RNA Oligomer
uaauauggccaucuuuuaucaga

SEQ ID NO: 64876 - RNA, 23 nt, Artificial Sequence
  RNA Oligomer
aauauggccaucuuuuaucagaa

SEQ ID NO: 64877 - RNA, 23 nt, Artificial Sequence
  RNA Oligomer
auauggccaucuuuuaucagaaa

SEQ ID NO: 64878 - RNA, 23 nt, Artificial Sequence
  RNA Oligomer
aaaucuguuacggaguaaagccc

SEQ ID NO: 64879 - RNA, 23 nt, Artificial Sequence
  RNA Oligomer
aaucuguuacggaguaaagcccu

SEQ ID NO: 64880 - RNA, 23 nt, Artificial Sequence
  RNA Oligomer
aucuguuacggaguaaagcccug

SEQ ID NO: 64881 - RNA, 23 nt, Artificial Sequence
  RNA Oligomer
ucuguuacggaguaaagcccuga

SEQ ID NO: 64882 - RNA, 23 nt, Artificial Sequence
  RNA Oligomer
cuguuacggaguaaagcccugaa

SEQ ID NO: 64883 - RNA, 23 nt, Artificial Sequence
  RNA Oligomer
acccagauuuuuucuucccacgu

SEQ ID NO: 64884 - RNA, 23 nt, Artificial Sequence
  RNA Oligomer
ccagauuuuuucuucccacgucu

SEQ ID NO: 64885 - RNA, 23 nt, Artificial Sequence
  RNA Oligomer
cagauuuuuucuucccacgucua

SEQ ID NO: 64886 - RNA, 23 nt, Artificial Sequence
  RNA Oligomer
agauuuuuucuucccacgucuag

SEQ ID NO: 64887 - RNA, 23 nt, Artificial Sequence
  RNA Oligomer
gauuuuuucuucccacgucuagc

SEQ ID NO: 64888 - RNA, 23 nt, Artificial Sequence
  RNA Oligomer
auuuuuucuucccacgucuagcu

SEQ ID NO: 64889 - RNA, 23 nt, Artificial Sequence
  RNA Oligomer
uagccauuucaaaaaccucucuc

SEQ ID NO: 64890 - RNA, 23 nt, Artificial Sequence
  RNA Oligomer
uuucuaaacuaucagggcugucg

SEQ ID NO: 64891 - RNA, 23 nt, Artificial Sequence
  RNA Oligomer
uucuaaacuaucagggcugucga

SEQ ID NO: 64892 - RNA, 23 nt, Artificial Sequence
  RNA Oligomer
ucuaaacuaucagggcugucgau

SEQ ID NO: 64893 - RNA, 23 nt, Artificial Sequence
  RNA Oligomer
cuaaacuaucagggcugucgaug

SEQ ID NO: 64894 - RNA, 23 nt, Artificial Sequence
  RNA Oligomer
uaaacuaucagggcugucgaugg

SEQ ID NO: 64895 - RNA, 23 nt, Artificial Sequence
  RNA Oligomer
cucgauaucugccacauaguucu

SEQ ID NO: 64896 - RNA, 23 nt, Artificial Sequence
  RNA Oligomer
ucgauaucugccacauaguucuc

SEQ ID NO: 64897 - RNA, 23 nt, Artificial Sequence
  RNA Oligomer
ugccacauaguucucaaacacug

SEQ ID NO: 64898 - RNA, 23 nt, Artificial Sequence
  RNA Oligomer
gccacauaguucucaaacacugu

SEQ ID NO: 64899 - RNA, 23 nt, Artificial Sequence
  RNA Oligomer
ccacauaguucucaaacacugug

SEQ ID NO: 64900 - RNA, 23 nt, Artificial Sequence
  RNA Oligomer
uuuuuagaaaacugccuuuauuc

SEQ ID NO: 64901 - RNA, 23 nt, Artificial Sequence
  RNA Oligomer
uuuuagaaaacugccuuuauucu

SEQ ID NO: 64902 - RNA, 23 nt, Artificial Sequence
  RNA Oligomer
uuuagaaaacugccuuuauucua

SEQ ID NO: 64903 - RNA, 23 nt, Artificial Sequence
  RNA Oligomer
gcgugaaaccaauuccuauuuac

SEQ ID NO: 64904 - RNA, 23 nt, Artificial Sequence
  RNA Oligomer
cgugaaaccaauuccuauuuacu

SEQ ID NO: 64905 - RNA, 23 nt, Artificial Sequence
  RNA Oligomer
gugaaaccaauuccuauuuacuu

SEQ ID NO: 64906 - RNA, 23 nt, Artificial Sequence
  RNA Oligomer
ugaaaccaauuccuauuuacuua

SEQ ID NO: 64907 - RNA, 23 nt, Artificial Sequence
  RNA Oligomer
gaaaccaauuccuauuuacuuag

SEQ ID NO: 64908 - RNA, 23 nt, Artificial Sequence
  RNA Oligomer
cugcaugaacuugggcuuuucug

SEQ ID NO: 64909 - RNA, 23 nt, Artificial Sequence
  RNA Oligomer
gaagcaagaaguuaagaaauucc

SEQ ID NO: 64910 - RNA, 23 nt, Artificial Sequence
  RNA Oligomer
aagcaagaaguuaagaaauuccu

SEQ ID NO: 64911 - RNA, 23 nt, Artificial Sequence
  RNA Oligomer
agcaagaaguuaagaaauuccuu

SEQ ID NO: 64912 - RNA, 23 nt, Artificial Sequence
  RNA Oligomer
gcaagaaguuaagaaauuccuug

SEQ ID NO: 64913 - RNA, 23 nt, Artificial Sequence
  RNA Oligomer
caagaaguuaagaaauuccuuga

SEQ ID NO: 64914 - RNA, 23 nt, Artificial Sequence
  RNA Oligomer
agaugacuucugauuuguaaucu

SEQ ID NO: 64915 - RNA, 23 nt, Artificial Sequence
  RNA Oligomer
gaugacuucugauuuguaaucuu

SEQ ID NO: 64916 - RNA, 23 nt, Artificial Sequence
  RNA Oligomer
augacuucugauuuguaaucuua

SEQ ID NO: 64917 - RNA, 23 nt, Artificial Sequence
  RNA Oligomer
ugacuucugauuuguaaucuuag

SEQ ID NO: 64918 - RNA, 23 nt, Artificial Sequence
  RNA Oligomer
gacuucugauuuguaaucuuagg

SEQ ID NO: 64919 - RNA, 23 nt, Artificial Sequence
  RNA Oligomer
aaacagcacuucaaaauuaaccg

SEQ ID NO: 64920 - RNA, 23 nt, Artificial Sequence
  RNA Oligomer
aacagcacuucaaaauuaaccgc

SEQ ID NO: 64921 - RNA, 23 nt, Artificial Sequence
  RNA Oligomer
acagcacuucaaaauuaaccgca

SEQ ID NO: 64922 - RNA, 23 nt, Artificial Sequence
  RNA Oligomer
cagcacuucaaaauuaaccgcau

SEQ ID NO: 64923 - RNA, 23 nt, Artificial Sequence
  RNA Oligomer
agcacuucaaaauuaaccgcaua

SEQ ID NO: 64924 - RNA, 23 nt, Artificial Sequence
  RNA Oligomer
cuugcagcaagguuucacaagac

SEQ ID NO: 64925 - RNA, 23 nt, Artificial Sequence
  RNA Oligomer
uugcagcaagguuucacaagaca

SEQ ID NO: 64926 - RNA, 23 nt, Artificial Sequence
  RNA Oligomer
ugcagcaagguuucacaagacaa

SEQ ID NO: 64927 - RNA, 23 nt, Artificial Sequence
  RNA Oligomer
gcagcaagguuucacaagacaag

SEQ ID NO: 64928 - RNA, 23 nt, Artificial Sequence
  RNA Oligomer
cagcaagguuucacaagacaagg

SEQ ID NO: 64929 - RNA, 23 nt, Artificial Sequence
  RNA Oligomer
uucacaagacaaggcacccagau

SEQ ID NO: 64930 - RNA, 23 nt, Artificial Sequence
  RNA Oligomer
agacaaggcacccagauuuuuuc

SEQ ID NO: 64931 - RNA, 23 nt, Artificial Sequence
  RNA Oligomer
gacaaggcacccagauuuuuucu

SEQ ID NO: 64932 - RNA, 23 nt, Artificial Sequence
  RNA Oligomer
acaaggcacccagauuuuuucuu

SEQ ID NO: 64933 - RNA, 23 nt, Artificial Sequence
  RNA Oligomer
caaggcacccagauuuuuucuuc

SEQ ID NO: 64934 - RNA, 23 nt, Artificial Sequence
  RNA Oligomer
aaaaacacaucaguauaacaucg

SEQ ID NO: 64935 - RNA, 23 nt, Artificial Sequence
  RNA Oligomer
aaaacacaucaguauaacaucgg

SEQ ID NO: 64936 - RNA, 23 nt, Artificial Sequence
  RNA Oligomer
aaacacaucaguauaacaucggu

SEQ ID NO: 64937 - RNA, 23 nt, Artificial Sequence
  RNA Oligomer
aacacaucaguauaacaucggua

SEQ ID NO: 64938 - RNA, 23 nt, Artificial Sequence
  RNA Oligomer
acacaucaguauaacaucgguau

SEQ ID NO: 64939 - RNA, 23 nt, Artificial Sequence
  RNA Oligomer
cacaucaguauaacaucgguauc

SEQ ID NO: 64940 - RNA, 23 nt, Artificial Sequence
  RNA Oligomer
ucaguauaacaucgguaucuggg

SEQ ID NO: 64941 - RNA, 23 nt, Artificial Sequence
  RNA Oligomer
caguauaacaucgguaucugggu

SEQ ID NO: 64942 - RNA, 23 nt, Artificial Sequence
  RNA Oligomer
aguauaacaucgguaucugggua

SEQ ID NO: 64943 - RNA, 23 nt, Artificial Sequence
  RNA Oligomer
guauaacaucgguaucuggguag

SEQ ID NO: 64944 - RNA, 23 nt, Artificial Sequence
  RNA Oligomer
uauaacaucgguaucuggguagg

SEQ ID NO: 64945 - RNA, 23 nt, Artificial Sequence
  RNA Oligomer
gaagagagacugagugccaccca

SEQ ID NO: 64946 - RNA, 23 nt, Artificial Sequence
  RNA Oligomer
aagagagacugagugccacccau

SEQ ID NO: 64947 - RNA, 23 nt, Artificial Sequence
  RNA Oligomer
aaaccaauuccuauuuacuuagc

SEQ ID NO: 64948 - RNA, 23 nt, Artificial Sequence
  RNA Oligomer
ggguaauauggccaucuuuuauc

SEQ ID NO: 64949 - RNA, 23 nt, Artificial Sequence
  RNA Oligomer
uucuuugaggaugacaguauuag

SEQ ID NO: 64950 - RNA, 23 nt, Artificial Sequence
  RNA Oligomer
ucuuugaggaugacaguauuagg

SEQ ID NO: 64951 - RNA, 23 nt, Artificial Sequence
  RNA Oligomer
cuuugaggaugacaguauuagga

SEQ ID NO: 64952 - RNA, 23 nt, Artificial Sequence
  RNA Oligomer
uuugaggaugacaguauuaggaa

SEQ ID NO: 64953 - RNA, 23 nt, Artificial Sequence
  RNA Oligomer
uugaggaugacaguauuaggaaa

SEQ ID NO: 64954 - RNA, 23 nt, Artificial Sequence
  RNA Oligomer
ccacagaacuguaacucugccac

SEQ ID NO: 64955 - RNA, 23 nt, Artificial Sequence
  RNA Oligomer
cacagaacuguaacucugccaca

SEQ ID NO: 64956 - RNA, 23 nt, Artificial Sequence
  RNA Oligomer
acagaacuguaacucugccacag

SEQ ID NO: 64957 - RNA, 23 nt, Artificial Sequence
  RNA Oligomer
cagaacuguaacucugccacagc

SEQ ID NO: 64958 - RNA, 23 nt, Artificial Sequence
  RNA Oligomer
agaacuguaacucugccacagcu

SEQ ID NO: 64959 - RNA, 23 nt, Artificial Sequence
  RNA Oligomer
uucaaaaaacugcccaccccaga

SEQ ID NO: 64960 - RNA, 23 nt, Artificial Sequence
  RNA Oligomer
cagcugacagauaauaggcagga

SEQ ID NO: 64961 - RNA, 23 nt, Artificial Sequence
  RNA Oligomer
agcugacagauaauaggcaggac

SEQ ID NO: 64962 - RNA, 23 nt, Artificial Sequence
  RNA Oligomer
gcugacagauaauaggcaggaca

SEQ ID NO: 64963 - RNA, 23 nt, Artificial Sequence
  RNA Oligomer
cugacagauaauaggcaggacau

SEQ ID NO: 64964 - RNA, 23 nt, Artificial Sequence
  RNA Oligomer
ugacagauaauaggcaggacaug

SEQ ID NO: 64965 - RNA, 23 nt, Artificial Sequence
  RNA Oligomer
auuccuugaauuagcgccuggug

SEQ ID NO: 64966 - RNA, 23 nt, Artificial Sequence
  RNA Oligomer
cauaguuggcuucuaaauacugg

SEQ ID NO: 64967 - RNA, 23 nt, Artificial Sequence
  RNA Oligomer
auaguuggcuucuaaauacuggu

SEQ ID NO: 64968 - RNA, 23 nt, Artificial Sequence
  RNA Oligomer
augaaaaaggccaguaaucauac

SEQ ID NO: 64969 - RNA, 23 nt, Artificial Sequence
  RNA Oligomer
ugaaaaaggccaguaaucauaca

SEQ ID NO: 64970 - RNA, 23 nt, Artificial Sequence
  RNA Oligomer
uuuuuucuucccacgucuagcuu

SEQ ID NO: 64971 - RNA, 23 nt, Artificial Sequence
  RNA Oligomer
uuuuucuucccacgucuagcuug

SEQ ID NO: 64972 - RNA, 23 nt, Artificial Sequence
  RNA Oligomer
uuuucuucccacgucuagcuugc

SEQ ID NO: 64973 - RNA, 23 nt, Artificial Sequence
  RNA Oligomer
uuucuucccacgucuagcuugca

SEQ ID NO: 64974 - RNA, 23 nt, Artificial Sequence
  RNA Oligomer
gcucaucauuccgaagauccuuc

SEQ ID NO: 64975 - RNA, 23 nt, Artificial Sequence
  RNA Oligomer
cucaucauuccgaagauccuucu

SEQ ID NO: 64976 - RNA, 23 nt, Artificial Sequence
  RNA Oligomer
ucaucauuccgaagauccuucuu

SEQ ID NO: 64977 - RNA, 23 nt, Artificial Sequence
  RNA Oligomer
caucauuccgaagauccuucuua

SEQ ID NO: 64978 - RNA, 23 nt, Artificial Sequence
  RNA Oligomer
aucauuccgaagauccuucuuau

SEQ ID NO: 64979 - RNA, 23 nt, Artificial Sequence
  RNA Oligomer
gaagauccuucuuauucccaacc

SEQ ID NO: 64980 - RNA, 23 nt, Artificial Sequence
  RNA Oligomer
aagauccuucuuauucccaacca

SEQ ID NO: 64981 - RNA, 23 nt, Artificial Sequence
  RNA Oligomer
agauccuucuuauucccaaccag

SEQ ID NO: 64982 - RNA, 23 nt, Artificial Sequence
  RNA Oligomer
gauccuucuuauucccaaccagg

SEQ ID NO: 64983 - RNA, 23 nt, Artificial Sequence
  RNA Oligomer
auccuucuuauucccaaccagga

SEQ ID NO: 64984 - RNA, 23 nt, Artificial Sequence
  RNA Oligomer
gaaaacugccuuuauucuauuag

SEQ ID NO: 64985 - RNA, 23 nt, Artificial Sequence
  RNA Oligomer
aaaacugccuuuauucuauuagu

SEQ ID NO: 64986 - RNA, 23 nt, Artificial Sequence
  RNA Oligomer
aaacugccuuuauucuauuagua

SEQ ID NO: 64987 - RNA, 23 nt, Artificial Sequence
  RNA Oligomer
aacugccuuuauucuauuaguag

SEQ ID NO: 64988 - RNA, 23 nt, Artificial Sequence
  RNA Oligomer
acugccuuuauucuauuaguagu

SEQ ID NO: 64989 - RNA, 23 nt, Artificial Sequence
  RNA Oligomer
uggagagaagagagacugagugc

SEQ ID NO: 64990 - RNA, 23 nt, Artificial Sequence
  RNA Oligomer
uuccuauuuacuuagcccagcuc

SEQ ID NO: 64991 - RNA, 23 nt, Artificial Sequence
  RNA Oligomer
aaaaaaugaauuuuccaucugac

SEQ ID NO: 64992 - RNA, 23 nt, Artificial Sequence
  RNA Oligomer
aaaaaugaauuuuccaucugacu

SEQ ID NO: 64993 - RNA, 23 nt, Artificial Sequence
  RNA Oligomer
aaaaugaauuuuccaucugacuu

SEQ ID NO: 64994 - RNA, 23 nt, Artificial Sequence
  RNA Oligomer
aaaugaauuuuccaucugacuuu

SEQ ID NO: 64995 - RNA, 23 nt, Artificial Sequence
  RNA Oligomer
aaugaauuuuccaucugacuuua

SEQ ID NO: 64996 - RNA, 23 nt, Artificial Sequence
  RNA Oligomer
aaaaaaccaauacacuuucuuug

SEQ ID NO: 64997 - RNA, 23 nt, Artificial Sequence
  RNA Oligomer
aaaaaccaauacacuuucuuuga

SEQ ID NO: 64998 - RNA, 23 nt, Artificial Sequence
  RNA Oligomer
aaaaccaauacacuuucuuugag

SEQ ID NO: 64999 - RNA, 23 nt, Artificial Sequence
  RNA Oligomer
aaaccaauacacuuucuuugagg

SEQ ID NO: 65000 - RNA, 23 nt, Artificial Sequence
  RNA Oligomer
aaccaauacacuuucuuugagga

SEQ ID NO: 65001 - RNA, 23 nt, Artificial Sequence
  RNA Oligomer
gaggaugacaguauuaggaaauc

SEQ ID NO: 65002 - RNA, 23 nt, Artificial Sequence
  RNA Oligomer
ccagagcuaugccaacaaaaucu

SEQ ID NO: 65003 - RNA, 23 nt, Artificial Sequence
  RNA Oligomer
cagagcuaugccaacaaaaucug

SEQ ID NO: 65004 - RNA, 23 nt, Artificial Sequence
  RNA Oligomer
agagcuaugccaacaaaaucugu

SEQ ID NO: 65005 - RNA, 23 nt, Artificial Sequence
  RNA Oligomer
gagcuaugccaacaaaaucuguu

SEQ ID NO: 65006 - RNA, 23 nt, Artificial Sequence
  RNA Oligomer
agcuaugccaacaaaaucuguua

SEQ ID NO: 65007 - RNA, 23 nt, Artificial Sequence
  RNA Oligomer
uaaucauaguuggcuucuaaaua

SEQ ID NO: 65008 - RNA, 23 nt, Artificial Sequence
  RNA Oligomer
aaucauaguuggcuucuaaauac

SEQ ID NO: 65009 - RNA, 23 nt, Artificial Sequence
  RNA Oligomer
uacugguagcaagaugacuucug

SEQ ID NO: 65010 - RNA, 23 nt, Artificial Sequence
  RNA Oligomer
acugguagcaagaugacuucuga

SEQ ID NO: 65011 - RNA, 23 nt, Artificial Sequence
  RNA Oligomer
cugguagcaagaugacuucugau

SEQ ID NO: 65012 - RNA, 23 nt, Artificial Sequence
  RNA Oligomer
aaugaaaaaggccaguaaucaua

SEQ ID NO: 65013 - RNA, 23 nt, Artificial Sequence
  RNA Oligomer
agauuaauaaacagcacuucaaa

SEQ ID NO: 65014 - RNA, 23 nt, Artificial Sequence
  RNA Oligomer
gauuaauaaacagcacuucaaaa

SEQ ID NO: 65015 - RNA, 23 nt, Artificial Sequence
  RNA Oligomer
gcacuucaaaauuaaccgcauaa

SEQ ID NO: 65016 - RNA, 23 nt, Artificial Sequence
  RNA Oligomer
cacuucaaaauuaaccgcauaag

SEQ ID NO: 65017 - RNA, 23 nt, Artificial Sequence
  RNA Oligomer
cccagauuuuuucuucccacguc

SEQ ID NO: 65018 - RNA, 23 nt, Artificial Sequence
  RNA Oligomer
ucguagccauuucaaaaaccucu

SEQ ID NO: 65019 - RNA, 23 nt, Artificial Sequence
  RNA Oligomer
cguagccauuucaaaaaccucuc

SEQ ID NO: 65020 - RNA, 23 nt, Artificial Sequence
  RNA Oligomer
guagccauuucaaaaaccucucu

SEQ ID NO: 65021 - RNA, 23 nt, Artificial Sequence
  RNA Oligomer
ugugugcucaucauuccgaagau

SEQ ID NO: 65022 - RNA, 23 nt, Artificial Sequence
  RNA Oligomer
gaaaugcuugacuucuggggucc

SEQ ID NO: 65023 - RNA, 23 nt, Artificial Sequence
  RNA Oligomer
ggggccucaggcgaucauaaucu

SEQ ID NO: 65024 - RNA, 23 nt, Artificial Sequence
  RNA Oligomer
gggccucaggcgaucauaaucuu

SEQ ID NO: 65025 - RNA, 23 nt, Artificial Sequence
  RNA Oligomer
ggccucaggcgaucauaaucuuc

SEQ ID NO: 65026 - RNA, 23 nt, Artificial Sequence
  RNA Oligomer
ggcgaucauaaucuuccugccca

SEQ ID NO: 65027 - RNA, 23 nt, Artificial Sequence
  RNA Oligomer
gcgaucauaaucuuccugcccag

SEQ ID NO: 65028 - RNA, 23 nt, Artificial Sequence
  RNA Oligomer
cgaucauaaucuuccugcccagc

SEQ ID NO: 65029 - RNA, 23 nt, Artificial Sequence
  RNA Oligomer
gaucauaaucuuccugcccagcu

SEQ ID NO: 65030 - RNA, 23 nt, Artificial Sequence
  RNA Oligomer
aucauaaucuuccugcccagcug

SEQ ID NO: 65031 - RNA, 23 nt, Artificial Sequence
  RNA Oligomer
ucauaaucuuccugcccagcugu

SEQ ID NO: 65032 - RNA, 23 nt, Artificial Sequence
  RNA Oligomer
cauaaucuuccugcccagcugug

SEQ ID NO: 65033 - RNA, 23 nt, Artificial Sequence
  RNA Oligomer
auaaucuuccugcccagcugugu

SEQ ID NO: 65034 - RNA, 23 nt, Artificial Sequence
  RNA Oligomer
uaaucuuccugcccagcuguguc

SEQ ID NO: 65035 - RNA, 23 nt, Artificial Sequence
  RNA Oligomer
ucccacaaagccaacucuaccug

SEQ ID NO: 65036 - RNA, 23 nt, Artificial Sequence
  RNA Oligomer
cccacaaagccaacucuaccugc

SEQ ID NO: 65037 - RNA, 23 nt, Artificial Sequence
  RNA Oligomer
ccacaaagccaacucuaccugcu

SEQ ID NO: 65038 - RNA, 23 nt, Artificial Sequence
  RNA Oligomer
cacaaagccaacucuaccugcuu

SEQ ID NO: 65039 - RNA, 23 nt, Artificial Sequence
  RNA Oligomer
uuccauccaccucgauaucugcc

SEQ ID NO: 65040 - RNA, 23 nt, Artificial Sequence
  RNA Oligomer
uccauccaccucgauaucugcca

SEQ ID NO: 65041 - RNA, 23 nt, Artificial Sequence
  RNA Oligomer
ccauccaccucgauaucugccac

SEQ ID NO: 65042 - RNA, 23 nt, Artificial Sequence
  RNA Oligomer
cauccaccucgauaucugccaca

SEQ ID NO: 65043 - RNA, 23 nt, Artificial Sequence
  RNA Oligomer
auccaccucgauaucugccacau

SEQ ID NO: 65044 - RNA, 23 nt, Artificial Sequence
  RNA Oligomer
ccaucuuccaaagugucuaauug

SEQ ID NO: 65045 - RNA, 23 nt, Artificial Sequence
  RNA Oligomer
aagugucuaauugccucaggcgu

SEQ ID NO: 65046 - RNA, 23 nt, Artificial Sequence
  RNA Oligomer
uccuauuuacuuagcccagcucc

SEQ ID NO: 65047 - RNA, 23 nt, Artificial Sequence
  RNA Oligomer
ccuauuuacuuagcccagcucca

SEQ ID NO: 65048 - RNA, 23 nt, Artificial Sequence
  RNA Oligomer
cuauuuacuuagcccagcuccau

SEQ ID NO: 65049 - RNA, 23 nt, Artificial Sequence
  RNA Oligomer
uauuuacuuagcccagcuccaug

SEQ ID NO: 65050 - RNA, 23 nt, Artificial Sequence
  RNA Oligomer
auuuacuuagcccagcuccaugg

SEQ ID NO: 65051 - RNA, 23 nt, Artificial Sequence
  RNA Oligomer
uaacuaacaugaaaccacagaac

SEQ ID NO: 65052 - RNA, 23 nt, Artificial Sequence
  RNA Oligomer
aacuaacaugaaaccacagaacu

SEQ ID NO: 65053 - RNA, 23 nt, Artificial Sequence
  RNA Oligomer
acuaacaugaaaccacagaacug

SEQ ID NO: 65054 - RNA, 23 nt, Artificial Sequence
  RNA Oligomer
cuaacaugaaaccacagaacugu

SEQ ID NO: 65055 - RNA, 23 nt, Artificial Sequence
  RNA Oligomer
uaacaugaaaccacagaacugua

SEQ ID NO: 65056 - RNA, 23 nt, Artificial Sequence
  RNA Oligomer
aacaugaaaccacagaacuguaa

SEQ ID NO: 65057 - RNA, 23 nt, Artificial Sequence
  RNA Oligomer
acaugaaaccacagaacuguaac

SEQ ID NO: 65058 - RNA, 23 nt, Artificial Sequence
  RNA Oligomer
caugaaaccacagaacuguaacu

SEQ ID NO: 65059 - RNA, 23 nt, Artificial Sequence
  RNA Oligomer
gcuaugccaacaaaaucuguuac

SEQ ID NO: 65060 - RNA, 23 nt, Artificial Sequence
  RNA Oligomer
cuaugccaacaaaaucuguuacg

SEQ ID NO: 65061 - RNA, 23 nt, Artificial Sequence
  RNA Oligomer
uaugccaacaaaaucuguuacgg

SEQ ID NO: 65062 - RNA, 23 nt, Artificial Sequence
  RNA Oligomer
gacagauaauaggcaggacaugu

SEQ ID NO: 65063 - RNA, 23 nt, Artificial Sequence
  RNA Oligomer
cuagaaagaagcaagaaguuaag

SEQ ID NO: 65064 - RNA, 23 nt, Artificial Sequence
  RNA Oligomer
uagaaagaagcaagaaguuaaga

SEQ ID NO: 65065 - RNA, 23 nt, Artificial Sequence
  RNA Oligomer
agaaagaagcaagaaguuaagaa

SEQ ID NO: 65066 - RNA, 23 nt, Artificial Sequence
  RNA Oligomer
gaaagaagcaagaaguuaagaaa

SEQ ID NO: 65067 - RNA, 23 nt, Artificial Sequence
  RNA Oligomer
aaagaagcaagaaguuaagaaau

SEQ ID NO: 65068 - RNA, 23 nt, Artificial Sequence
  RNA Oligomer
uuccuugaauuagcgccuggugu

SEQ ID NO: 65069 - RNA, 23 nt, Artificial Sequence
  RNA Oligomer
uccuugaauuagcgccuggugug

SEQ ID NO: 65070 - RNA, 23 nt, Artificial Sequence
  RNA Oligomer
acuucugauuuguaaucuuaggu

SEQ ID NO: 65071 - RNA, 23 nt, Artificial Sequence
  RNA Oligomer
cuucugauuuguaaucuuaggua

SEQ ID NO: 65072 - RNA, 23 nt, Artificial Sequence
  RNA Oligomer
uucugauuuguaaucuuagguaa

SEQ ID NO: 65073 - RNA, 23 nt, Artificial Sequence
  RNA Oligomer
ucacaagacaaggcacccagauu

SEQ ID NO: 65074 - RNA, 23 nt, Artificial Sequence
  RNA Oligomer
acaucaguauaacaucgguaucu

SEQ ID NO: 65075 - RNA, 23 nt, Artificial Sequence
  RNA Oligomer
caucaguauaacaucgguaucug

SEQ ID NO: 65076 - RNA, 23 nt, Artificial Sequence
  RNA Oligomer
aucaguauaacaucgguaucugg

SEQ ID NO: 65077 - RNA, 23 nt, Artificial Sequence
  RNA Oligomer
auaacaucgguaucuggguagga

SEQ ID NO: 65078 - RNA, 23 nt, Artificial Sequence
  RNA Oligomer
cugugucccacaaagccaacucu

SEQ ID NO: 65079 - RNA, 23 nt, Artificial Sequence
  RNA Oligomer
ugugucccacaaagccaacucua

SEQ ID NO: 65080 - RNA, 23 nt, Artificial Sequence
  RNA Oligomer
gugucccacaaagccaacucuac

SEQ ID NO: 65081 - RNA, 23 nt, Artificial Sequence
  RNA Oligomer
ugucccacaaagccaacucuacc

SEQ ID NO: 65082 - RNA, 23 nt, Artificial Sequence
  RNA Oligomer
gucccacaaagccaacucuaccu

SEQ ID NO: 65083 - RNA, 23 nt, Artificial Sequence
  RNA Oligomer
aaagccaacucuaccugcuuucc

SEQ ID NO: 65084 - RNA, 23 nt, Artificial Sequence
  RNA Oligomer
uccaccucgauaucugccacaua

SEQ ID NO: 65085 - RNA, 23 nt, Artificial Sequence
  RNA Oligomer
aguccaggugagacagguuaugc

SEQ ID NO: 65086 - RNA, 23 nt, Artificial Sequence
  RNA Oligomer
guccaggugagacagguuaugcc

SEQ ID NO: 65087 - RNA, 23 nt, Artificial Sequence
  RNA Oligomer
uccaggugagacagguuaugcca

SEQ ID NO: 65088 - RNA, 23 nt, Artificial Sequence
  RNA Oligomer
ccaggugagacagguuaugccau

SEQ ID NO: 65089 - RNA, 23 nt, Artificial Sequence
  RNA Oligomer
caggugagacagguuaugccauc

SEQ ID NO: 65090 - RNA, 23 nt, Artificial Sequence
  RNA Oligomer
augaauuuuccaucugacuuuau

SEQ ID NO: 65091 - RNA, 23 nt, Artificial Sequence
  RNA Oligomer
ugaauuuuccaucugacuuuauu

SEQ ID NO: 65092 - RNA, 23 nt, Artificial Sequence
  RNA Oligomer
gaauuuuccaucugacuuuauuu

SEQ ID NO: 65093 - RNA, 23 nt, Artificial Sequence
  RNA Oligomer
ugaggaugacaguauuaggaaau

SEQ ID NO: 65094 - RNA, 23 nt, Artificial Sequence
  RNA Oligomer
cuauaagguaacuaacaugaaac

SEQ ID NO: 65095 - RNA, 23 nt, Artificial Sequence
  RNA Oligomer
uauaagguaacuaacaugaaacc

SEQ ID NO: 65096 - RNA, 23 nt, Artificial Sequence
  RNA Oligomer
auaagguaacuaacaugaaacca

SEQ ID NO: 65097 - RNA, 23 nt, Artificial Sequence
  RNA Oligomer
uaagguaacuaacaugaaaccac

SEQ ID NO: 65098 - RNA, 23 nt, Artificial Sequence
  RNA Oligomer
aagguaacuaacaugaaaccaca

SEQ ID NO: 65099 - RNA, 23 nt, Artificial Sequence
  RNA Oligomer
cuugcagcugacagauaauaggc

SEQ ID NO: 65100 - RNA, 23 nt, Artificial Sequence
  RNA Oligomer
uugcagcugacagauaauaggca

SEQ ID NO: 65101 - RNA, 23 nt, Artificial Sequence
  RNA Oligomer
ugcagcugacagauaauaggcag

SEQ ID NO: 65102 - RNA, 23 nt, Artificial Sequence
  RNA Oligomer
gcagcugacagauaauaggcagg

SEQ ID NO: 65103 - RNA, 23 nt, Artificial Sequence
  RNA Oligomer
aagaaguuaagaaauuccuugaa

SEQ ID NO: 65104 - RNA, 23 nt, Artificial Sequence
  RNA Oligomer
agaaguuaagaaauuccuugaau

SEQ ID NO: 65105 - RNA, 23 nt, Artificial Sequence
  RNA Oligomer
gaaguuaagaaauuccuugaauu

SEQ ID NO: 65106 - RNA, 23 nt, Artificial Sequence
  RNA Oligomer
ucucguagccauuucaaaaaccu

SEQ ID NO: 65107 - RNA, 23 nt, Artificial Sequence
  RNA Oligomer
cucguagccauuucaaaaaccuc

SEQ ID NO: 65108 - RNA, 23 nt, Artificial Sequence
  RNA Oligomer
cugcuucaucuuggcuagcuccc

SEQ ID NO: 65109 - RNA, 23 nt, Artificial Sequence
  RNA Oligomer
ugcuucaucuuggcuagcucccg

SEQ ID NO: 65110 - RNA, 23 nt, Artificial Sequence
  RNA Oligomer
gcuucaucuuggcuagcucccgc

SEQ ID NO: 65111 - RNA, 23 nt, Artificial Sequence
  RNA Oligomer
cuucaucuuggcuagcucccgcc

SEQ ID NO: 65112 - RNA, 23 nt, Artificial Sequence
  RNA Oligomer
uucaucuuggcuagcucccgccu

SEQ ID NO: 65113 - RNA, 23 nt, Artificial Sequence
  RNA Oligomer
uccuucuuauucccaaccaggau

SEQ ID NO: 65114 - RNA, 23 nt, Artificial Sequence
  RNA Oligomer
aaacuaucagggcugucgaugga

SEQ ID NO: 65115 - RNA, 23 nt, Artificial Sequence
  RNA Oligomer
aacuaucagggcugucgauggaa

SEQ ID NO: 65116 - RNA, 23 nt, Artificial Sequence
  RNA Oligomer
acuaucagggcugucgauggaaa

SEQ ID NO: 65117 - RNA, 23 nt, Artificial Sequence
  RNA Oligomer
cuaucagggcugucgauggaaaa

SEQ ID NO: 65118 - RNA, 23 nt, Artificial Sequence
  RNA Oligomer
uaucagggcugucgauggaaaaa

SEQ ID NO: 65119 - RNA, 23 nt, Artificial Sequence
  RNA Oligomer
uacagaaaaaaaguuuagucagc

SEQ ID NO: 65120 - RNA, 23 nt, Artificial Sequence
  RNA Oligomer
acagaaaaaaaguuuagucagcu

SEQ ID NO: 65121 - RNA, 23 nt, Artificial Sequence
  RNA Oligomer
cagaaaaaaaguuuagucagcug

SEQ ID NO: 65122 - RNA, 23 nt, Artificial Sequence
  RNA Oligomer
agaaaaaaaguuuagucagcugg

SEQ ID NO: 65123 - RNA, 23 nt, Artificial Sequence
  RNA Oligomer
gaaaaaaaguuuagucagcugga

SEQ ID NO: 65124 - RNA, 23 nt, Artificial Sequence
  RNA Oligomer
cuggagagaagagagacugagug

SEQ ID NO: 65125 - RNA, 23 nt, Artificial Sequence
  RNA Oligomer
gcacauacaccucugggaacugg

SEQ ID NO: 65126 - RNA, 23 nt, Artificial Sequence
  RNA Oligomer
cacauacaccucugggaacuggu

SEQ ID NO: 65127 - RNA, 23 nt, Artificial Sequence
  RNA Oligomer
acauacaccucugggaacugguc

SEQ ID NO: 65128 - RNA, 23 nt, Artificial Sequence
  RNA Oligomer
cauacaccucugggaacuggucc

SEQ ID NO: 65129 - RNA, 23 nt, Artificial Sequence
  RNA Oligomer
auacaccucugggaacugguccu

SEQ ID NO: 65130 - RNA, 23 nt, Artificial Sequence
  RNA Oligomer
uaaacagcacuucaaaauuaacc

SEQ ID NO: 65131 - RNA, 23 nt, Artificial Sequence
  RNA Oligomer
uaacaucgguaucuggguaggag

SEQ ID NO: 65132 - RNA, 23 nt, Artificial Sequence
  RNA Oligomer
aacaucgguaucuggguaggaga

SEQ ID NO: 65133 - RNA, 23 nt, Artificial Sequence
  RNA Oligomer
acaucgguaucuggguaggagag

SEQ ID NO: 65134 - RNA, 23 nt, Artificial Sequence
  RNA Oligomer
acucuaccugcuuuccauccacc

SEQ ID NO: 65135 - RNA, 23 nt, Artificial Sequence
  RNA Oligomer
cucuaccugcuuuccauccaccu

SEQ ID NO: 65136 - RNA, 23 nt, Artificial Sequence
  RNA Oligomer
ucuaccugcuuuccauccaccuc

SEQ ID NO: 65137 - RNA, 23 nt, Artificial Sequence
  RNA Oligomer
cuaccugcuuuccauccaccucg

SEQ ID NO: 65138 - RNA, 23 nt, Artificial Sequence
  RNA Oligomer
uaccugcuuuccauccaccucga

SEQ ID NO: 65139 - RNA, 23 nt, Artificial Sequence
  RNA Oligomer
uuuccauccaccucgauaucugc

SEQ ID NO: 65140 - RNA, 23 nt, Artificial Sequence
  RNA Oligomer
ggauacagugaggagaaaagagc

SEQ ID NO: 65141 - RNA, 23 nt, Artificial Sequence
  RNA Oligomer
gauacagugaggagaaaagagca

SEQ ID NO: 65142 - RNA, 23 nt, Artificial Sequence
  RNA Oligomer
agugucuaauugccucaggcgug

SEQ ID NO: 65143 - RNA, 23 nt, Artificial Sequence
  RNA Oligomer
aauuuuccaucugacuuuauuuc

SEQ ID NO: 65144 - RNA, 23 nt, Artificial Sequence
  RNA Oligomer
auuuuccaucugacuuuauuucc

SEQ ID NO: 65145 - RNA, 23 nt, Artificial Sequence
  RNA Oligomer
agguaacuaacaugaaaccacag

SEQ ID NO: 65146 - RNA, 23 nt, Artificial Sequence
  RNA Oligomer
gguaacuaacaugaaaccacaga

SEQ ID NO: 65147 - RNA, 23 nt, Artificial Sequence
  RNA Oligomer
guaacuaacaugaaaccacagaa

SEQ ID NO: 65148 - RNA, 23 nt, Artificial Sequence
  RNA Oligomer
ugugcucaucauuccgaagaucc

SEQ ID NO: 65149 - RNA, 23 nt, Artificial Sequence
  RNA Oligomer
gugcucaucauuccgaagauccu

SEQ ID NO: 65150 - RNA, 23 nt, Artificial Sequence
  RNA Oligomer
ugcucaucauuccgaagauccuu

SEQ ID NO: 65151 - RNA, 23 nt, Artificial Sequence
  RNA Oligomer
gaaaaacacaucaguauaacauc

SEQ ID NO: 65152 - RNA, 23 nt, Artificial Sequence
  RNA Oligomer
ccucgauaucugccacauaguuc

SEQ ID NO: 65153 - RNA, 23 nt, Artificial Sequence
  RNA Oligomer
guggacuaacgagagaaccgacg

SEQ ID NO: 65154 - RNA, 23 nt, Artificial Sequence
  RNA Oligomer
uggacuaacgagagaaccgacgg

SEQ ID NO: 65155 - RNA, 23 nt, Artificial Sequence
  RNA Oligomer
ggacuaacgagagaaccgacgga

SEQ ID NO: 65156 - RNA, 23 nt, Artificial Sequence
  RNA Oligomer
gacuaacgagagaaccgacggag

SEQ ID NO: 65157 - RNA, 23 nt, Artificial Sequence
  RNA Oligomer
acuaacgagagaaccgacggagg

SEQ ID NO: 65158 - RNA, 23 nt, Artificial Sequence
  RNA Oligomer
uacacuuucuuugaggaugacag

SEQ ID NO: 65159 - RNA, 23 nt, Artificial Sequence
  RNA Oligomer
acacuuucuuugaggaugacagu

SEQ ID NO: 65160 - RNA, 23 nt, Artificial Sequence
  RNA Oligomer
cacuuucuuugaggaugacagua

SEQ ID NO: 65161 - RNA, 23 nt, Artificial Sequence
  RNA Oligomer
acuuucuuugaggaugacaguau

SEQ ID NO: 65162 - RNA, 23 nt, Artificial Sequence
  RNA Oligomer
cuuucuuugaggaugacaguauu

SEQ ID NO: 65163 - RNA, 23 nt, Artificial Sequence
  RNA Oligomer
uuucuuugaggaugacaguauua

SEQ ID NO: 65164 - RNA, 23 nt, Artificial Sequence
  RNA Oligomer
ccaacucuaccugcuuuccaucc

SEQ ID NO: 65165 - RNA, 23 nt, Artificial Sequence
  RNA Oligomer
caacucuaccugcuuuccaucca

SEQ ID NO: 65166 - RNA, 23 nt, Artificial Sequence
  RNA Oligomer
aacucuaccugcuuuccauccac

SEQ ID NO: 65167 - RNA, 23 nt, Artificial Sequence
  RNA Oligomer
cugcuuuccauccaccucgauau

SEQ ID NO: 65168 - RNA, 23 nt, Artificial Sequence
  RNA Oligomer
ugcuuuccauccaccucgauauc

SEQ ID NO: 65169 - RNA, 23 nt, Artificial Sequence
  RNA Oligomer
gcuuuccauccaccucgauaucu

SEQ ID NO: 65170 - RNA, 23 nt, Artificial Sequence
  RNA Oligomer
cuuuccauccaccucgauaucug

SEQ ID NO: 65171 - RNA, 23 nt, Artificial Sequence
  RNA Oligomer
ucagcuggagagaagagagacug

SEQ ID NO: 65172 - RNA, 23 nt, Artificial Sequence
  RNA Oligomer
cagcuggagagaagagagacuga

SEQ ID NO: 65173 - RNA, 23 nt, Artificial Sequence
  RNA Oligomer
agcuggagagaagagagacugag

SEQ ID NO: 65174 - RNA, 23 nt, Artificial Sequence
  RNA Oligomer
gcuggagagaagagagacugagu

SEQ ID NO: 65175 - RNA, 23 nt, Artificial Sequence
  RNA Oligomer
uggauacagugaggagaaaagag

SEQ ID NO: 65176 - RNA, 23 nt, Artificial Sequence
  RNA Oligomer
ccucucucacuccaucuuugguc

SEQ ID NO: 65177 - RNA, 23 nt, Artificial Sequence
  RNA Oligomer
cucucucacuccaucuuuggucu

SEQ ID NO: 65178 - RNA, 23 nt, Artificial Sequence
  RNA Oligomer
ucucucacuccaucuuuggucuu

SEQ ID NO: 65179 - RNA, 23 nt, Artificial Sequence
  RNA Oligomer
cucucacuccaucuuuggucuuu

SEQ ID NO: 65180 - RNA, 23 nt, Artificial Sequence
  RNA Oligomer
ucucacuccaucuuuggucuuug

SEQ ID NO: 65181 - RNA, 23 nt, Artificial Sequence
  RNA Oligomer
ccugcuucaucuuggcuagcucc

SEQ ID NO: 65182 - RNA, 23 nt, Artificial Sequence
  RNA Oligomer
accaauacacuuucuuugaggau

SEQ ID NO: 65183 - RNA, 23 nt, Artificial Sequence
  RNA Oligomer
ugacucaccagaguaccuugcag

SEQ ID NO: 65184 - RNA, 23 nt, Artificial Sequence
  RNA Oligomer
gacucaccagaguaccuugcagc

SEQ ID NO: 65185 - RNA, 23 nt, Artificial Sequence
  RNA Oligomer
acucaccagaguaccuugcagcu

SEQ ID NO: 65186 - RNA, 23 nt, Artificial Sequence
  RNA Oligomer
cucaccagaguaccuugcagcug

SEQ ID NO: 65187 - RNA, 23 nt, Artificial Sequence
  RNA Oligomer
ucaccagaguaccuugcagcuga

SEQ ID NO: 65188 - RNA, 23 nt, Artificial Sequence
  RNA Oligomer
agagcagugucaaaaggacccug

SEQ ID NO: 65189 - RNA, 23 nt, Artificial Sequence
  RNA Oligomer
gagcagugucaaaaggacccugg

SEQ ID NO: 65190 - RNA, 23 nt, Artificial Sequence
  RNA Oligomer
agcagugucaaaaggacccuggu

SEQ ID NO: 65191 - RNA, 23 nt, Artificial Sequence
  RNA Oligomer
aaaauuaaccgcauaagggcugu

SEQ ID NO: 65192 - RNA, 23 nt, Artificial Sequence
  RNA Oligomer
aaauuaaccgcauaagggcugug

SEQ ID NO: 65193 - RNA, 23 nt, Artificial Sequence
  RNA Oligomer
aauuaaccgcauaagggcugugc

SEQ ID NO: 65194 - RNA, 23 nt, Artificial Sequence
  RNA Oligomer
auuaaccgcauaagggcugugcu

SEQ ID NO: 65195 - RNA, 23 nt, Artificial Sequence
  RNA Oligomer
uuaaccgcauaagggcugugcuu

SEQ ID NO: 65196 - RNA, 23 nt, Artificial Sequence
  RNA Oligomer
cuucuuauucccaaccaggauga

SEQ ID NO: 65197 - RNA, 23 nt, Artificial Sequence
  RNA Oligomer
uucuuauucccaaccaggaugau

SEQ ID NO: 65198 - RNA, 23 nt, Artificial Sequence
  RNA Oligomer
ucuuauucccaaccaggaugaug

SEQ ID NO: 65199 - RNA, 23 nt, Artificial Sequence
  RNA Oligomer
cuuauucccaaccaggaugaugg

SEQ ID NO: 65200 - RNA, 23 nt, Artificial Sequence
  RNA Oligomer
uuauucccaaccaggaugauggg

SEQ ID NO: 65201 - RNA, 23 nt, Artificial Sequence
  RNA Oligomer
agccaacucuaccugcuuuccau

SEQ ID NO: 65202 - RNA, 23 nt, Artificial Sequence
  RNA Oligomer
gccaacucuaccugcuuuccauc

SEQ ID NO: 65203 - RNA, 23 nt, Artificial Sequence
  RNA Oligomer
gccucaggcgugaaaccaauucc

SEQ ID NO: 65204 - RNA, 23 nt, Artificial Sequence
  RNA Oligomer
ccucaggcgugaaaccaauuccu

SEQ ID NO: 65205 - RNA, 23 nt, Artificial Sequence
  RNA Oligomer
cucaggcgugaaaccaauuccua

SEQ ID NO: 65206 - RNA, 23 nt, Artificial Sequence
  RNA Oligomer
ucaggcgugaaaccaauuccuau

SEQ ID NO: 65207 - RNA, 23 nt, Artificial Sequence
  RNA Oligomer
caggcgugaaaccaauuccuauu

SEQ ID NO: 65208 - RNA, 23 nt, Artificial Sequence
  RNA Oligomer
aucauaguuggcuucuaaauacu

SEQ ID NO: 65209 - RNA, 23 nt, Artificial Sequence
  RNA Oligomer
ucauaguuggcuucuaaauacug

SEQ ID NO: 65210 - RNA, 23 nt, Artificial Sequence
  RNA Oligomer
caaaauuaaccgcauaagggcug

SEQ ID NO: 65211 - RNA, 23 nt, Artificial Sequence
  RNA Oligomer
agcaagguuucacaagacaaggc

SEQ ID NO: 65212 - RNA, 23 nt, Artificial Sequence
  RNA Oligomer
gcaagguuucacaagacaaggca

SEQ ID NO: 65213 - RNA, 23 nt, Artificial Sequence
  RNA Oligomer
caagguuucacaagacaaggcac

SEQ ID NO: 65214 - RNA, 23 nt, Artificial Sequence
  RNA Oligomer
accguggacuaacgagagaaccg

SEQ ID NO: 65215 - RNA, 23 nt, Artificial Sequence
  RNA Oligomer
ccguggacuaacgagagaaccga

SEQ ID NO: 65216 - RNA, 23 nt, Artificial Sequence
  RNA Oligomer
cguggacuaacgagagaaccgac

SEQ ID NO: 65217 - RNA, 23 nt, Artificial Sequence
  RNA Oligomer
ugccuucuucagguuucaccggc

SEQ ID NO: 65218 - RNA, 23 nt, Artificial Sequence
  RNA Oligomer
gccuucuucagguuucaccggcu

SEQ ID NO: 65219 - RNA, 23 nt, Artificial Sequence
  RNA Oligomer
ccuucuucagguuucaccggcuc

SEQ ID NO: 65220 - RNA, 23 nt, Artificial Sequence
  RNA Oligomer
cuucuucagguuucaccggcucc

SEQ ID NO: 65221 - RNA, 23 nt, Artificial Sequence
  RNA Oligomer
uucuucagguuucaccggcuccu

SEQ ID NO: 65222 - RNA, 23 nt, Artificial Sequence
  RNA Oligomer
aggcgaucauaaucuuccugccc

SEQ ID NO: 65223 - RNA, 23 nt, Artificial Sequence
  RNA Oligomer
uaguaguuggaaaaauuaacugg

SEQ ID NO: 65224 - RNA, 23 nt, Artificial Sequence
  RNA Oligomer
agcaugucuuuccacaggcucca

SEQ ID NO: 65225 - RNA, 23 nt, Artificial Sequence
  RNA Oligomer
gcaugucuuuccacaggcuccau

SEQ ID NO: 65226 - RNA, 23 nt, Artificial Sequence
  RNA Oligomer
caugucuuuccacaggcuccauc

SEQ ID NO: 65227 - RNA, 23 nt, Artificial Sequence
  RNA Oligomer
augucuuuccacaggcuccauca

SEQ ID NO: 65228 - RNA, 23 nt, Artificial Sequence
  RNA Oligomer
uucaaaauuaaccgcauaagggc

SEQ ID NO: 65229 - RNA, 23 nt, Artificial Sequence
  RNA Oligomer
ucaaaauuaaccgcauaagggcu

SEQ ID NO: 65230 - RNA, 23 nt, Artificial Sequence
  RNA Oligomer
cucacuccaucuuuggucuuugc

SEQ ID NO: 65231 - RNA, 23 nt, Artificial Sequence
  RNA Oligomer
uauucccaaccaggaugaugggc

SEQ ID NO: 65232 - RNA, 23 nt, Artificial Sequence
  RNA Oligomer
auucccaaccaggaugaugggca

SEQ ID NO: 65233 - RNA, 23 nt, Artificial Sequence
  RNA Oligomer
uucccaaccaggaugaugggcac

SEQ ID NO: 65234 - RNA, 23 nt, Artificial Sequence
  RNA Oligomer
aaaaaaaguuuagucagcuggag

SEQ ID NO: 65235 - RNA, 23 nt, Artificial Sequence
  RNA Oligomer
aaaaaaguuuagucagcuggaga

SEQ ID NO: 65236 - RNA, 23 nt, Artificial Sequence
  RNA Oligomer
aaaaaguuuagucagcuggagag

SEQ ID NO: 65237 - RNA, 23 nt, Artificial Sequence
  RNA Oligomer
aucagaaaaagugacaaaacggg

SEQ ID NO: 65238 - RNA, 23 nt, Artificial Sequence
  RNA Oligomer
ucagaaaaagugacaaaacggga

SEQ ID NO: 65239 - RNA, 23 nt, Artificial Sequence
  RNA Oligomer
cagaaaaagugacaaaacgggaa

SEQ ID NO: 65240 - RNA, 23 nt, Artificial Sequence
  RNA Oligomer
agaaaaagugacaaaacgggaau

SEQ ID NO: 65241 - RNA, 23 nt, Artificial Sequence
  RNA Oligomer
gaaaaagugacaaaacgggaauu

SEQ ID NO: 65242 - RNA, 23 nt, Artificial Sequence
  RNA Oligomer
augaaaccacagaacuguaacuc

SEQ ID NO: 65243 - RNA, 23 nt, Artificial Sequence
  RNA Oligomer
ugaaaccacagaacuguaacucu

SEQ ID NO: 65244 - RNA, 23 nt, Artificial Sequence
  RNA Oligomer
gaaaccacagaacuguaacucug

SEQ ID NO: 65245 - RNA, 23 nt, Artificial Sequence
  RNA Oligomer
gcagugucaaaaggacccuggug

SEQ ID NO: 65246 - RNA, 23 nt, Artificial Sequence
  RNA Oligomer
cagugucaaaaggacccuggugg

SEQ ID NO: 65247 - RNA, 23 nt, Artificial Sequence
  RNA Oligomer
agugucaaaaggacccugguggg

SEQ ID NO: 65248 - RNA, 23 nt, Artificial Sequence
  RNA Oligomer
accucucucacuccaucuuuggu

SEQ ID NO: 65249 - RNA, 23 nt, Artificial Sequence
  RNA Oligomer
gcugugucccacaaagccaacuc

SEQ ID NO: 65250 - RNA, 23 nt, Artificial Sequence
  RNA Oligomer
aguucucaaacacugugggcaca

SEQ ID NO: 65251 - RNA, 23 nt, Artificial Sequence
  RNA Oligomer
guucucaaacacugugggcacau

SEQ ID NO: 65252 - RNA, 23 nt, Artificial Sequence
  RNA Oligomer
uucucaaacacugugggcacaua

SEQ ID NO: 65253 - RNA, 23 nt, Artificial Sequence
  RNA Oligomer
gagggaaccuggauacagugagg

SEQ ID NO: 65254 - RNA, 23 nt, Artificial Sequence
  RNA Oligomer
agggaaccuggauacagugagga

SEQ ID NO: 65255 - RNA, 23 nt, Artificial Sequence
  RNA Oligomer
gggaaccuggauacagugaggag

SEQ ID NO: 65256 - RNA, 23 nt, Artificial Sequence
  RNA Oligomer
ggaaccuggauacagugaggaga

SEQ ID NO: 65257 - RNA, 23 nt, Artificial Sequence
  RNA Oligomer
gaaccuggauacagugaggagaa

SEQ ID NO: 65258 - RNA, 23 nt, Artificial Sequence
  RNA Oligomer
uauggccaucuuuuaucagaaaa

SEQ ID NO: 65259 - RNA, 23 nt, Artificial Sequence
  RNA Oligomer
auggccaucuuuuaucagaaaaa

SEQ ID NO: 65260 - RNA, 23 nt, Artificial Sequence
  RNA Oligomer
guagcaagaugacuucugauuug

SEQ ID NO: 65261 - RNA, 23 nt, Artificial Sequence
  RNA Oligomer
uagcaagaugacuucugauuugu

SEQ ID NO: 65262 - RNA, 23 nt, Artificial Sequence
  RNA Oligomer
agcaagaugacuucugauuugua

SEQ ID NO: 65263 - RNA, 23 nt, Artificial Sequence
  RNA Oligomer
gcaagaugacuucugauuuguaa

SEQ ID NO: 65264 - RNA, 23 nt, Artificial Sequence
  RNA Oligomer
caagaugacuucugauuuguaau

SEQ ID NO: 65265 - RNA, 23 nt, Artificial Sequence
  RNA Oligomer
uaaccgcauaagggcugugcuug

SEQ ID NO: 65266 - RNA, 23 nt, Artificial Sequence
  RNA Oligomer
ucacuccaucuuuggucuuugcu

SEQ ID NO: 65267 - RNA, 23 nt, Artificial Sequence
  RNA Oligomer
cacuccaucuuuggucuuugcug

SEQ ID NO: 65268 - RNA, 23 nt, Artificial Sequence
  RNA Oligomer
acuccaucuuuggucuuugcuga

SEQ ID NO: 65269 - RNA, 23 nt, Artificial Sequence
  RNA Oligomer
cuccaucuuuggucuuugcugaa

SEQ ID NO: 65270 - RNA, 23 nt, Artificial Sequence
  RNA Oligomer
ugccucaggcgugaaaccaauuc

SEQ ID NO: 65271 - RNA, 23 nt, Artificial Sequence
  RNA Oligomer
caacaaaaucuguuacggaguaa

SEQ ID NO: 65272 - RNA, 23 nt, Artificial Sequence
  RNA Oligomer
aacaaaaucuguuacggaguaaa

SEQ ID NO: 65273 - RNA, 23 nt, Artificial Sequence
  RNA Oligomer
acaaaaucuguuacggaguaaag

SEQ ID NO: 65274 - RNA, 23 nt, Artificial Sequence
  RNA Oligomer
caaaaucuguuacggaguaaagc

SEQ ID NO: 65275 - RNA, 23 nt, Artificial Sequence
  RNA Oligomer
aaaaucuguuacggaguaaagcc

SEQ ID NO: 65276 - RNA, 23 nt, Artificial Sequence
  RNA Oligomer
uuaagaaauuccuugaauuagcg

SEQ ID NO: 65277 - RNA, 23 nt, Artificial Sequence
  RNA Oligomer
uaagaaauuccuugaauuagcgc

SEQ ID NO: 65278 - RNA, 23 nt, Artificial Sequence
  RNA Oligomer
uugaauuagcgccugguguguca

SEQ ID NO: 65279 - RNA, 23 nt, Artificial Sequence
  RNA Oligomer
ugaauuagcgccuggugugucag

SEQ ID NO: 65280 - RNA, 23 nt, Artificial Sequence
  RNA Oligomer
gaauuagcgccuggugugucagg

SEQ ID NO: 65281 - RNA, 23 nt, Artificial Sequence
  RNA Oligomer
aauuagcgccuggugugucaggu

SEQ ID NO: 65282 - RNA, 23 nt, Artificial Sequence
  RNA Oligomer
auuagcgccuggugugucaggug

SEQ ID NO: 65283 - RNA, 23 nt, Artificial Sequence
  RNA Oligomer
aagaugacuucugauuuguaauc

SEQ ID NO: 65284 - RNA, 23 nt, Artificial Sequence
  RNA Oligomer
aaccuggauacagugaggagaaa

SEQ ID NO: 65285 - RNA, 23 nt, Artificial Sequence
  RNA Oligomer
ugaauuagagccagaugcuuaag

SEQ ID NO: 65286 - RNA, 23 nt, Artificial Sequence
  RNA Oligomer
gaauuagagccagaugcuuaagu

SEQ ID NO: 65287 - RNA, 23 nt, Artificial Sequence
  RNA Oligomer
aauuagagccagaugcuuaaguc

SEQ ID NO: 65288 - RNA, 23 nt, Artificial Sequence
  RNA Oligomer
auuagagccagaugcuuaagucc

SEQ ID NO: 65289 - RNA, 23 nt, Artificial Sequence
  RNA Oligomer
aaaaagugacaaaacgggaauuu

SEQ ID NO: 65290 - RNA, 23 nt, Artificial Sequence
  RNA Oligomer
ucucuuucuagaaagaagcaaga

SEQ ID NO: 65291 - RNA, 23 nt, Artificial Sequence
  RNA Oligomer
gaggagggcuguuagagcagugu

SEQ ID NO: 65292 - RNA, 23 nt, Artificial Sequence
  RNA Oligomer
aggagggcuguuagagcaguguc

SEQ ID NO: 65293 - RNA, 23 nt, Artificial Sequence
  RNA Oligomer
ggagggcuguuagagcaguguca

SEQ ID NO: 65294 - RNA, 23 nt, Artificial Sequence
  RNA Oligomer
gagggcuguuagagcagugucaa

SEQ ID NO: 65295 - RNA, 23 nt, Artificial Sequence
  RNA Oligomer
agggcuguuagagcagugucaaa

SEQ ID NO: 65296 - RNA, 23 nt, Artificial Sequence
  RNA Oligomer
gccauugcucaggcaacgaaucc

SEQ ID NO: 65297 - RNA, 23 nt, Artificial Sequence
  RNA Oligomer
ccauugcucaggcaacgaauccg

SEQ ID NO: 65298 - RNA, 23 nt, Artificial Sequence
  RNA Oligomer
cauugcucaggcaacgaauccga

SEQ ID NO: 65299 - RNA, 23 nt, Artificial Sequence
  RNA Oligomer
auugcucaggcaacgaauccgag

SEQ ID NO: 65300 - RNA, 23 nt, Artificial Sequence
  RNA Oligomer
uugcucaggcaacgaauccgagu

SEQ ID NO: 65301 - RNA, 23 nt, Artificial Sequence
  RNA Oligomer
cuaacgagagaaccgacggagga

SEQ ID NO: 65302 - RNA, 23 nt, Artificial Sequence
  RNA Oligomer
uaacgagagaaccgacggaggac

SEQ ID NO: 65303 - RNA, 23 nt, Artificial Sequence
  RNA Oligomer
aagagcacugugaauuagagcca

SEQ ID NO: 65304 - RNA, 23 nt, Artificial Sequence
  RNA Oligomer
agagcacugugaauuagagccag

SEQ ID NO: 65305 - RNA, 23 nt, Artificial Sequence
  RNA Oligomer
gugagacagguuaugccaucuuc

SEQ ID NO: 65306 - RNA, 23 nt, Artificial Sequence
  RNA Oligomer
ugagacagguuaugccaucuucc

SEQ ID NO: 65307 - RNA, 23 nt, Artificial Sequence
  RNA Oligomer
gagacagguuaugccaucuucca

SEQ ID NO: 65308 - RNA, 23 nt, Artificial Sequence
  RNA Oligomer
agacagguuaugccaucuuccaa

SEQ ID NO: 65309 - RNA, 23 nt, Artificial Sequence
  RNA Oligomer
gacagguuaugccaucuuccaaa

SEQ ID NO: 65310 - RNA, 23 nt, Artificial Sequence
  RNA Oligomer
acagguuaugccaucuuccaaag

SEQ ID NO: 65311 - RNA, 23 nt, Artificial Sequence
  RNA Oligomer
aaaagugacaaaacgggaauuua

SEQ ID NO: 65312 - RNA, 23 nt, Artificial Sequence
  RNA Oligomer
acuguaacucugccacagcugca

SEQ ID NO: 65313 - RNA, 23 nt, Artificial Sequence
  RNA Oligomer
cuguaacucugccacagcugcau

SEQ ID NO: 65314 - RNA, 23 nt, Artificial Sequence
  RNA Oligomer
uguaacucugccacagcugcaug

SEQ ID NO: 65315 - RNA, 23 nt, Artificial Sequence
  RNA Oligomer
guaacucugccacagcugcauga

SEQ ID NO: 65316 - RNA, 23 nt, Artificial Sequence
  RNA Oligomer
uaacucugccacagcugcaugaa

SEQ ID NO: 65317 - RNA, 23 nt, Artificial Sequence
  RNA Oligomer
augccaacaaaaucuguuacgga

SEQ ID NO: 65318 - RNA, 23 nt, Artificial Sequence
  RNA Oligomer
ugccaacaaaaucuguuacggag

SEQ ID NO: 65319 - RNA, 23 nt, Artificial Sequence
  RNA Oligomer
agauaauaggcaggacauguuag

SEQ ID NO: 65320 - RNA, 23 nt, Artificial Sequence
  RNA Oligomer
gauaauaggcaggacauguuagu

SEQ ID NO: 65321 - RNA, 23 nt, Artificial Sequence
  RNA Oligomer
auaauaggcaggacauguuaguu

SEQ ID NO: 65322 - RNA, 23 nt, Artificial Sequence
  RNA Oligomer
uaauaggcaggacauguuaguua

SEQ ID NO: 65323 - RNA, 23 nt, Artificial Sequence
  RNA Oligomer
guuaagaaauuccuugaauuagc

SEQ ID NO: 65324 - RNA, 23 nt, Artificial Sequence
  RNA Oligomer
cuucaaaauuaaccgcauaaggg

SEQ ID NO: 65325 - RNA, 23 nt, Artificial Sequence
  RNA Oligomer
auuccgaagauccuucuuauucc

SEQ ID NO: 65326 - RNA, 23 nt, Artificial Sequence
  RNA Oligomer
uuccgaagauccuucuuauuccc

SEQ ID NO: 65327 - RNA, 23 nt, Artificial Sequence
  RNA Oligomer
uccgaagauccuucuuauuccca

SEQ ID NO: 65328 - RNA, 23 nt, Artificial Sequence
  RNA Oligomer
ccgaagauccuucuuauucccaa

SEQ ID NO: 65329 - RNA, 23 nt, Artificial Sequence
  RNA Oligomer
cgaagauccuucuuauucccaac

SEQ ID NO: 65330 - RNA, 23 nt, Artificial Sequence
  RNA Oligomer
ccacuuuucugggauguuuucua

SEQ ID NO: 65331 - RNA, 23 nt, Artificial Sequence
  RNA Oligomer
cacuuuucugggauguuuucuaa

SEQ ID NO: 65332 - RNA, 23 nt, Artificial Sequence
  RNA Oligomer
gagcacugugaauuagagccaga

SEQ ID NO: 65333 - RNA, 23 nt, Artificial Sequence
  RNA Oligomer
agcacugugaauuagagccagau

SEQ ID NO: 65334 - RNA, 23 nt, Artificial Sequence
  RNA Oligomer
gcacugugaauuagagccagaug

SEQ ID NO: 65335 - RNA, 23 nt, Artificial Sequence
  RNA Oligomer
gugucuaauugccucaggcguga

SEQ ID NO: 65336 - RNA, 23 nt, Artificial Sequence
  RNA Oligomer
ugucuaauugccucaggcgugaa

SEQ ID NO: 65337 - RNA, 23 nt, Artificial Sequence
  RNA Oligomer
gucuaauugccucaggcgugaaa

SEQ ID NO: 65338 - RNA, 23 nt, Artificial Sequence
  RNA Oligomer
ucuaauugccucaggcgugaaac

SEQ ID NO: 65339 - RNA, 23 nt, Artificial Sequence
  RNA Oligomer
cuaauugccucaggcgugaaacc

SEQ ID NO: 65340 - RNA, 23 nt, Artificial Sequence
  RNA Oligomer
uaucagaaaaagugacaaaacgg

SEQ ID NO: 65341 - RNA, 23 nt, Artificial Sequence
  RNA Oligomer
gcuuuucugguugagcccauuuu

SEQ ID NO: 65342 - RNA, 23 nt, Artificial Sequence
  RNA Oligomer
cuuuucugguugagcccauuuuc

SEQ ID NO: 65343 - RNA, 23 nt, Artificial Sequence
  RNA Oligomer
uuuucugguugagcccauuuuca

SEQ ID NO: 65344 - RNA, 23 nt, Artificial Sequence
  RNA Oligomer
uuucugguugagcccauuuucaa

SEQ ID NO: 65345 - RNA, 23 nt, Artificial Sequence
  RNA Oligomer
uucugguugagcccauuuucaaa

SEQ ID NO: 65346 - RNA, 23 nt, Artificial Sequence
  RNA Oligomer
uguuacggaguaaagcccugaag

SEQ ID NO: 65347 - RNA, 23 nt, Artificial Sequence
  RNA Oligomer
guuacggaguaaagcccugaagu

SEQ ID NO: 65348 - RNA, 23 nt, Artificial Sequence
  RNA Oligomer
agagcagcucucguagccauuuc

SEQ ID NO: 65349 - RNA, 23 nt, Artificial Sequence
  RNA Oligomer
gagcagcucucguagccauuuca

SEQ ID NO: 65350 - RNA, 23 nt, Artificial Sequence
  RNA Oligomer
agcagcucucguagccauuucaa

SEQ ID NO: 65351 - RNA, 23 nt, Artificial Sequence
  RNA Oligomer
gcagcucucguagccauuucaaa

SEQ ID NO: 65352 - RNA, 23 nt, Artificial Sequence
  RNA Oligomer
cagcucucguagccauuucaaaa

SEQ ID NO: 65353 - RNA, 23 nt, Artificial Sequence
  RNA Oligomer
cugccuucuucagguuucaccgg

SEQ ID NO: 65354 - RNA, 23 nt, Artificial Sequence
  RNA Oligomer
ucuucagguuucaccggcuccug

SEQ ID NO: 65355 - RNA, 23 nt, Artificial Sequence
  RNA Oligomer
ucauuccgaagauccuucuuauu

SEQ ID NO: 65356 - RNA, 23 nt, Artificial Sequence
  RNA Oligomer
cauuccgaagauccuucuuauuc

SEQ ID NO: 65357 - RNA, 23 nt, Artificial Sequence
  RNA Oligomer
ugggcacguugggacagaaaugc

SEQ ID NO: 65358 - RNA, 23 nt, Artificial Sequence
  RNA Oligomer
gggcacguugggacagaaaugcu

SEQ ID NO: 65359 - RNA, 23 nt, Artificial Sequence
  RNA Oligomer
ggcacguugggacagaaaugcuu

SEQ ID NO: 65360 - RNA, 23 nt, Artificial Sequence
  RNA Oligomer
gcacguugggacagaaaugcuug

SEQ ID NO: 65361 - RNA, 23 nt, Artificial Sequence
  RNA Oligomer
cacguugggacagaaaugcuuga

SEQ ID NO: 65362 - RNA, 23 nt, Artificial Sequence
  RNA Oligomer
cggguagcugaagaccagaccgu

SEQ ID NO: 65363 - RNA, 23 nt, Artificial Sequence
  RNA Oligomer
ggguagcugaagaccagaccgug

SEQ ID NO: 65364 - RNA, 23 nt, Artificial Sequence
  RNA Oligomer
gguagcugaagaccagaccgugg

SEQ ID NO: 65365 - RNA, 23 nt, Artificial Sequence
  RNA Oligomer
guagcugaagaccagaccgugga

SEQ ID NO: 65366 - RNA, 23 nt, Artificial Sequence
  RNA Oligomer
uagcugaagaccagaccguggac

SEQ ID NO: 65367 - RNA, 23 nt, Artificial Sequence
  RNA Oligomer
uuagagccagaugcuuaagucca

SEQ ID NO: 65368 - RNA, 23 nt, Artificial Sequence
  RNA Oligomer
uagagccagaugcuuaaguccag

SEQ ID NO: 65369 - RNA, 23 nt, Artificial Sequence
  RNA Oligomer
gagccagaugcuuaaguccaggu

SEQ ID NO: 65370 - RNA, 23 nt, Artificial Sequence
  RNA Oligomer
agccagaugcuuaaguccaggug

SEQ ID NO: 65371 - RNA, 23 nt, Artificial Sequence
  RNA Oligomer
gccagaugcuuaaguccagguga

SEQ ID NO: 65372 - RNA, 23 nt, Artificial Sequence
  RNA Oligomer
ccagaugcuuaaguccaggugag

SEQ ID NO: 65373 - RNA, 23 nt, Artificial Sequence
  RNA Oligomer
cagaugcuuaaguccaggugaga

SEQ ID NO: 65374 - RNA, 23 nt, Artificial Sequence
  RNA Oligomer
agaugcuuaaguccaggugagac

SEQ ID NO: 65375 - RNA, 23 nt, Artificial Sequence
  RNA Oligomer
gaugcuuaaguccaggugagaca

SEQ ID NO: 65376 - RNA, 23 nt, Artificial Sequence
  RNA Oligomer
augcuuaaguccaggugagacag

SEQ ID NO: 65377 - RNA, 23 nt, Artificial Sequence
  RNA Oligomer
gcuuaaguccaggugagacaggu

SEQ ID NO: 65378 - RNA, 23 nt, Artificial Sequence
  RNA Oligomer
cuuaaguccaggugagacagguu

SEQ ID NO: 65379 - RNA, 23 nt, Artificial Sequence
  RNA Oligomer
uuaaguccaggugagacagguua

SEQ ID NO: 65380 - RNA, 23 nt, Artificial Sequence
  RNA Oligomer
uaaguccaggugagacagguuau

SEQ ID NO: 65381 - RNA, 23 nt, Artificial Sequence
  RNA Oligomer
aaguccaggugagacagguuaug

SEQ ID NO: 65382 - RNA, 23 nt, Artificial Sequence
  RNA Oligomer
ccaauacacuuucuuugaggaug

SEQ ID NO: 65383 - RNA, 23 nt, Artificial Sequence
  RNA Oligomer
caauacacuuucuuugaggauga

SEQ ID NO: 65384 - RNA, 23 nt, Artificial Sequence
  RNA Oligomer
aauacacuuucuuugaggaugac

SEQ ID NO: 65385 - RNA, 23 nt, Artificial Sequence
  RNA Oligomer
gaacuugggcuuuucugguugag

SEQ ID NO: 65386 - RNA, 23 nt, Artificial Sequence
  RNA Oligomer
aacuugggcuuuucugguugagc

SEQ ID NO: 65387 - RNA, 23 nt, Artificial Sequence
  RNA Oligomer
gccaacaaaaucuguuacggagu

SEQ ID NO: 65388 - RNA, 23 nt, Artificial Sequence
  RNA Oligomer
ccaacaaaaucuguuacggagua

SEQ ID NO: 65389 - RNA, 23 nt, Artificial Sequence
  RNA Oligomer
uuacggaguaaagcccugaagug

SEQ ID NO: 65390 - RNA, 23 nt, Artificial Sequence
  RNA Oligomer
ucucugccuucuucagguuucac

SEQ ID NO: 65391 - RNA, 23 nt, Artificial Sequence
  RNA Oligomer
cucugccuucuucagguuucacc

SEQ ID NO: 65392 - RNA, 23 nt, Artificial Sequence
  RNA Oligomer
ucugccuucuucagguuucaccg

SEQ ID NO: 65393 - RNA, 23 nt, Artificial Sequence
  RNA Oligomer
acguugggacagaaaugcuugac

SEQ ID NO: 65394 - RNA, 23 nt, Artificial Sequence
  RNA Oligomer
cguugggacagaaaugcuugacu

SEQ ID NO: 65395 - RNA, 23 nt, Artificial Sequence
  RNA Oligomer
guugggacagaaaugcuugacuu

SEQ ID NO: 65396 - RNA, 23 nt, Artificial Sequence
  RNA Oligomer
uugggacagaaaugcuugacuuc

SEQ ID NO: 65397 - RNA, 23 nt, Artificial Sequence
  RNA Oligomer
aauuaacugguacagaaaaaaag

SEQ ID NO: 65398 - RNA, 23 nt, Artificial Sequence
  RNA Oligomer
auuaacugguacagaaaaaaagu

SEQ ID NO: 65399 - RNA, 23 nt, Artificial Sequence
  RNA Oligomer
uuaacugguacagaaaaaaaguu

SEQ ID NO: 65400 - RNA, 23 nt, Artificial Sequence
  RNA Oligomer
uaacugguacagaaaaaaaguuu

SEQ ID NO: 65401 - RNA, 23 nt, Artificial Sequence
  RNA Oligomer
aacugguacagaaaaaaaguuua

SEQ ID NO: 65402 - RNA, 23 nt, Artificial Sequence
  RNA Oligomer
ugcuuaaguccaggugagacagg

SEQ ID NO: 65403 - RNA, 23 nt, Artificial Sequence
  RNA Oligomer
aggugagacagguuaugccaucu

SEQ ID NO: 65404 - RNA, 23 nt, Artificial Sequence
  RNA Oligomer
ggugagacagguuaugccaucuu

SEQ ID NO: 65405 - RNA, 23 nt, Artificial Sequence
  RNA Oligomer
aggcgugaaaccaauuccuauuu

SEQ ID NO: 65406 - RNA, 23 nt, Artificial Sequence
  RNA Oligomer
gaguaaagcccugaaguggugac

SEQ ID NO: 65407 - RNA, 23 nt, Artificial Sequence
  RNA Oligomer
aguaaagcccugaaguggugacu

SEQ ID NO: 65408 - RNA, 23 nt, Artificial Sequence
  RNA Oligomer
guaaagcccugaaguggugacuc

SEQ ID NO: 65409 - RNA, 23 nt, Artificial Sequence
  RNA Oligomer
uaaagcccugaaguggugacuca

SEQ ID NO: 65410 - RNA, 23 nt, Artificial Sequence
  RNA Oligomer
aaagcccugaaguggugacucac

SEQ ID NO: 65411 - RNA, 23 nt, Artificial Sequence
  RNA Oligomer
acagauaauaggcaggacauguu

SEQ ID NO: 65412 - RNA, 23 nt, Artificial Sequence
  RNA Oligomer
cagauaauaggcaggacauguua

SEQ ID NO: 65413 - RNA, 23 nt, Artificial Sequence
  RNA Oligomer
ugguagcaagaugacuucugauu

SEQ ID NO: 65414 - RNA, 23 nt, Artificial Sequence
  RNA Oligomer
gguagcaagaugacuucugauuu

SEQ ID NO: 65415 - RNA, 23 nt, Artificial Sequence
  RNA Oligomer
ugucuuuccacaggcuccaucac

SEQ ID NO: 65416 - RNA, 23 nt, Artificial Sequence
  RNA Oligomer
accgcauaagggcugugcuugca

SEQ ID NO: 65417 - RNA, 23 nt, Artificial Sequence
  RNA Oligomer
ccgcauaagggcugugcuugcag

SEQ ID NO: 65418 - RNA, 23 nt, Artificial Sequence
  RNA Oligomer
cgcauaagggcugugcuugcagc

SEQ ID NO: 65419 - RNA, 23 nt, Artificial Sequence
  RNA Oligomer
gcauaagggcugugcuugcagca

SEQ ID NO: 65420 - RNA, 23 nt, Artificial Sequence
  RNA Oligomer
cauaagggcugugcuugcagcaa

SEQ ID NO: 65421 - RNA, 23 nt, Artificial Sequence
  RNA Oligomer
uccaucuuuggucuuugcugaac

SEQ ID NO: 65422 - RNA, 23 nt, Artificial Sequence
  RNA Oligomer
ccaucuuuggucuuugcugaaca

SEQ ID NO: 65423 - RNA, 23 nt, Artificial Sequence
  RNA Oligomer
aucaccaguuucuuccggauggc

SEQ ID NO: 65424 - RNA, 23 nt, Artificial Sequence
  RNA Oligomer
aaacacugugggcacauacaccu

SEQ ID NO: 65425 - RNA, 23 nt, Artificial Sequence
  RNA Oligomer
aacacugugggcacauacaccuc

SEQ ID NO: 65426 - RNA, 23 nt, Artificial Sequence
  RNA Oligomer
acacugugggcacauacaccucu

SEQ ID NO: 65427 - RNA, 23 nt, Artificial Sequence
  RNA Oligomer
cacugugggcacauacaccucug

SEQ ID NO: 65428 - RNA, 23 nt, Artificial Sequence
  RNA Oligomer
acugugggcacauacaccucugg

SEQ ID NO: 65429 - RNA, 23 nt, Artificial Sequence
  RNA Oligomer
gaacuguaacucugccacagcug

SEQ ID NO: 65430 - RNA, 23 nt, Artificial Sequence
  RNA Oligomer
aacuguaacucugccacagcugc

SEQ ID NO: 65431 - RNA, 23 nt, Artificial Sequence
  RNA Oligomer
cagcugcaugaacuugggcuuuu

SEQ ID NO: 65432 - RNA, 23 nt, Artificial Sequence
  RNA Oligomer
agcugcaugaacuugggcuuuuc

SEQ ID NO: 65433 - RNA, 23 nt, Artificial Sequence
  RNA Oligomer
ggaguaaagcccugaagugguga

SEQ ID NO: 65434 - RNA, 23 nt, Artificial Sequence
  RNA Oligomer
cucuuucuagaaagaagcaagaa

SEQ ID NO: 65435 - RNA, 23 nt, Artificial Sequence
  RNA Oligomer
ucuuucuagaaagaagcaagaag

SEQ ID NO: 65436 - RNA, 23 nt, Artificial Sequence
  RNA Oligomer
cuuucuagaaagaagcaagaagu

SEQ ID NO: 65437 - RNA, 23 nt, Artificial Sequence
  RNA Oligomer
uuucuagaaagaagcaagaaguu

SEQ ID NO: 65438 - RNA, 23 nt, Artificial Sequence
  RNA Oligomer
auaagggcugugcuugcagcaag

SEQ ID NO: 65439 - RNA, 23 nt, Artificial Sequence
  RNA Oligomer
aaaaguuuagucagcuggagaga

SEQ ID NO: 65440 - RNA, 23 nt, Artificial Sequence
  RNA Oligomer
aaaguuuagucagcuggagagaa

SEQ ID NO: 65441 - RNA, 23 nt, Artificial Sequence
  RNA Oligomer
aguuuagucagcuggagagaaga

SEQ ID NO: 65442 - RNA, 23 nt, Artificial Sequence
  RNA Oligomer
gacaguauuaggaaauccaauua

SEQ ID NO: 65443 - RNA, 23 nt, Artificial Sequence
  RNA Oligomer
ucaccaguuucuuccggauggca

SEQ ID NO: 65444 - RNA, 23 nt, Artificial Sequence
  RNA Oligomer
caccaguuucuuccggauggcag

SEQ ID NO: 65445 - RNA, 23 nt, Artificial Sequence
  RNA Oligomer
accaguuucuuccggauggcagc

SEQ ID NO: 65446 - RNA, 23 nt, Artificial Sequence
  RNA Oligomer
auacacuuucuuugaggaugaca

SEQ ID NO: 65447 - RNA, 23 nt, Artificial Sequence
  RNA Oligomer
aagcccugaaguggugacucacc

SEQ ID NO: 65448 - RNA, 23 nt, Artificial Sequence
  RNA Oligomer
ggugacucaccagaguaccuugc

SEQ ID NO: 65449 - RNA, 23 nt, Artificial Sequence
  RNA Oligomer
gugacucaccagaguaccuugca

SEQ ID NO: 65450 - RNA, 23 nt, Artificial Sequence
  RNA Oligomer
agcucucguagccauuucaaaaa

SEQ ID NO: 65451 - RNA, 23 nt, Artificial Sequence
  RNA Oligomer
ccuucuuauucccaaccaggaug

SEQ ID NO: 65452 - RNA, 23 nt, Artificial Sequence
  RNA Oligomer
gcugucgauggaaaaacacauca

SEQ ID NO: 65453 - RNA, 23 nt, Artificial Sequence
  RNA Oligomer
cugucgauggaaaaacacaucag

SEQ ID NO: 65454 - RNA, 23 nt, Artificial Sequence
  RNA Oligomer
ugucgauggaaaaacacaucagu

SEQ ID NO: 65455 - RNA, 23 nt, Artificial Sequence
  RNA Oligomer
gucgauggaaaaacacaucagua

SEQ ID NO: 65456 - RNA, 23 nt, Artificial Sequence
  RNA Oligomer
ucgauggaaaaacacaucaguau

SEQ ID NO: 65457 - RNA, 23 nt, Artificial Sequence
  RNA Oligomer
caucgguaucuggguaggagagg

SEQ ID NO: 65458 - RNA, 23 nt, Artificial Sequence
  RNA Oligomer
aucgguaucuggguaggagaggg

SEQ ID NO: 65459 - RNA, 23 nt, Artificial Sequence
  RNA Oligomer
agagccagaugcuuaaguccagg

SEQ ID NO: 65460 - RNA, 23 nt, Artificial Sequence
  RNA Oligomer
uuaucagaaaaagugacaaaacg

SEQ ID NO: 65461 - RNA, 23 nt, Artificial Sequence
  RNA Oligomer
uacggaguaaagcccugaagugg

SEQ ID NO: 65462 - RNA, 23 nt, Artificial Sequence
  RNA Oligomer
acggaguaaagcccugaaguggu

SEQ ID NO: 65463 - RNA, 23 nt, Artificial Sequence
  RNA Oligomer
cggaguaaagcccugaaguggug

SEQ ID NO: 65464 - RNA, 23 nt, Artificial Sequence
  RNA Oligomer
ccugaaguggugacucaccagag

SEQ ID NO: 65465 - RNA, 23 nt, Artificial Sequence
  RNA Oligomer
cugaaguggugacucaccagagu

SEQ ID NO: 65466 - RNA, 23 nt, Artificial Sequence
  RNA Oligomer
ugaaguggugacucaccagagua

SEQ ID NO: 65467 - RNA, 23 nt, Artificial Sequence
  RNA Oligomer
gaaguggugacucaccagaguac

SEQ ID NO: 65468 - RNA, 23 nt, Artificial Sequence
  RNA Oligomer
aaguggugacucaccagaguacc

SEQ ID NO: 65469 - RNA, 23 nt, Artificial Sequence
  RNA Oligomer
gcuugcagagcagcucucguagc

SEQ ID NO: 65470 - RNA, 23 nt, Artificial Sequence
  RNA Oligomer
cuugcagagcagcucucguagcc

SEQ ID NO: 65471 - RNA, 23 nt, Artificial Sequence
  RNA Oligomer
uugcagagcagcucucguagcca

SEQ ID NO: 65472 - RNA, 23 nt, Artificial Sequence
  RNA Oligomer
ucucaaacacugugggcacauac

SEQ ID NO: 65473 - RNA, 23 nt, Artificial Sequence
  RNA Oligomer
cucaaacacugugggcacauaca

SEQ ID NO: 65474 - RNA, 23 nt, Artificial Sequence
  RNA Oligomer
ucaaacacugugggcacauacac

SEQ ID NO: 65475 - RNA, 23 nt, Artificial Sequence
  RNA Oligomer
caaacacugugggcacauacacc

SEQ ID NO: 65476 - RNA, 23 nt, Artificial Sequence
  RNA Oligomer
cuugaauuagcgccugguguguc

SEQ ID NO: 65477 - RNA, 23 nt, Artificial Sequence
  RNA Oligomer
cugugggcacauacaccucuggg

SEQ ID NO: 65478 - RNA, 23 nt, Artificial Sequence
  RNA Oligomer
ugugggcacauacaccucuggga

SEQ ID NO: 65479 - RNA, 23 nt, Artificial Sequence
  RNA Oligomer
ccuugaauuagcgccuggugugu

SEQ ID NO: 65480 - RNA, 23 nt, Artificial Sequence
  RNA Oligomer
cuccugcuucaucuuggcuagcu

SEQ ID NO: 65481 - RNA, 23 nt, Artificial Sequence
  RNA Oligomer
uccugcuucaucuuggcuagcuc

SEQ ID NO: 65482 - RNA, 23 nt, Artificial Sequence
  RNA Oligomer
ggcugucgauggaaaaacacauc

SEQ ID NO: 65483 - RNA, 23 nt, Artificial Sequence
  RNA Oligomer
guuuagucagcuggagagaagag

SEQ ID NO: 65484 - RNA, 23 nt, Artificial Sequence
  RNA Oligomer
uuuagucagcuggagagaagaga

SEQ ID NO: 65485 - RNA, 23 nt, Artificial Sequence
  RNA Oligomer
uuagucagcuggagagaagagag

SEQ ID NO: 65486 - RNA, 23 nt, Artificial Sequence
  RNA Oligomer
aguggugacucaccagaguaccu

SEQ ID NO: 65487 - RNA, 23 nt, Artificial Sequence
  RNA Oligomer
guggugacucaccagaguaccuu

SEQ ID NO: 65488 - RNA, 23 nt, Artificial Sequence
  RNA Oligomer
uggugacucaccagaguaccuug

SEQ ID NO: 65489 - RNA, 23 nt, Artificial Sequence
  RNA Oligomer
caccagaguaccuugcagcugac

SEQ ID NO: 65490 - RNA, 23 nt, Artificial Sequence
  RNA Oligomer
accagaguaccuugcagcugaca

SEQ ID NO: 65491 - RNA, 23 nt, Artificial Sequence
  RNA Oligomer
ccagaguaccuugcagcugacag

SEQ ID NO: 65492 - RNA, 23 nt, Artificial Sequence
  RNA Oligomer
cagaguaccuugcagcugacaga

SEQ ID NO: 65493 - RNA, 23 nt, Artificial Sequence
  RNA Oligomer
acuugggcuuuucugguugagcc

SEQ ID NO: 65494 - RNA, 23 nt, Artificial Sequence
  RNA Oligomer
agcccugaaguggugacucacca

SEQ ID NO: 65495 - RNA, 23 nt, Artificial Sequence
  RNA Oligomer
gcccugaaguggugacucaccag

SEQ ID NO: 65496 - RNA, 23 nt, Artificial Sequence
  RNA Oligomer
cccugaaguggugacucaccaga

SEQ ID NO: 65497 - RNA, 23 nt, Artificial Sequence
  RNA Oligomer
uccacuuuucugggauguuuucu

SEQ ID NO: 65498 - RNA, 23 nt, Artificial Sequence
  RNA Oligomer
cuugggcuuuucugguugagccc

SEQ ID NO: 65499 - RNA, 23 nt, Artificial Sequence
  RNA Oligomer
uugggcuuuucugguugagccca

SEQ ID NO: 65500 - RNA, 23 nt, Artificial Sequence
  RNA Oligomer
aacucugccacagcugcaugaac

SEQ ID NO: 65501 - RNA, 23 nt, Artificial Sequence
  RNA Oligomer
gacaucguuaauaaucauaguug

SEQ ID NO: 65502 - RNA, 23 nt, Artificial Sequence
  RNA Oligomer
aauccuguuugccauaucucugc

SEQ ID NO: 65503 - RNA, 23 nt, Artificial Sequence
  RNA Oligomer
ucugacuuuauuuccaaauacac

SEQ ID NO: 65504 - RNA, 23 nt, Artificial Sequence
  RNA Oligomer
uucuucccacgucuagcuugcag

SEQ ID NO: 65505 - RNA, 23 nt, Artificial Sequence
  RNA Oligomer
auacauuaaguggcacuaauuac

SEQ ID NO: 65506 - RNA, 23 nt, Artificial Sequence
  RNA Oligomer
cuaauuacacaguaacuauaagg

SEQ ID NO: 65507 - RNA, 23 nt, Artificial Sequence
  RNA Oligomer
auccuguuugccauaucucugcc

SEQ ID NO: 65508 - RNA, 23 nt, Artificial Sequence
  RNA Oligomer
gccuuuauucuauuaguaguugg

SEQ ID NO: 65509 - RNA, 23 nt, Artificial Sequence
  RNA Oligomer
ugguacagaaaaaaaguuuaguc

SEQ ID NO: 65510 - RNA, 23 nt, Artificial Sequence
  RNA Oligomer
uaacauacauuaaguggcacuaa

SEQ ID NO: 65511 - RNA, 23 nt, Artificial Sequence
  RNA Oligomer
cucucguagccauuucaaaaacc

SEQ ID NO: 65512 - RNA, 23 nt, Artificial Sequence
  RNA Oligomer
ugccuuuauucuauuaguaguug

SEQ ID NO: 65513 - RNA, 23 nt, Artificial Sequence
  RNA Oligomer
guacagaaaaaaaguuuagucag

SEQ ID NO: 65514 - RNA, 23 nt, Artificial Sequence
  RNA Oligomer
uuugccauaucucugccuucuuc

SEQ ID NO: 65515 - RNA, 23 nt, Artificial Sequence
  RNA Oligomer
gguacagaaaaaaaguuuaguca

SEQ ID NO: 65516 - RNA, 23 nt, Artificial Sequence
  RNA Oligomer
uccuguuugccauaucucugccu

SEQ ID NO: 65517 - RNA, 23 nt, Artificial Sequence
  RNA Oligomer
cuguuugccauaucucugccuuc

SEQ ID NO: 65518 - RNA, 23 nt, Artificial Sequence
  RNA Oligomer
uguuugccauaucucugccuucu

SEQ ID NO: 65519 - RNA, 23 nt, Artificial Sequence
  RNA Oligomer
cagggcugucgauggaaaaacac

SEQ ID NO: 65520 - RNA, 23 nt, Artificial Sequence
  RNA Oligomer
uggaaaaacacaucaguauaaca

SEQ ID NO: 65521 - RNA, 23 nt, Artificial Sequence
  RNA Oligomer
uaauugccucaggcgugaaacca

SEQ ID NO: 65522 - RNA, 23 nt, Artificial Sequence
  RNA Oligomer
agaagcaagaaguuaagaaauuc

SEQ ID NO: 65523 - RNA, 23 nt, Artificial Sequence
  RNA Oligomer
ugccauaucucugccuucuucag

SEQ ID NO: 65524 - RNA, 23 nt, Artificial Sequence
  RNA Oligomer
uuucaccggcuccugcuucaucu

SEQ ID NO: 65525 - RNA, 23 nt, Artificial Sequence
  RNA Oligomer
aaccacagaacuguaacucugcc

SEQ ID NO: 65526 - RNA, 23 nt, Artificial Sequence
  RNA Oligomer
caucaccaacaaucaccaguuuc

SEQ ID NO: 65527 - RNA, 23 nt, Artificial Sequence
  RNA Oligomer
uagucagcuggagagaagagaga

SEQ ID NO: 65528 - RNA, 23 nt, Artificial Sequence
  RNA Oligomer
gacuaugagcaagcaugucuuuc

SEQ ID NO: 65529 - RNA, 23 nt, Artificial Sequence
  RNA Oligomer
uaucucugccuucuucagguuuc

SEQ ID NO: 65530 - RNA, 23 nt, Artificial Sequence
  RNA Oligomer
auuaaguggcacuaauuacacag

SEQ ID NO: 65531 - RNA, 23 nt, Artificial Sequence
  RNA Oligomer
uugagcccauuuucaaaaaacug

SEQ ID NO: 65532 - RNA, 23 nt, Artificial Sequence
  RNA Oligomer
uuaaguggcacuaauuacacagu

SEQ ID NO: 65533 - RNA, 23 nt, Artificial Sequence
  RNA Oligomer
aaaccacagaacuguaacucugc

SEQ ID NO: 65534 - RNA, 23 nt, Artificial Sequence
  RNA Oligomer
uuucuuccggauggcagccauug

SEQ ID NO: 65535 - RNA, 23 nt, Artificial Sequence
  RNA Oligomer
uaaguggcacuaauuacacagua

SEQ ID NO: 65536 - RNA, 23 nt, Artificial Sequence
  RNA Oligomer
aaguggcacuaauuacacaguaa

SEQ ID NO: 65537 - RNA, 23 nt, Artificial Sequence
  RNA Oligomer
ugcuugcagcaagguuucacaag

SEQ ID NO: 65538 - RNA, 23 nt, Artificial Sequence
  RNA Oligomer
auaucucugccuucuucagguuu

SEQ ID NO: 65539 - RNA, 23 nt, Artificial Sequence
  RNA Oligomer
aucucugccuucuucagguuuca

SEQ ID NO: 65540 - RNA, 23 nt, Artificial Sequence
  RNA Oligomer
aaagugacaaaacgggaauuuaa

SEQ ID NO: 65541 - RNA, 23 nt, Artificial Sequence
  RNA Oligomer
ugaagacuaugagcaagcauguc

SEQ ID NO: 65542 - RNA, 23 nt, Artificial Sequence
  RNA Oligomer
uucuagaaagaagcaagaaguua

SEQ ID NO: 65543 - RNA, 23 nt, Artificial Sequence
  RNA Oligomer
acuucaaaauuaaccgcauaagg

SEQ ID NO: 65544 - RNA, 23 nt, Artificial Sequence
  RNA Oligomer
caggcuccaucaccaacaaucac

SEQ ID NO: 65545 - RNA, 23 nt, Artificial Sequence
  RNA Oligomer
caucuuuuaucagaaaaagugac

SEQ ID NO: 65546 - RNA, 23 nt, Artificial Sequence
  RNA Oligomer
acugguacagaaaaaaaguuuag

SEQ ID NO: 65547 - RNA, 23 nt, Artificial Sequence
  RNA Oligomer
cauuaaguggcacuaauuacaca

SEQ ID NO: 65548 - RNA, 23 nt, Artificial Sequence
  RNA Oligomer
guccuugcugaagacuaugagca

SEQ ID NO: 65549 - RNA, 23 nt, Artificial Sequence
  RNA Oligomer
uugcugaagacuaugagcaagca

SEQ ID NO: 65550 - RNA, 23 nt, Artificial Sequence
  RNA Oligomer
aagccaacucuaccugcuuucca

SEQ ID NO: 65551 - RNA, 23 nt, Artificial Sequence
  RNA Oligomer
uuuacuuagcccagcuccauggg

SEQ ID NO: 65552 - RNA, 23 nt, Artificial Sequence
  RNA Oligomer
acauuaaguggcacuaauuacac

SEQ ID NO: 65553 - RNA, 23 nt, Artificial Sequence
  RNA Oligomer
caguaacuauaagguaacuaaca

SEQ ID NO: 65554 - RNA, 23 nt, Artificial Sequence
  RNA Oligomer
cugguccuugcugaagacuauga

SEQ ID NO: 65555 - RNA, 23 nt, Artificial Sequence
  RNA Oligomer
ccuugcagcugacagauaauagg

SEQ ID NO: 65556 - RNA, 23 nt, Artificial Sequence
  RNA Oligomer
uuuccacaggcuccaucaccaac

SEQ ID NO: 65557 - RNA, 23 nt, Artificial Sequence
  RNA Oligomer
ucugccacagcugcaugaacuug

SEQ ID NO: 65558 - RNA, 23 nt, Artificial Sequence
  RNA Oligomer
guccacuuuucugggauguuuuc

SEQ ID NO: 65559 - RNA, 23 nt, Artificial Sequence
  RNA Oligomer
aagaccagaccguggacuaacga

SEQ ID NO: 65560 - RNA, 23 nt, Artificial Sequence
  RNA Oligomer
ccuuuauucuauuaguaguugga

SEQ ID NO: 65561 - RNA, 23 nt, Artificial Sequence
  RNA Oligomer
cuuuauucuauuaguaguuggaa

SEQ ID NO: 65562 - RNA, 23 nt, Artificial Sequence
  RNA Oligomer
uuuauucuauuaguaguuggaaa

SEQ ID NO: 65563 - RNA, 23 nt, Artificial Sequence
  RNA Oligomer
uuauucuauuaguaguuggaaaa

SEQ ID NO: 65564 - RNA, 23 nt, Artificial Sequence
  RNA Oligomer
aaauuauagauaaaugaaaaagg

SEQ ID NO: 65565 - RNA, 23 nt, Artificial Sequence
  RNA Oligomer
aauuauagauaaaugaaaaaggc

SEQ ID NO: 65566 - RNA, 23 nt, Artificial Sequence
  RNA Oligomer
ucuuuuuuaaaaaaccaauacac

SEQ ID NO: 65567 - RNA, 23 nt, Artificial Sequence
  RNA Oligomer
cuuuuuuaaaaaaccaauacacu

SEQ ID NO: 65568 - RNA, 23 nt, Artificial Sequence
  RNA Oligomer
uuuuuuaaaaaaccaauacacuu

SEQ ID NO: 65569 - RNA, 23 nt, Artificial Sequence
  RNA Oligomer
uuuuuaaaaaaccaauacacuuu

SEQ ID NO: 65570 - RNA, 23 nt, Artificial Sequence
  RNA Oligomer
uuuuaaaaaaccaauacacuuuc

SEQ ID NO: 65571 - RNA, 23 nt, Artificial Sequence
  RNA Oligomer
auuuaaaaaaugaauuuuccauc

SEQ ID NO: 65572 - RNA, 23 nt, Artificial Sequence
  RNA Oligomer
uuaaaaaaugaauuuuccaucug

SEQ ID NO: 65573 - RNA, 23 nt, Artificial Sequence
  RNA Oligomer
uaaaaaaugaauuuuccaucuga

SEQ ID NO: 65574 - RNA, 23 nt, Artificial Sequence
  RNA Oligomer
uuaguaguuggaaaaauuaacug

SEQ ID NO: 65575 - RNA, 23 nt, Artificial Sequence
  RNA Oligomer
cacaacuaauuucacccaagguu

SEQ ID NO: 65576 - RNA, 23 nt, Artificial Sequence
  RNA Oligomer
ccacaacuaauuucacccaaggu

SEQ ID NO: 65577 - RNA, 23 nt, Artificial Sequence
  RNA Oligomer
accacaacuaauuucacccaagg

SEQ ID NO: 65578 - RNA, 23 nt, Artificial Sequence
  RNA Oligomer
caccacaacuaauuucacccaag

SEQ ID NO: 65579 - RNA, 23 nt, Artificial Sequence
  RNA Oligomer
acaccacaacuaauuucacccaa

SEQ ID NO: 65580 - RNA, 23 nt, Artificial Sequence
  RNA Oligomer
aacaccacaacuaauuucaccca

SEQ ID NO: 65581 - RNA, 23 nt, Artificial Sequence
  RNA Oligomer
acaacuaauuucacccaagguuu

SEQ ID NO: 65582 - RNA, 23 nt, Artificial Sequence
  RNA Oligomer
ccaagguuuuaagcacguucuuu

SEQ ID NO: 65583 - RNA, 23 nt, Artificial Sequence
  RNA Oligomer
cccaagguuuuaagcacguucuu

SEQ ID NO: 65584 - RNA, 23 nt, Artificial Sequence
  RNA Oligomer
acccaagguuuuaagcacguucu

SEQ ID NO: 65585 - RNA, 23 nt, Artificial Sequence
  RNA Oligomer
cacccaagguuuuaagcacguuc

SEQ ID NO: 65586 - RNA, 23 nt, Artificial Sequence
  RNA Oligomer
ucacccaagguuuuaagcacguu

SEQ ID NO: 65587 - RNA, 23 nt, Artificial Sequence
  RNA Oligomer
ccagacuucagaaacaaaucuca

SEQ ID NO: 65588 - RNA, 23 nt, Artificial Sequence
  RNA Oligomer
uccagacuucagaaacaaaucuc

SEQ ID NO: 65589 - RNA, 23 nt, Artificial Sequence
  RNA Oligomer
uuccagacuucagaaacaaaucu

SEQ ID NO: 65590 - RNA, 23 nt, Artificial Sequence
  RNA Oligomer
cuuccagacuucagaaacaaauc

SEQ ID NO: 65591 - RNA, 23 nt, Artificial Sequence
  RNA Oligomer
gcuuccagacuucagaaacaaau

SEQ ID NO: 65592 - RNA, 23 nt, Artificial Sequence
  RNA Oligomer
gcaucucuuucauguucuccuac

SEQ ID NO: 65593 - RNA, 23 nt, Artificial Sequence
  RNA Oligomer
agcaucucuuucauguucuccua

SEQ ID NO: 65594 - RNA, 23 nt, Artificial Sequence
  RNA Oligomer
cagcaucucuuucauguucuccu

SEQ ID NO: 65595 - RNA, 23 nt, Artificial Sequence
  RNA Oligomer
ccagcaucucuuucauguucucc

SEQ ID NO: 65596 - RNA, 23 nt, Artificial Sequence
  RNA Oligomer
gccagcaucucuuucauguucuc

SEQ ID NO: 65597 - RNA, 23 nt, Artificial Sequence
  RNA Oligomer
ggaccacuaugcuguacaucugu

SEQ ID NO: 65598 - RNA, 23 nt, Artificial Sequence
  RNA Oligomer
aggaccacuaugcuguacaucug

SEQ ID NO: 65599 - RNA, 23 nt, Artificial Sequence
  RNA Oligomer
caggaccacuaugcuguacaucu

SEQ ID NO: 65600 - RNA, 23 nt, Artificial Sequence
  RNA Oligomer
ucaggaccacuaugcuguacauc

SEQ ID NO: 65601 - RNA, 23 nt, Artificial Sequence
  RNA Oligomer
cucaggaccacuaugcuguacau

SEQ ID NO: 65602 - RNA, 23 nt, Artificial Sequence
  RNA Oligomer
ccauuuugggacauucuaauccc

SEQ ID NO: 65603 - RNA, 23 nt, Artificial Sequence
  RNA Oligomer
uccauuuugggacauucuaaucc

SEQ ID NO: 65604 - RNA, 23 nt, Artificial Sequence
  RNA Oligomer
cuccauuuugggacauucuaauc

SEQ ID NO: 65605 - RNA, 23 nt, Artificial Sequence
  RNA Oligomer
ucuccauuuugggacauucuaau

SEQ ID NO: 65606 - RNA, 23 nt, Artificial Sequence
  RNA Oligomer
gucuccauuuugggacauucuaa

SEQ ID NO: 65607 - RNA, 23 nt, Artificial Sequence
  RNA Oligomer
gggucaucaaucggaacucaagu

SEQ ID NO: 65608 - RNA, 23 nt, Artificial Sequence
  RNA Oligomer
ggggucaucaaucggaacucaag

SEQ ID NO: 65609 - RNA, 23 nt, Artificial Sequence
  RNA Oligomer
gggggucaucaaucggaacucaa

SEQ ID NO: 65610 - RNA, 23 nt, Artificial Sequence
  RNA Oligomer
agggggucaucaaucggaacuca

SEQ ID NO: 65611 - RNA, 23 nt, Artificial Sequence
  RNA Oligomer
cagggggucaucaaucggaacuc

SEQ ID NO: 65612 - RNA, 23 nt, Artificial Sequence
  RNA Oligomer
gcaucuuagaacccucccuacuc

SEQ ID NO: 65613 - RNA, 23 nt, Artificial Sequence
  RNA Oligomer
ggcaucuuagaacccucccuacu

SEQ ID NO: 65614 - RNA, 23 nt, Artificial Sequence
  RNA Oligomer
uggcaucuuagaacccucccuac

SEQ ID NO: 65615 - RNA, 23 nt, Artificial Sequence
  RNA Oligomer
cuggcaucuuagaacccucccua

SEQ ID NO: 65616 - RNA, 23 nt, Artificial Sequence
  RNA Oligomer
gcuggcaucuuagaacccucccu

SEQ ID NO: 65617 - RNA, 23 nt, Artificial Sequence
  RNA Oligomer
cccuauuauuuucaucaugggcu

SEQ ID NO: 65618 - RNA, 23 nt, Artificial Sequence
  RNA Oligomer
ccccuauuauuuucaucaugggc

SEQ ID NO: 65619 - RNA, 23 nt, Artificial Sequence
  RNA Oligomer
gccccuauuauuuucaucauggg

SEQ ID NO: 65620 - RNA, 23 nt, Artificial Sequence
  RNA Oligomer
agccccuauuauuuucaucaugg

SEQ ID NO: 65621 - RNA, 23 nt, Artificial Sequence
  RNA Oligomer
gagccccuauuauuuucaucaug

SEQ ID NO: 65622 - RNA, 23 nt, Artificial Sequence
  RNA Oligomer
gcagauccgugugguagauggca

SEQ ID NO: 65623 - RNA, 23 nt, Artificial Sequence
  RNA Oligomer
ggcagauccgugugguagauggc

SEQ ID NO: 65624 - RNA, 23 nt, Artificial Sequence
  RNA Oligomer
gggcagauccgugugguagaugg

SEQ ID NO: 65625 - RNA, 23 nt, Artificial Sequence
  RNA Oligomer
cgggcagauccgugugguagaug

SEQ ID NO: 65626 - RNA, 23 nt, Artificial Sequence
  RNA Oligomer
ccgggcagauccgugugguagau

SEQ ID NO: 65627 - RNA, 23 nt, Artificial Sequence
  RNA Oligomer
ugaacaauuugugcggcuacggg

SEQ ID NO: 65628 - RNA, 23 nt, Artificial Sequence
  RNA Oligomer
uugaacaauuugugcggcuacgg

SEQ ID NO: 65629 - RNA, 23 nt, Artificial Sequence
  RNA Oligomer
cuugaacaauuugugcggcuacg

SEQ ID NO: 65630 - RNA, 23 nt, Artificial Sequence
  RNA Oligomer
ccuugaacaauuugugcggcuac

SEQ ID NO: 65631 - RNA, 23 nt, Artificial Sequence
  RNA Oligomer
uccuugaacaauuugugcggcua

SEQ ID NO: 65632 - RNA, 23 nt, Artificial Sequence
  RNA Oligomer
ggucaucaaucggaacucaagug

SEQ ID NO: 65633 - RNA, 23 nt, Artificial Sequence
  RNA Oligomer
uucacccaagguuuuaagcacgu

SEQ ID NO: 65634 - RNA, 23 nt, Artificial Sequence
  RNA Oligomer
caacuaauuucacccaagguuuu

SEQ ID NO: 65635 - RNA, 23 nt, Artificial Sequence
  RNA Oligomer
gcaagccauuuacagaaacccac

SEQ ID NO: 65636 - RNA, 23 nt, Artificial Sequence
  RNA Oligomer
ggcaagccauuuacagaaaccca

SEQ ID NO: 65637 - RNA, 23 nt, Artificial Sequence
  RNA Oligomer
uggcaagccauuuacagaaaccc

SEQ ID NO: 65638 - RNA, 23 nt, Artificial Sequence
  RNA Oligomer
auggcaagccauuuacagaaacc

SEQ ID NO: 65639 - RNA, 23 nt, Artificial Sequence
  RNA Oligomer
cauggcaagccauuuacagaaac

SEQ ID NO: 65640 - RNA, 23 nt, Artificial Sequence
  RNA Oligomer
gcagccagcaucucuuucauguu

SEQ ID NO: 65641 - RNA, 23 nt, Artificial Sequence
  RNA Oligomer
agcagccagcaucucuuucaugu

SEQ ID NO: 65642 - RNA, 23 nt, Artificial Sequence
  RNA Oligomer
cagcagccagcaucucuuucaug

SEQ ID NO: 65643 - RNA, 23 nt, Artificial Sequence
  RNA Oligomer
acagcagccagcaucucuuucau

SEQ ID NO: 65644 - RNA, 23 nt, Artificial Sequence
  RNA Oligomer
cacagcagccagcaucucuuuca

SEQ ID NO: 65645 - RNA, 23 nt, Artificial Sequence
  RNA Oligomer
gcaccgagagaaguuccaacgca

SEQ ID NO: 65646 - RNA, 23 nt, Artificial Sequence
  RNA Oligomer
cgcaccgagagaaguuccaacgc

SEQ ID NO: 65647 - RNA, 23 nt, Artificial Sequence
  RNA Oligomer
gcgcaccgagagaaguuccaacg

SEQ ID NO: 65648 - RNA, 23 nt, Artificial Sequence
  RNA Oligomer
ggcgcaccgagagaaguuccaac

SEQ ID NO: 65649 - RNA, 23 nt, Artificial Sequence
  RNA Oligomer
aggcgcaccgagagaaguuccaa

SEQ ID NO: 65650 - RNA, 23 nt, Artificial Sequence
  RNA Oligomer
gccuuauguuccgcauguacgac

SEQ ID NO: 65651 - RNA, 23 nt, Artificial Sequence
  RNA Oligomer
cgccuuauguuccgcauguacga

SEQ ID NO: 65652 - RNA, 23 nt, Artificial Sequence
  RNA Oligomer
ucgccuuauguuccgcauguacg

SEQ ID NO: 65653 - RNA, 23 nt, Artificial Sequence
  RNA Oligomer
cucgccuuauguuccgcauguac

SEQ ID NO: 65654 - RNA, 23 nt, Artificial Sequence
  RNA Oligomer
ucucgccuuauguuccgcaugua

SEQ ID NO: 65655 - RNA, 23 nt, Artificial Sequence
  RNA Oligomer
ccaaugucuuugucuggcauaaa

SEQ ID NO: 65656 - RNA, 23 nt, Artificial Sequence
  RNA Oligomer
cccaaugucuuugucuggcauaa

SEQ ID NO: 65657 - RNA, 23 nt, Artificial Sequence
  RNA Oligomer
gcccaaugucuuugucuggcaua

SEQ ID NO: 65658 - RNA, 23 nt, Artificial Sequence
  RNA Oligomer
agcccaaugucuuugucuggcau

SEQ ID NO: 65659 - RNA, 23 nt, Artificial Sequence
  RNA Oligomer
cagcccaaugucuuugucuggca

SEQ ID NO: 65660 - RNA, 23 nt, Artificial Sequence
  RNA Oligomer
ccggagcaaugacacuguacugg

SEQ ID NO: 65661 - RNA, 23 nt, Artificial Sequence
  RNA Oligomer
cccggagcaaugacacuguacug

SEQ ID NO: 65662 - RNA, 23 nt, Artificial Sequence
  RNA Oligomer
ucccggagcaaugacacuguacu

SEQ ID NO: 65663 - RNA, 23 nt, Artificial Sequence
  RNA Oligomer
cucccggagcaaugacacuguac

SEQ ID NO: 65664 - RNA, 23 nt, Artificial Sequence
  RNA Oligomer
ucucccggagcaaugacacugua

SEQ ID NO: 65665 - RNA, 23 nt, Artificial Sequence
  RNA Oligomer
gucaucaaucggaacucaagugu

SEQ ID NO: 65666 - RNA, 23 nt, Artificial Sequence
  RNA Oligomer
cgagaccuuagcaacaccaucuc

SEQ ID NO: 65667 - RNA, 23 nt, Artificial Sequence
  RNA Oligomer
ccgagaccuuagcaacaccaucu

SEQ ID NO: 65668 - RNA, 23 nt, Artificial Sequence
  RNA Oligomer
cccgagaccuuagcaacaccauc

SEQ ID NO: 65669 - RNA, 23 nt, Artificial Sequence
  RNA Oligomer
ccccgagaccuuagcaacaccau

SEQ ID NO: 65670 - RNA, 23 nt, Artificial Sequence
  RNA Oligomer
cccccgagaccuuagcaacacca

SEQ ID NO: 65671 - RNA, 23 nt, Artificial Sequence
  RNA Oligomer
cccagucuaacaccacaacuaau

SEQ ID NO: 65672 - RNA, 23 nt, Artificial Sequence
  RNA Oligomer
ccccagucuaacaccacaacuaa

SEQ ID NO: 65673 - RNA, 23 nt, Artificial Sequence
  RNA Oligomer
accccagucuaacaccacaacua

SEQ ID NO: 65674 - RNA, 23 nt, Artificial Sequence
  RNA Oligomer
caccccagucuaacaccacaacu

SEQ ID NO: 65675 - RNA, 23 nt, Artificial Sequence
  RNA Oligomer
gcaccccagucuaacaccacaac

SEQ ID NO: 65676 - RNA, 23 nt, Artificial Sequence
  RNA Oligomer
accauuaugagaacuucuaggcc

SEQ ID NO: 65677 - RNA, 23 nt, Artificial Sequence
  RNA Oligomer
caccauuaugagaacuucuaggc

SEQ ID NO: 65678 - RNA, 23 nt, Artificial Sequence
  RNA Oligomer
ccaccauuaugagaacuucuagg

SEQ ID NO: 65679 - RNA, 23 nt, Artificial Sequence
  RNA Oligomer
cccaccauuaugagaacuucuag

SEQ ID NO: 65680 - RNA, 23 nt, Artificial Sequence
  RNA Oligomer
ucccaccauuaugagaacuucua

SEQ ID NO: 65681 - RNA, 23 nt, Artificial Sequence
  RNA Oligomer
guaccuugauggaccauuuggag

SEQ ID NO: 65682 - RNA, 23 nt, Artificial Sequence
  RNA Oligomer
uguaccuugauggaccauuugga

SEQ ID NO: 65683 - RNA, 23 nt, Artificial Sequence
  RNA Oligomer
cuguaccuugauggaccauuugg

SEQ ID NO: 65684 - RNA, 23 nt, Artificial Sequence
  RNA Oligomer
gcuguaccuugauggaccauuug

SEQ ID NO: 65685 - RNA, 23 nt, Artificial Sequence
  RNA Oligomer
agcuguaccuugauggaccauuu

SEQ ID NO: 65686 - RNA, 23 nt, Artificial Sequence
  RNA Oligomer
cguccucucuugccucuuuccug

SEQ ID NO: 65687 - RNA, 23 nt, Artificial Sequence
  RNA Oligomer
gcguccucucuugccucuuuccu

SEQ ID NO: 65688 - RNA, 23 nt, Artificial Sequence
  RNA Oligomer
agcguccucucuugccucuuucc

SEQ ID NO: 65689 - RNA, 23 nt, Artificial Sequence
  RNA Oligomer
cagcguccucucuugccucuuuc

SEQ ID NO: 65690 - RNA, 23 nt, Artificial Sequence
  RNA Oligomer
ucagcguccucucuugccucuuu

SEQ ID NO: 65691 - RNA, 23 nt, Artificial Sequence
  RNA Oligomer
ccaucguccucacagucuuacac

SEQ ID NO: 65692 - RNA, 23 nt, Artificial Sequence
  RNA Oligomer
gccaucguccucacagucuuaca

SEQ ID NO: 65693 - RNA, 23 nt, Artificial Sequence
  RNA Oligomer
cgccaucguccucacagucuuac

SEQ ID NO: 65694 - RNA, 23 nt, Artificial Sequence
  RNA Oligomer
ccgccaucguccucacagucuua

SEQ ID NO: 65695 - RNA, 23 nt, Artificial Sequence
  RNA Oligomer
accgccaucguccucacagucuu

SEQ ID NO: 65696 - RNA, 23 nt, Artificial Sequence
  RNA Oligomer
ucucuuucauguucuccuacauc

SEQ ID NO: 65697 - RNA, 23 nt, Artificial Sequence
  RNA Oligomer
aucucuuucauguucuccuacau

SEQ ID NO: 65698 - RNA, 23 nt, Artificial Sequence
  RNA Oligomer
caucucuuucauguucuccuaca

SEQ ID NO: 65699 - RNA, 23 nt, Artificial Sequence
  RNA Oligomer
agccagcaucucuuucauguucu

SEQ ID NO: 65700 - RNA, 23 nt, Artificial Sequence
  RNA Oligomer
cagccagcaucucuuucauguuc

SEQ ID NO: 65701 - RNA, 23 nt, Artificial Sequence
  RNA Oligomer
gcaagaagguaacgucauuccag

SEQ ID NO: 65702 - RNA, 23 nt, Artificial Sequence
  RNA Oligomer
ggcaagaagguaacgucauucca

SEQ ID NO: 65703 - RNA, 23 nt, Artificial Sequence
  RNA Oligomer
uggcaagaagguaacgucauucc

SEQ ID NO: 65704 - RNA, 23 nt, Artificial Sequence
  RNA Oligomer
uuggcaagaagguaacgucauuc

SEQ ID NO: 65705 - RNA, 23 nt, Artificial Sequence
  RNA Oligomer
uuuggcaagaagguaacgucauu

SEQ ID NO: 65706 - RNA, 23 nt, Artificial Sequence
  RNA Oligomer
ggaaaagucucgccuuauguucc

SEQ ID NO: 65707 - RNA, 23 nt, Artificial Sequence
  RNA Oligomer
aggaaaagucucgccuuauguuc

SEQ ID NO: 65708 - RNA, 23 nt, Artificial Sequence
  RNA Oligomer
gaggaaaagucucgccuuauguu

SEQ ID NO: 65709 - RNA, 23 nt, Artificial Sequence
  RNA Oligomer
ugaggaaaagucucgccuuaugu

SEQ ID NO: 65710 - RNA, 23 nt, Artificial Sequence
  RNA Oligomer
cugaggaaaagucucgccuuaug

SEQ ID NO: 65711 - RNA, 23 nt, Artificial Sequence
  RNA Oligomer
cccucuguugcuucccuuuggug

SEQ ID NO: 65712 - RNA, 23 nt, Artificial Sequence
  RNA Oligomer
acccucuguugcuucccuuuggu

SEQ ID NO: 65713 - RNA, 23 nt, Artificial Sequence
  RNA Oligomer
gacccucuguugcuucccuuugg

SEQ ID NO: 65714 - RNA, 23 nt, Artificial Sequence
  RNA Oligomer
ggacccucuguugcuucccuuug

SEQ ID NO: 65715 - RNA, 23 nt, Artificial Sequence
  RNA Oligomer
gggacccucuguugcuucccuuu

SEQ ID NO: 65716 - RNA, 23 nt, Artificial Sequence
  RNA Oligomer
cgggacccucuguugcuucccuu

SEQ ID NO: 65717 - RNA, 23 nt, Artificial Sequence
  RNA Oligomer
gcagcccaaugucuuugucuggc

SEQ ID NO: 65718 - RNA, 23 nt, Artificial Sequence
  RNA Oligomer
ugcagcccaaugucuuugucugg

SEQ ID NO: 65719 - RNA, 23 nt, Artificial Sequence
  RNA Oligomer
cugcagcccaaugucuuugucug

SEQ ID NO: 65720 - RNA, 23 nt, Artificial Sequence
  RNA Oligomer
ucugcagcccaaugucuuugucu

SEQ ID NO: 65721 - RNA, 23 nt, Artificial Sequence
  RNA Oligomer
cucugcagcccaaugucuuuguc

SEQ ID NO: 65722 - RNA, 23 nt, Artificial Sequence
  RNA Oligomer
agaaggagauugaagaaauccga

SEQ ID NO: 65723 - RNA, 23 nt, Artificial Sequence
  RNA Oligomer
aagaaggagauugaagaaauccg

SEQ ID NO: 65724 - RNA, 23 nt, Artificial Sequence
  RNA Oligomer
caagaaggagauugaagaaaucc

SEQ ID NO: 65725 - RNA, 23 nt, Artificial Sequence
  RNA Oligomer
ccaagaaggagauugaagaaauc

SEQ ID NO: 65726 - RNA, 23 nt, Artificial Sequence
  RNA Oligomer
uccaagaaggagauugaagaaau

SEQ ID NO: 65727 - RNA, 23 nt, Artificial Sequence
  RNA Oligomer
cucccaccauuaugagaacuucu

SEQ ID NO: 65728 - RNA, 23 nt, Artificial Sequence
  RNA Oligomer
ucucccaccauuaugagaacuuc

SEQ ID NO: 65729 - RNA, 23 nt, Artificial Sequence
  RNA Oligomer
gccaaguguucuguaagaagauc

SEQ ID NO: 65730 - RNA, 23 nt, Artificial Sequence
  RNA Oligomer
ugccaaguguucuguaagaagau

SEQ ID NO: 65731 - RNA, 23 nt, Artificial Sequence
  RNA Oligomer
cugccaaguguucuguaagaaga

SEQ ID NO: 65732 - RNA, 23 nt, Artificial Sequence
  RNA Oligomer
gcugccaaguguucuguaagaag

SEQ ID NO: 65733 - RNA, 23 nt, Artificial Sequence
  RNA Oligomer
agcugccaaguguucuguaagaa

SEQ ID NO: 65734 - RNA, 23 nt, Artificial Sequence
  RNA Oligomer
gcauaaguuugaggugucagugu

SEQ ID NO: 65735 - RNA, 23 nt, Artificial Sequence
  RNA Oligomer
ggcauaaguuugaggugucagug

SEQ ID NO: 65736 - RNA, 23 nt, Artificial Sequence
  RNA Oligomer
uggcauaaguuugaggugucagu

SEQ ID NO: 65737 - RNA, 23 nt, Artificial Sequence
  RNA Oligomer
guggcauaaguuugaggugucag

SEQ ID NO: 65738 - RNA, 23 nt, Artificial Sequence
  RNA Oligomer
aguggcauaaguuugagguguca

SEQ ID NO: 65739 - RNA, 23 nt, Artificial Sequence
  RNA Oligomer
gaguggcauaaguuugagguguc

SEQ ID NO: 65740 - RNA, 23 nt, Artificial Sequence
  RNA Oligomer
ggaguggcauaaguuugaggugu

SEQ ID NO: 65741 - RNA, 23 nt, Artificial Sequence
  RNA Oligomer
aggaguggcauaaguuugaggug

SEQ ID NO: 65742 - RNA, 23 nt, Artificial Sequence
  RNA Oligomer
caggaguggcauaaguuugaggu

SEQ ID NO: 65743 - RNA, 23 nt, Artificial Sequence
  RNA Oligomer
ccaggaguggcauaaguuugagg

SEQ ID NO: 65744 - RNA, 23 nt, Artificial Sequence
  RNA Oligomer
accaggaguggcauaaguuugag

SEQ ID NO: 65745 - RNA, 23 nt, Artificial Sequence
  RNA Oligomer
ggccaucauguaugucuuugccu

SEQ ID NO: 65746 - RNA, 23 nt, Artificial Sequence
  RNA Oligomer
uggccaucauguaugucuuugcc

SEQ ID NO: 65747 - RNA, 23 nt, Artificial Sequence
  RNA Oligomer
cuggccaucauguaugucuuugc

SEQ ID NO: 65748 - RNA, 23 nt, Artificial Sequence
  RNA Oligomer
ccuggccaucauguaugucuuug

SEQ ID NO: 65749 - RNA, 23 nt, Artificial Sequence
  RNA Oligomer
uccuggccaucauguaugucuuu

SEQ ID NO: 65750 - RNA, 23 nt, Artificial Sequence
  RNA Oligomer
agaaguauuacuggugguucuuc

SEQ ID NO: 65751 - RNA, 23 nt, Artificial Sequence
  RNA Oligomer
cagaaguauuacuggugguucuu

SEQ ID NO: 65752 - RNA, 23 nt, Artificial Sequence
  RNA Oligomer
ccagaaguauuacuggugguucu

SEQ ID NO: 65753 - RNA, 23 nt, Artificial Sequence
  RNA Oligomer
cccagaaguauuacuggugguuc

SEQ ID NO: 65754 - RNA, 23 nt, Artificial Sequence
  RNA Oligomer
ccccagaaguauuacuggugguu

SEQ ID NO: 65755 - RNA, 23 nt, Artificial Sequence
  RNA Oligomer
aaaccuuccucaaccgcuacgug

SEQ ID NO: 65756 - RNA, 23 nt, Artificial Sequence
  RNA Oligomer
gaaaccuuccucaaccgcuacgu

SEQ ID NO: 65757 - RNA, 23 nt, Artificial Sequence
  RNA Oligomer
agaaaccuuccucaaccgcuacg

SEQ ID NO: 65758 - RNA, 23 nt, Artificial Sequence
  RNA Oligomer
gagaaaccuuccucaaccgcuac

SEQ ID NO: 65759 - RNA, 23 nt, Artificial Sequence
  RNA Oligomer
cgagaaaccuuccucaaccgcua

SEQ ID NO: 65760 - RNA, 23 nt, Artificial Sequence
  RNA Oligomer
agcgagaggaccauguguugguu

SEQ ID NO: 65761 - RNA, 23 nt, Artificial Sequence
  RNA Oligomer
gagcgagaggaccauguguuggu

SEQ ID NO: 65762 - RNA, 23 nt, Artificial Sequence
  RNA Oligomer
agagcgagaggaccauguguugg

SEQ ID NO: 65763 - RNA, 23 nt, Artificial Sequence
  RNA Oligomer
cagagcgagaggaccauguguug

SEQ ID NO: 65764 - RNA, 23 nt, Artificial Sequence
  RNA Oligomer
gcagagcgagaggaccauguguu

SEQ ID NO: 65765 - RNA, 23 nt, Artificial Sequence
  RNA Oligomer
agguuuuaagcacguucuuucau

SEQ ID NO: 65766 - RNA, 23 nt, Artificial Sequence
  RNA Oligomer
aagguuuuaagcacguucuuuca

SEQ ID NO: 65767 - RNA, 23 nt, Artificial Sequence
  RNA Oligomer
caagguuuuaagcacguucuuuc

SEQ ID NO: 65768 - RNA, 23 nt, Artificial Sequence
  RNA Oligomer
cuaacaccacaacuaauuucacc

SEQ ID NO: 65769 - RNA, 23 nt, Artificial Sequence
  RNA Oligomer
ucuaacaccacaacuaauuucac

SEQ ID NO: 65770 - RNA, 23 nt, Artificial Sequence
  RNA Oligomer
gucuaacaccacaacuaauuuca

SEQ ID NO: 65771 - RNA, 23 nt, Artificial Sequence
  RNA Oligomer
agucuaacaccacaacuaauuuc

SEQ ID NO: 65772 - RNA, 23 nt, Artificial Sequence
  RNA Oligomer
cagucuaacaccacaacuaauuu

SEQ ID NO: 65773 - RNA, 23 nt, Artificial Sequence
  RNA Oligomer
ccagucuaacaccacaacuaauu

SEQ ID NO: 65774 - RNA, 23 nt, Artificial Sequence
  RNA Oligomer
gcaugucuguauguguguugggg

SEQ ID NO: 65775 - RNA, 23 nt, Artificial Sequence
  RNA Oligomer
ugcaugucuguauguguguuggg

SEQ ID NO: 65776 - RNA, 23 nt, Artificial Sequence
  RNA Oligomer
gugcaugucuguauguguguugg

SEQ ID NO: 65777 - RNA, 23 nt, Artificial Sequence
  RNA Oligomer
ugugcaugucuguauguguguug

SEQ ID NO: 65778 - RNA, 23 nt, Artificial Sequence
  RNA Oligomer
gugugcaugucuguauguguguu

SEQ ID NO: 65779 - RNA, 23 nt, Artificial Sequence
  RNA Oligomer
ggacuagagugagaaguagggga

SEQ ID NO: 65780 - RNA, 23 nt, Artificial Sequence
  RNA Oligomer
gggacuagagugagaaguagggg

SEQ ID NO: 65781 - RNA, 23 nt, Artificial Sequence
  RNA Oligomer
agggacuagagugagaaguaggg

SEQ ID NO: 65782 - RNA, 23 nt, Artificial Sequence
  RNA Oligomer
uagggacuagagugagaaguagg

SEQ ID NO: 65783 - RNA, 23 nt, Artificial Sequence
  RNA Oligomer
cuagggacuagagugagaaguag

SEQ ID NO: 65784 - RNA, 23 nt, Artificial Sequence
  RNA Oligomer
ccucuguucuuccuauuucuggc

SEQ ID NO: 65785 - RNA, 23 nt, Artificial Sequence
  RNA Oligomer
accucuguucuuccuauuucugg

SEQ ID NO: 65786 - RNA, 23 nt, Artificial Sequence
  RNA Oligomer
caccucuguucuuccuauuucug

SEQ ID NO: 65787 - RNA, 23 nt, Artificial Sequence
  RNA Oligomer
ucaccucuguucuuccuauuucu

SEQ ID NO: 65788 - RNA, 23 nt, Artificial Sequence
  RNA Oligomer
cucaccucuguucuuccuauuuc

SEQ ID NO: 65789 - RNA, 23 nt, Artificial Sequence
  RNA Oligomer
ggucccagcaaucaucuaugggg

SEQ ID NO: 65790 - RNA, 23 nt, Artificial Sequence
  RNA Oligomer
uggucccagcaaucaucuauggg

SEQ ID NO: 65791 - RNA, 23 nt, Artificial Sequence
  RNA Oligomer
cuggucccagcaaucaucuaugg

SEQ ID NO: 65792 - RNA, 23 nt, Artificial Sequence
  RNA Oligomer
ccuggucccagcaaucaucuaug

SEQ ID NO: 65793 - RNA, 23 nt, Artificial Sequence
  RNA Oligomer
uccuggucccagcaaucaucuau

SEQ ID NO: 65794 - RNA, 23 nt, Artificial Sequence
  RNA Oligomer
guaugucuuugccucccaccacu

SEQ ID NO: 65795 - RNA, 23 nt, Artificial Sequence
  RNA Oligomer
uguaugucuuugccucccaccac

SEQ ID NO: 65796 - RNA, 23 nt, Artificial Sequence
  RNA Oligomer
auguaugucuuugccucccacca

SEQ ID NO: 65797 - RNA, 23 nt, Artificial Sequence
  RNA Oligomer
cauguaugucuuugccucccacc

SEQ ID NO: 65798 - RNA, 23 nt, Artificial Sequence
  RNA Oligomer
ucauguaugucuuugccucccac

SEQ ID NO: 65799 - RNA, 23 nt, Artificial Sequence
  RNA Oligomer
cauuuugggacauucuaaucccu

SEQ ID NO: 65800 - RNA, 23 nt, Artificial Sequence
  RNA Oligomer
gagagaaguuccaacgcagcugu

SEQ ID NO: 65801 - RNA, 23 nt, Artificial Sequence
  RNA Oligomer
cgagagaaguuccaacgcagcug

SEQ ID NO: 65802 - RNA, 23 nt, Artificial Sequence
  RNA Oligomer
ccgagagaaguuccaacgcagcu

SEQ ID NO: 65803 - RNA, 23 nt, Artificial Sequence
  RNA Oligomer
accgagagaaguuccaacgcagc

SEQ ID NO: 65804 - RNA, 23 nt, Artificial Sequence
  RNA Oligomer
caccgagagaaguuccaacgcag

SEQ ID NO: 65805 - RNA, 23 nt, Artificial Sequence
  RNA Oligomer
gcgacauugagacugaguugaca

SEQ ID NO: 65806 - RNA, 23 nt, Artificial Sequence
  RNA Oligomer
agcgacauugagacugaguugac

SEQ ID NO: 65807 - RNA, 23 nt, Artificial Sequence
  RNA Oligomer
cagcgacauugagacugaguuga

SEQ ID NO: 65808 - RNA, 23 nt, Artificial Sequence
  RNA Oligomer
gcagcgacauugagacugaguug

SEQ ID NO: 65809 - RNA, 23 nt, Artificial Sequence
  RNA Oligomer
cgcagcgacauugagacugaguu

SEQ ID NO: 65810 - RNA, 23 nt, Artificial Sequence
  RNA Oligomer
ggauaugaucugucccucuccca

SEQ ID NO: 65811 - RNA, 23 nt, Artificial Sequence
  RNA Oligomer
aggauaugaucugucccucuccc

SEQ ID NO: 65812 - RNA, 23 nt, Artificial Sequence
  RNA Oligomer
caggauaugaucugucccucucc

SEQ ID NO: 65813 - RNA, 23 nt, Artificial Sequence
  RNA Oligomer
ccaggauaugaucugucccucuc

SEQ ID NO: 65814 - RNA, 23 nt, Artificial Sequence
  RNA Oligomer
gccaggauaugaucugucccucu

SEQ ID NO: 65815 - RNA, 23 nt, Artificial Sequence
  RNA Oligomer
ccuucaucgagaucuccaacaac

SEQ ID NO: 65816 - RNA, 23 nt, Artificial Sequence
  RNA Oligomer
uccuucaucgagaucuccaacaa

SEQ ID NO: 65817 - RNA, 23 nt, Artificial Sequence
  RNA Oligomer
auccuucaucgagaucuccaaca

SEQ ID NO: 65818 - RNA, 23 nt, Artificial Sequence
  RNA Oligomer
gauccuucaucgagaucuccaac

SEQ ID NO: 65819 - RNA, 23 nt, Artificial Sequence
  RNA Oligomer
agauccuucaucgagaucuccaa

SEQ ID NO: 65820 - RNA, 23 nt, Artificial Sequence
  RNA Oligomer
agagcaucgugucugagaagcuc

SEQ ID NO: 65821 - RNA, 23 nt, Artificial Sequence
  RNA Oligomer
cagagcaucgugucugagaagcu

SEQ ID NO: 65822 - RNA, 23 nt, Artificial Sequence
  RNA Oligomer
ccagagcaucgugucugagaagc

SEQ ID NO: 65823 - RNA, 23 nt, Artificial Sequence
  RNA Oligomer
gccagagcaucgugucugagaag

SEQ ID NO: 65824 - RNA, 23 nt, Artificial Sequence
  RNA Oligomer
cgccagagcaucgugucugagaa

SEQ ID NO: 65825 - RNA, 23 nt, Artificial Sequence
  RNA Oligomer
caaugucuuugucuggcauaaag

SEQ ID NO: 65826 - RNA, 23 nt, Artificial Sequence
  RNA Oligomer
caucuaugguuccucgcauuccu

SEQ ID NO: 65827 - RNA, 23 nt, Artificial Sequence
  RNA Oligomer
ccaucuaugguuccucgcauucc

SEQ ID NO: 65828 - RNA, 23 nt, Artificial Sequence
  RNA Oligomer
gccaucuaugguuccucgcauuc

SEQ ID NO: 65829 - RNA, 23 nt, Artificial Sequence
  RNA Oligomer
cgccaucuaugguuccucgcauu

SEQ ID NO: 65830 - RNA, 23 nt, Artificial Sequence
  RNA Oligomer
gcgccaucuaugguuccucgcau

SEQ ID NO: 65831 - RNA, 23 nt, Artificial Sequence
  RNA Oligomer
gguuuuaagcacguucuuucauc

SEQ ID NO: 65832 - RNA, 23 nt, Artificial Sequence
  RNA Oligomer
ucuagggacuagagugagaagua

SEQ ID NO: 65833 - RNA, 23 nt, Artificial Sequence
  RNA Oligomer
ccucaccucuguucuuccuauuu

SEQ ID NO: 65834 - RNA, 23 nt, Artificial Sequence
  RNA Oligomer
accucaccucuguucuuccuauu

SEQ ID NO: 65835 - RNA, 23 nt, Artificial Sequence
  RNA Oligomer
ggagucuauucacaggccugcgc

SEQ ID NO: 65836 - RNA, 23 nt, Artificial Sequence
  RNA Oligomer
cggagucuauucacaggccugcg

SEQ ID NO: 65837 - RNA, 23 nt, Artificial Sequence
  RNA Oligomer
ccggagucuauucacaggccugc

SEQ ID NO: 65838 - RNA, 23 nt, Artificial Sequence
  RNA Oligomer
accggagucuauucacaggccug

SEQ ID NO: 65839 - RNA, 23 nt, Artificial Sequence
  RNA Oligomer
aaccggagucuauucacaggccu

SEQ ID NO: 65840 - RNA, 23 nt, Artificial Sequence
  RNA Oligomer
ggcuuugaguacaagucagggca

SEQ ID NO: 65841 - RNA, 23 nt, Artificial Sequence
  RNA Oligomer
gggcuuugaguacaagucagggc

SEQ ID NO: 65842 - RNA, 23 nt, Artificial Sequence
  RNA Oligomer
agggcuuugaguacaagucaggg

SEQ ID NO: 65843 - RNA, 23 nt, Artificial Sequence
  RNA Oligomer
cagggcuuugaguacaagucagg

SEQ ID NO: 65844 - RNA, 23 nt, Artificial Sequence
  RNA Oligomer
ccagggcuuugaguacaagucag

SEQ ID NO: 65845 - RNA, 23 nt, Artificial Sequence
  RNA Oligomer
gccaucauguaugucuuugccuc

SEQ ID NO: 65846 - RNA, 23 nt, Artificial Sequence
  RNA Oligomer
ccuacaucuugcucaccaugugc

SEQ ID NO: 65847 - RNA, 23 nt, Artificial Sequence
  RNA Oligomer
uccuacaucuugcucaccaugug

SEQ ID NO: 65848 - RNA, 23 nt, Artificial Sequence
  RNA Oligomer
cuccuacaucuugcucaccaugu

SEQ ID NO: 65849 - RNA, 23 nt, Artificial Sequence
  RNA Oligomer
ucuccuacaucuugcucaccaug

SEQ ID NO: 65850 - RNA, 23 nt, Artificial Sequence
  RNA Oligomer
uucuccuacaucuugcucaccau

SEQ ID NO: 65851 - RNA, 23 nt, Artificial Sequence
  RNA Oligomer
agacggugcaacaguucaagcgc

SEQ ID NO: 65852 - RNA, 23 nt, Artificial Sequence
  RNA Oligomer
cagacggugcaacaguucaagcg

SEQ ID NO: 65853 - RNA, 23 nt, Artificial Sequence
  RNA Oligomer
ccagacggugcaacaguucaagc

SEQ ID NO: 65854 - RNA, 23 nt, Artificial Sequence
  RNA Oligomer
accagacggugcaacaguucaag

SEQ ID NO: 65855 - RNA, 23 nt, Artificial Sequence
  RNA Oligomer
caccagacggugcaacaguucaa

SEQ ID NO: 65856 - RNA, 23 nt, Artificial Sequence
  RNA Oligomer
acauguuuguggaguccauguuc

SEQ ID NO: 65857 - RNA, 23 nt, Artificial Sequence
  RNA Oligomer
gacauguuuguggaguccauguu

SEQ ID NO: 65858 - RNA, 23 nt, Artificial Sequence
  RNA Oligomer
ggacauguuuguggaguccaugu

SEQ ID NO: 65859 - RNA, 23 nt, Artificial Sequence
  RNA Oligomer
aggacauguuuguggaguccaug

SEQ ID NO: 65860 - RNA, 23 nt, Artificial Sequence
  RNA Oligomer
caggacauguuuguggaguccau

SEQ ID NO: 65861 - RNA, 23 nt, Artificial Sequence
  RNA Oligomer
ggaugagaaauuucaagaggcuc

SEQ ID NO: 65862 - RNA, 23 nt, Artificial Sequence
  RNA Oligomer
cggaugagaaauuucaagaggcu

SEQ ID NO: 65863 - RNA, 23 nt, Artificial Sequence
  RNA Oligomer
ccggaugagaaauuucaagaggc

SEQ ID NO: 65864 - RNA, 23 nt, Artificial Sequence
  RNA Oligomer
uccggaugagaaauuucaagagg

SEQ ID NO: 65865 - RNA, 23 nt, Artificial Sequence
  RNA Oligomer
cuccggaugagaaauuucaagag

SEQ ID NO: 65866 - RNA, 23 nt, Artificial Sequence
  RNA Oligomer
gucuuugucuggcauaaaggaga

SEQ ID NO: 65867 - RNA, 23 nt, Artificial Sequence
  RNA Oligomer
ugucuuugucuggcauaaaggag

SEQ ID NO: 65868 - RNA, 23 nt, Artificial Sequence
  RNA Oligomer
augucuuugucuggcauaaagga

SEQ ID NO: 65869 - RNA, 23 nt, Artificial Sequence
  RNA Oligomer
aaugucuuugucuggcauaaagg

SEQ ID NO: 65870 - RNA, 23 nt, Artificial Sequence
  RNA Oligomer
gcuacugguuugagaacaccagg

SEQ ID NO: 65871 - RNA, 23 nt, Artificial Sequence
  RNA Oligomer
cgcuacugguuugagaacaccag

SEQ ID NO: 65872 - RNA, 23 nt, Artificial Sequence
  RNA Oligomer
ccgcuacugguuugagaacacca

SEQ ID NO: 65873 - RNA, 23 nt, Artificial Sequence
  RNA Oligomer
accgcuacugguuugagaacacc

SEQ ID NO: 65874 - RNA, 23 nt, Artificial Sequence
  RNA Oligomer
gaccgcuacugguuugagaacac

SEQ ID NO: 65875 - RNA, 23 nt, Artificial Sequence
  RNA Oligomer
ggagcaaugacacuguacuggag

SEQ ID NO: 65876 - RNA, 23 nt, Artificial Sequence
  RNA Oligomer
cggagcaaugacacuguacugga

SEQ ID NO: 65877 - RNA, 23 nt, Artificial Sequence
  RNA Oligomer
ccuacaaagugcugaagaugugg

SEQ ID NO: 65878 - RNA, 23 nt, Artificial Sequence
  RNA Oligomer
gccuacaaagugcugaagaugug

SEQ ID NO: 65879 - RNA, 23 nt, Artificial Sequence
  RNA Oligomer
agccuacaaagugcugaagaugu

SEQ ID NO: 65880 - RNA, 23 nt, Artificial Sequence
  RNA Oligomer
aagccuacaaagugcugaagaug

SEQ ID NO: 65881 - RNA, 23 nt, Artificial Sequence
  RNA Oligomer
caagccuacaaagugcugaagau

SEQ ID NO: 65882 - RNA, 23 nt, Artificial Sequence
  RNA Oligomer
aucuaugguuccucgcauuccug

SEQ ID NO: 65883 - RNA, 23 nt, Artificial Sequence
  RNA Oligomer
caccucaccucuguucuuccuau

SEQ ID NO: 65884 - RNA, 23 nt, Artificial Sequence
  RNA Oligomer
ccauuaugagaacuucuaggccc

SEQ ID NO: 65885 - RNA, 23 nt, Artificial Sequence
  RNA Oligomer
caccaggaguggcauaaguuuga

SEQ ID NO: 65886 - RNA, 23 nt, Artificial Sequence
  RNA Oligomer
ccaucauguaugucuuugccucc

SEQ ID NO: 65887 - RNA, 23 nt, Artificial Sequence
  RNA Oligomer
auccuggccaucauguaugucuu

SEQ ID NO: 65888 - RNA, 23 nt, Artificial Sequence
  RNA Oligomer
guccucucuugccucuuuccugg

SEQ ID NO: 65889 - RNA, 23 nt, Artificial Sequence
  RNA Oligomer
acaguucaagcgcuucauugaga

SEQ ID NO: 65890 - RNA, 23 nt, Artificial Sequence
  RNA Oligomer
aacaguucaagcgcuucauugag

SEQ ID NO: 65891 - RNA, 23 nt, Artificial Sequence
  RNA Oligomer
caacaguucaagcgcuucauuga

SEQ ID NO: 65892 - RNA, 23 nt, Artificial Sequence
  RNA Oligomer
gcaacaguucaagcgcuucauug

SEQ ID NO: 65893 - RNA, 23 nt, Artificial Sequence
  RNA Oligomer
ugcaacaguucaagcgcuucauu

SEQ ID NO: 65894 - RNA, 23 nt, Artificial Sequence
  RNA Oligomer
guacgacuuugaugggaauggcc

SEQ ID NO: 65895 - RNA, 23 nt, Artificial Sequence
  RNA Oligomer
uguacgacuuugaugggaauggc

SEQ ID NO: 65896 - RNA, 23 nt, Artificial Sequence
  RNA Oligomer
auguacgacuuugaugggaaugg

SEQ ID NO: 65897 - RNA, 23 nt, Artificial Sequence
  RNA Oligomer
cauguacgacuuugaugggaaug

SEQ ID NO: 65898 - RNA, 23 nt, Artificial Sequence
  RNA Oligomer
gcauguacgacuuugaugggaau

SEQ ID NO: 65899 - RNA, 23 nt, Artificial Sequence
  RNA Oligomer
accuggugcugcuguuuaacuug

SEQ ID NO: 65900 - RNA, 23 nt, Artificial Sequence
  RNA Oligomer
gaccuggugcugcuguuuaacuu

SEQ ID NO: 65901 - RNA, 23 nt, Artificial Sequence
  RNA Oligomer
ugaccuggugcugcuguuuaacu

SEQ ID NO: 65902 - RNA, 23 nt, Artificial Sequence
  RNA Oligomer
augaccuggugcugcuguuuaac

SEQ ID NO: 65903 - RNA, 23 nt, Artificial Sequence
  RNA Oligomer
uaugaccuggugcugcuguuuaa

SEQ ID NO: 65904 - RNA, 23 nt, Artificial Sequence
  RNA Oligomer
ggaagcuuuggaauggcaaggcc

SEQ ID NO: 65905 - RNA, 23 nt, Artificial Sequence
  RNA Oligomer
uggaagcuuuggaauggcaaggc

SEQ ID NO: 65906 - RNA, 23 nt, Artificial Sequence
  RNA Oligomer
auggaagcuuuggaauggcaagg

SEQ ID NO: 65907 - RNA, 23 nt, Artificial Sequence
  RNA Oligomer
cauggaagcuuuggaauggcaag

SEQ ID NO: 65908 - RNA, 23 nt, Artificial Sequence
  RNA Oligomer
gcauggaagcuuuggaauggcaa

SEQ ID NO: 65909 - RNA, 23 nt, Artificial Sequence
  RNA Oligomer
gcuccggaugagaaauuucaaga

SEQ ID NO: 65910 - RNA, 23 nt, Artificial Sequence
  RNA Oligomer
ggcuccggaugagaaauuucaag

SEQ ID NO: 65911 - RNA, 23 nt, Artificial Sequence
  RNA Oligomer
uguuguucgugacuauuuugagg

SEQ ID NO: 65912 - RNA, 23 nt, Artificial Sequence
  RNA Oligomer
cuguuguucgugacuauuuugag

SEQ ID NO: 65913 - RNA, 23 nt, Artificial Sequence
  RNA Oligomer
ucuguuguucgugacuauuuuga

SEQ ID NO: 65914 - RNA, 23 nt, Artificial Sequence
  RNA Oligomer
cucuguuguucgugacuauuuug

SEQ ID NO: 65915 - RNA, 23 nt, Artificial Sequence
  RNA Oligomer
ccucuguuguucgugacuauuuu

SEQ ID NO: 65916 - RNA, 23 nt, Artificial Sequence
  RNA Oligomer
cccucuguuguucgugacuauuu

SEQ ID NO: 65917 - RNA, 23 nt, Artificial Sequence
  RNA Oligomer
ucccucuguuguucgugacuauu

SEQ ID NO: 65918 - RNA, 23 nt, Artificial Sequence
  RNA Oligomer
cucccucuguuguucgugacuau

SEQ ID NO: 65919 - RNA, 23 nt, Artificial Sequence
  RNA Oligomer
gcucccucuguuguucgugacua

SEQ ID NO: 65920 - RNA, 23 nt, Artificial Sequence
  RNA Oligomer
gauugaagaaauccgaaauacca

SEQ ID NO: 65921 - RNA, 23 nt, Artificial Sequence
  RNA Oligomer
agauugaagaaauccgaaauacc

SEQ ID NO: 65922 - RNA, 23 nt, Artificial Sequence
  RNA Oligomer
gagauugaagaaauccgaaauac

SEQ ID NO: 65923 - RNA, 23 nt, Artificial Sequence
  RNA Oligomer
ggagauugaagaaauccgaaaua

SEQ ID NO: 65924 - RNA, 23 nt, Artificial Sequence
  RNA Oligomer
aggagauugaagaaauccgaaau

SEQ ID NO: 65925 - RNA, 23 nt, Artificial Sequence
  RNA Oligomer
gaacaauuugugcggcuacggga

SEQ ID NO: 65926 - RNA, 23 nt, Artificial Sequence
  RNA Oligomer
ggcgucuacaugagaaaugccag

SEQ ID NO: 65927 - RNA, 23 nt, Artificial Sequence
  RNA Oligomer
uggcgucuacaugagaaaugcca

SEQ ID NO: 65928 - RNA, 23 nt, Artificial Sequence
  RNA Oligomer
cuggcgucuacaugagaaaugcc

SEQ ID NO: 65929 - RNA, 23 nt, Artificial Sequence
  RNA Oligomer
ccuggcgucuacaugagaaaugc

SEQ ID NO: 65930 - RNA, 23 nt, Artificial Sequence
  RNA Oligomer
cccuggcgucuacaugagaaaug

SEQ ID NO: 65931 - RNA, 23 nt, Artificial Sequence
  RNA Oligomer
ccccuggcgucuacaugagaaau

SEQ ID NO: 65932 - RNA, 23 nt, Artificial Sequence
  RNA Oligomer
cccccuggcgucuacaugagaaa

SEQ ID NO: 65933 - RNA, 23 nt, Artificial Sequence
  RNA Oligomer
gcccccuggcgucuacaugagaa

SEQ ID NO: 65934 - RNA, 23 nt, Artificial Sequence
  RNA Oligomer
gggucuucuuuggcuaucacgug

SEQ ID NO: 65935 - RNA, 23 nt, Artificial Sequence
  RNA Oligomer
ggggucuucuuuggcuaucacgu

SEQ ID NO: 65936 - RNA, 23 nt, Artificial Sequence
  RNA Oligomer
gggggucuucuuuggcuaucacg

SEQ ID NO: 65937 - RNA, 23 nt, Artificial Sequence
  RNA Oligomer
ugggggucuucuuuggcuaucac

SEQ ID NO: 65938 - RNA, 23 nt, Artificial Sequence
  RNA Oligomer
uugggggucuucuuuggcuauca

SEQ ID NO: 65939 - RNA, 23 nt, Artificial Sequence
  RNA Oligomer
gucucccuuccaaauaaaucacu

SEQ ID NO: 65940 - RNA, 23 nt, Artificial Sequence
  RNA Oligomer
agucucccuuccaaauaaaucac

SEQ ID NO: 65941 - RNA, 23 nt, Artificial Sequence
  RNA Oligomer
uagucucccuuccaaauaaauca

SEQ ID NO: 65942 - RNA, 23 nt, Artificial Sequence
  RNA Oligomer
guagucucccuuccaaauaaauc

SEQ ID NO: 65943 - RNA, 23 nt, Artificial Sequence
  RNA Oligomer
aguagucucccuuccaaauaaau

SEQ ID NO: 65944 - RNA, 23 nt, Artificial Sequence
  RNA Oligomer
accuauguaugcaaugcuccuca

SEQ ID NO: 65945 - RNA, 23 nt, Artificial Sequence
  RNA Oligomer
uaccuauguaugcaaugcuccuc

SEQ ID NO: 65946 - RNA, 23 nt, Artificial Sequence
  RNA Oligomer
auaccuauguaugcaaugcuccu

SEQ ID NO: 65947 - RNA, 23 nt, Artificial Sequence
  RNA Oligomer
aauaccuauguaugcaaugcucc

SEQ ID NO: 65948 - RNA, 23 nt, Artificial Sequence
  RNA Oligomer
caauaccuauguaugcaaugcuc

SEQ ID NO: 65949 - RNA, 23 nt, Artificial Sequence
  RNA Oligomer
ucacuucucccaccauuaugaga

SEQ ID NO: 65950 - RNA, 23 nt, Artificial Sequence
  RNA Oligomer
cucacuucucccaccauuaugag

SEQ ID NO: 65951 - RNA, 23 nt, Artificial Sequence
  RNA Oligomer
acucacuucucccaccauuauga

SEQ ID NO: 65952 - RNA, 23 nt, Artificial Sequence
  RNA Oligomer
gacucacuucucccaccauuaug

SEQ ID NO: 65953 - RNA, 23 nt, Artificial Sequence
  RNA Oligomer
ggacucacuucucccaccauuau

SEQ ID NO: 65954 - RNA, 23 nt, Artificial Sequence
  RNA Oligomer
ggaggugcagcgauuugaugggu

SEQ ID NO: 65955 - RNA, 23 nt, Artificial Sequence
  RNA Oligomer
gggaggugcagcgauuugauggg

SEQ ID NO: 65956 - RNA, 23 nt, Artificial Sequence
  RNA Oligomer
ugggaggugcagcgauuugaugg

SEQ ID NO: 65957 - RNA, 23 nt, Artificial Sequence
  RNA Oligomer
gugggaggugcagcgauuugaug

SEQ ID NO: 65958 - RNA, 23 nt, Artificial Sequence
  RNA Oligomer
cgugggaggugcagcgauuugau

SEQ ID NO: 65959 - RNA, 23 nt, Artificial Sequence
  RNA Oligomer
uguucuguaagaagaucuacuuc

SEQ ID NO: 65960 - RNA, 23 nt, Artificial Sequence
  RNA Oligomer
guguucuguaagaagaucuacuu

SEQ ID NO: 65961 - RNA, 23 nt, Artificial Sequence
  RNA Oligomer
aguguucuguaagaagaucuacu

SEQ ID NO: 65962 - RNA, 23 nt, Artificial Sequence
  RNA Oligomer
aaguguucuguaagaagaucuac

SEQ ID NO: 65963 - RNA, 23 nt, Artificial Sequence
  RNA Oligomer
caaguguucuguaagaagaucua

SEQ ID NO: 65964 - RNA, 23 nt, Artificial Sequence
  RNA Oligomer
gucccagcaaucaucuauggggg

SEQ ID NO: 65965 - RNA, 23 nt, Artificial Sequence
  RNA Oligomer
ccuauuauuuucaucaugggcuu

SEQ ID NO: 65966 - RNA, 23 nt, Artificial Sequence
  RNA Oligomer
ucuuucauguucuccuacaucuu

SEQ ID NO: 65967 - RNA, 23 nt, Artificial Sequence
  RNA Oligomer
cucuuucauguucuccuacaucu

SEQ ID NO: 65968 - RNA, 23 nt, Artificial Sequence
  RNA Oligomer
gugcaacaguucaagcgcuucau

SEQ ID NO: 65969 - RNA, 23 nt, Artificial Sequence
  RNA Oligomer
ggugcaacaguucaagcgcuuca

SEQ ID NO: 65970 - RNA, 23 nt, Artificial Sequence
  RNA Oligomer
uaacgucauuccagcccuugcug

SEQ ID NO: 65971 - RNA, 23 nt, Artificial Sequence
  RNA Oligomer
guaacgucauuccagcccuugcu

SEQ ID NO: 65972 - RNA, 23 nt, Artificial Sequence
  RNA Oligomer
gguaacgucauuccagcccuugc

SEQ ID NO: 65973 - RNA, 23 nt, Artificial Sequence
  RNA Oligomer
agguaacgucauuccagcccuug

SEQ ID NO: 65974 - RNA, 23 nt, Artificial Sequence
  RNA Oligomer
aagguaacgucauuccagcccuu

SEQ ID NO: 65975 - RNA, 23 nt, Artificial Sequence
  RNA Oligomer
uggugcugcuguuuaacuuggag

SEQ ID NO: 65976 - RNA, 23 nt, Artificial Sequence
  RNA Oligomer
cuggugcugcuguuuaacuugga

SEQ ID NO: 65977 - RNA, 23 nt, Artificial Sequence
  RNA Oligomer
ccuggugcugcuguuuaacuugg

SEQ ID NO: 65978 - RNA, 23 nt, Artificial Sequence
  RNA Oligomer
ugagaaauuucaagaggcuccag

SEQ ID NO: 65979 - RNA, 23 nt, Artificial Sequence
  RNA Oligomer
augagaaauuucaagaggcucca

SEQ ID NO: 65980 - RNA, 23 nt, Artificial Sequence
  RNA Oligomer
gaugagaaauuucaagaggcucc

SEQ ID NO: 65981 - RNA, 23 nt, Artificial Sequence
  RNA Oligomer
ccaguagucucccuuccaaauaa

SEQ ID NO: 65982 - RNA, 23 nt, Artificial Sequence
  RNA Oligomer
uccaguagucucccuuccaaaua

SEQ ID NO: 65983 - RNA, 23 nt, Artificial Sequence
  RNA Oligomer
cuccaguagucucccuuccaaau

SEQ ID NO: 65984 - RNA, 23 nt, Artificial Sequence
  RNA Oligomer
gcuccaguagucucccuuccaaa

SEQ ID NO: 65985 - RNA, 23 nt, Artificial Sequence
  RNA Oligomer
ugcuccaguagucucccuuccaa

SEQ ID NO: 65986 - RNA, 23 nt, Artificial Sequence
  RNA Oligomer
caagccauuuacagaaacccacu

SEQ ID NO: 65987 - RNA, 23 nt, Artificial Sequence
  RNA Oligomer
gcuaugcagauggcguguaccag

SEQ ID NO: 65988 - RNA, 23 nt, Artificial Sequence
  RNA Oligomer
agcuaugcagauggcguguacca

SEQ ID NO: 65989 - RNA, 23 nt, Artificial Sequence
  RNA Oligomer
cagcuaugcagauggcguguacc

SEQ ID NO: 65990 - RNA, 23 nt, Artificial Sequence
  RNA Oligomer
ccagcuaugcagauggcguguac

SEQ ID NO: 65991 - RNA, 23 nt, Artificial Sequence
  RNA Oligomer
gccagcuaugcagauggcgugua

SEQ ID NO: 65992 - RNA, 23 nt, Artificial Sequence
  RNA Oligomer
ugcuuccagacuucagaaacaaa

SEQ ID NO: 65993 - RNA, 23 nt, Artificial Sequence
  RNA Oligomer
cugcuuccagacuucagaaacaa

SEQ ID NO: 65994 - RNA, 23 nt, Artificial Sequence
  RNA Oligomer
ccaaguguucuguaagaagaucu

SEQ ID NO: 65995 - RNA, 23 nt, Artificial Sequence
  RNA Oligomer
cagcugccaaguguucuguaaga

SEQ ID NO: 65996 - RNA, 23 nt, Artificial Sequence
  RNA Oligomer
cccagggcuuugaguacaaguca

SEQ ID NO: 65997 - RNA, 23 nt, Artificial Sequence
  RNA Oligomer
uuauuuucaucaugggcuucugc

SEQ ID NO: 65998 - RNA, 23 nt, Artificial Sequence
  RNA Oligomer
auuauuuucaucaugggcuucug

SEQ ID NO: 65999 - RNA, 23 nt, Artificial Sequence
  RNA Oligomer
uauuauuuucaucaugggcuucu

SEQ ID NO: 66000 - RNA, 23 nt, Artificial Sequence
  RNA Oligomer
cuauuauuuucaucaugggcuuc

SEQ ID NO: 66001 - RNA, 23 nt, Artificial Sequence
  RNA Oligomer
aucauguaugucuuugccuccca

SEQ ID NO: 66002 - RNA, 23 nt, Artificial Sequence
  RNA Oligomer
caucauguaugucuuugccuccc

SEQ ID NO: 66003 - RNA, 23 nt, Artificial Sequence
  RNA Oligomer
gaagguaacgucauuccagcccu

SEQ ID NO: 66004 - RNA, 23 nt, Artificial Sequence
  RNA Oligomer
guuuggcaagaagguaacgucau

SEQ ID NO: 66005 - RNA, 23 nt, Artificial Sequence
  RNA Oligomer
cgacuuugaugggaauggccuca

SEQ ID NO: 66006 - RNA, 23 nt, Artificial Sequence
  RNA Oligomer
acgacuuugaugggaauggccuc

SEQ ID NO: 66007 - RNA, 23 nt, Artificial Sequence
  RNA Oligomer
uacgacuuugaugggaauggccu

SEQ ID NO: 66008 - RNA, 23 nt, Artificial Sequence
  RNA Oligomer
ccugaggaaaagucucgccuuau

SEQ ID NO: 66009 - RNA, 23 nt, Artificial Sequence
  RNA Oligomer
uggcugacaaggauggcaauggc

SEQ ID NO: 66010 - RNA, 23 nt, Artificial Sequence
  RNA Oligomer
cuggcugacaaggauggcaaugg

SEQ ID NO: 66011 - RNA, 23 nt, Artificial Sequence
  RNA Oligomer
ucuggcugacaaggauggcaaug

SEQ ID NO: 66012 - RNA, 23 nt, Artificial Sequence
  RNA Oligomer
cucuggcugacaaggauggcaau

SEQ ID NO: 66013 - RNA, 23 nt, Artificial Sequence
  RNA Oligomer
ucucuggcugacaaggauggcaa

SEQ ID NO: 66014 - RNA, 23 nt, Artificial Sequence
  RNA Oligomer
uguuuguggaguccauguucucu

SEQ ID NO: 66015 - RNA, 23 nt, Artificial Sequence
  RNA Oligomer
auguuuguggaguccauguucuc

SEQ ID NO: 66016 - RNA, 23 nt, Artificial Sequence
  RNA Oligomer
cauguuuguggaguccauguucu

SEQ ID NO: 66017 - RNA, 23 nt, Artificial Sequence
  RNA Oligomer
gcuguuuaacuuggaggaagagc

SEQ ID NO: 66018 - RNA, 23 nt, Artificial Sequence
  RNA Oligomer
ugcuguuuaacuuggaggaagag

SEQ ID NO: 66019 - RNA, 23 nt, Artificial Sequence
  RNA Oligomer
cugcuguuuaacuuggaggaaga

SEQ ID NO: 66020 - RNA, 23 nt, Artificial Sequence
  RNA Oligomer
gcugcuguuuaacuuggaggaag

SEQ ID NO: 66021 - RNA, 23 nt, Artificial Sequence
  RNA Oligomer
ugcugcuguuuaacuuggaggaa

SEQ ID NO: 66022 - RNA, 23 nt, Artificial Sequence
  RNA Oligomer
cgugacuauuuugagggcagugg

SEQ ID NO: 66023 - RNA, 23 nt, Artificial Sequence
  RNA Oligomer
ucgugacuauuuugagggcagug

SEQ ID NO: 66024 - RNA, 23 nt, Artificial Sequence
  RNA Oligomer
uucgugacuauuuugagggcagu

SEQ ID NO: 66025 - RNA, 23 nt, Artificial Sequence
  RNA Oligomer
guucgugacuauuuugagggcag

SEQ ID NO: 66026 - RNA, 23 nt, Artificial Sequence
  RNA Oligomer
uguucgugacuauuuugagggca

SEQ ID NO: 66027 - RNA, 23 nt, Artificial Sequence
  RNA Oligomer
gcucugcagcccaaugucuuugu

SEQ ID NO: 66028 - RNA, 23 nt, Artificial Sequence
  RNA Oligomer
cugggccacugaaguuuucccgc

SEQ ID NO: 66029 - RNA, 23 nt, Artificial Sequence
  RNA Oligomer
ccugggccacugaaguuuucccg

SEQ ID NO: 66030 - RNA, 23 nt, Artificial Sequence
  RNA Oligomer
gccugggccacugaaguuuuccc

SEQ ID NO: 66031 - RNA, 23 nt, Artificial Sequence
  RNA Oligomer
ggccugggccacugaaguuuucc

SEQ ID NO: 66032 - RNA, 23 nt, Artificial Sequence
  RNA Oligomer
uggccugggccacugaaguuuuc

SEQ ID NO: 66033 - RNA, 23 nt, Artificial Sequence
  RNA Oligomer
cuggccugggccacugaaguuuu

SEQ ID NO: 66034 - RNA, 23 nt, Artificial Sequence
  RNA Oligomer
ggucuucuuuggcuaucacgugc

SEQ ID NO: 66035 - RNA, 23 nt, Artificial Sequence
  RNA Oligomer
ccauuuacagaaacccacucggc

SEQ ID NO: 66036 - RNA, 23 nt, Artificial Sequence
  RNA Oligomer
gccauuuacagaaacccacucgg

SEQ ID NO: 66037 - RNA, 23 nt, Artificial Sequence
  RNA Oligomer
agccauuuacagaaacccacucg

SEQ ID NO: 66038 - RNA, 23 nt, Artificial Sequence
  RNA Oligomer
aagccauuuacagaaacccacuc

SEQ ID NO: 66039 - RNA, 23 nt, Artificial Sequence
  RNA Oligomer
cggugaguguaaggaugcagugg

SEQ ID NO: 66040 - RNA, 23 nt, Artificial Sequence
  RNA Oligomer
gcggugaguguaaggaugcagug

SEQ ID NO: 66041 - RNA, 23 nt, Artificial Sequence
  RNA Oligomer
ggcggugaguguaaggaugcagu

SEQ ID NO: 66042 - RNA, 23 nt, Artificial Sequence
  RNA Oligomer
gggcggugaguguaaggaugcag

SEQ ID NO: 66043 - RNA, 23 nt, Artificial Sequence
  RNA Oligomer
ggggcggugaguguaaggaugca

SEQ ID NO: 66044 - RNA, 23 nt, Artificial Sequence
  RNA Oligomer
gcugaccugacaaguacuaugug

SEQ ID NO: 66045 - RNA, 23 nt, Artificial Sequence
  RNA Oligomer
agcugaccugacaaguacuaugu

SEQ ID NO: 66046 - RNA, 23 nt, Artificial Sequence
  RNA Oligomer
aagcugaccugacaaguacuaug

SEQ ID NO: 66047 - RNA, 23 nt, Artificial Sequence
  RNA Oligomer
caagcugaccugacaaguacuau

SEQ ID NO: 66048 - RNA, 23 nt, Artificial Sequence
  RNA Oligomer
acaagcugaccugacaaguacua

SEQ ID NO: 66049 - RNA, 23 nt, Artificial Sequence
  RNA Oligomer
cggacucacuucucccaccauua

SEQ ID NO: 66050 - RNA, 23 nt, Artificial Sequence
  RNA Oligomer
ccggacucacuucucccaccauu

SEQ ID NO: 66051 - RNA, 23 nt, Artificial Sequence
  RNA Oligomer
gcgauuugaugggugguacaaca

SEQ ID NO: 66052 - RNA, 23 nt, Artificial Sequence
  RNA Oligomer
agcgauuugaugggugguacaac

SEQ ID NO: 66053 - RNA, 23 nt, Artificial Sequence
  RNA Oligomer
cagcgauuugaugggugguacaa

SEQ ID NO: 66054 - RNA, 23 nt, Artificial Sequence
  RNA Oligomer
gcagcgauuugaugggugguaca

SEQ ID NO: 66055 - RNA, 23 nt, Artificial Sequence
  RNA Oligomer
ugcagcgauuugaugggugguac

SEQ ID NO: 66056 - RNA, 23 nt, Artificial Sequence
  RNA Oligomer
cugcucaucauccaugguagcuu

SEQ ID NO: 66057 - RNA, 23 nt, Artificial Sequence
  RNA Oligomer
ccugcucaucauccaugguagcu

SEQ ID NO: 66058 - RNA, 23 nt, Artificial Sequence
  RNA Oligomer
uccugcucaucauccaugguagc

SEQ ID NO: 66059 - RNA, 23 nt, Artificial Sequence
  RNA Oligomer
guccugcucaucauccaugguag

SEQ ID NO: 66060 - RNA, 23 nt, Artificial Sequence
  RNA Oligomer
uguccugcucaucauccauggua

SEQ ID NO: 66061 - RNA, 23 nt, Artificial Sequence
  RNA Oligomer
accucuacauccugcucuauguc

SEQ ID NO: 66062 - RNA, 23 nt, Artificial Sequence
  RNA Oligomer
caccucuacauccugcucuaugu

SEQ ID NO: 66063 - RNA, 23 nt, Artificial Sequence
  RNA Oligomer
ccaccucuacauccugcucuaug

SEQ ID NO: 66064 - RNA, 23 nt, Artificial Sequence
  RNA Oligomer
accaccucuacauccugcucuau

SEQ ID NO: 66065 - RNA, 23 nt, Artificial Sequence
  RNA Oligomer
caccaccucuacauccugcucua

SEQ ID NO: 66066 - RNA, 23 nt, Artificial Sequence
  RNA Oligomer
guucuccuacaucuugcucacca

SEQ ID NO: 66067 - RNA, 23 nt, Artificial Sequence
  RNA Oligomer
ucaagcgcuucauugagaacuac

SEQ ID NO: 66068 - RNA, 23 nt, Artificial Sequence
  RNA Oligomer
uucaagcgcuucauugagaacua

SEQ ID NO: 66069 - RNA, 23 nt, Artificial Sequence
  RNA Oligomer
guucaagcgcuucauugagaacu

SEQ ID NO: 66070 - RNA, 23 nt, Artificial Sequence
  RNA Oligomer
aguucaagcgcuucauugagaac

SEQ ID NO: 66071 - RNA, 23 nt, Artificial Sequence
  RNA Oligomer
caguucaagcgcuucauugagaa

SEQ ID NO: 66072 - RNA, 23 nt, Artificial Sequence
  RNA Oligomer
cggugcaacaguucaagcgcuuc

SEQ ID NO: 66073 - RNA, 23 nt, Artificial Sequence
  RNA Oligomer
cgacauugagacugaguugacac

SEQ ID NO: 66074 - RNA, 23 nt, Artificial Sequence
  RNA Oligomer
ugacaugggaagauuuucacuuc

SEQ ID NO: 66075 - RNA, 23 nt, Artificial Sequence
  RNA Oligomer
cugacaugggaagauuuucacuu

SEQ ID NO: 66076 - RNA, 23 nt, Artificial Sequence
  RNA Oligomer
acugacaugggaagauuuucacu

SEQ ID NO: 66077 - RNA, 23 nt, Artificial Sequence
  RNA Oligomer
aacugacaugggaagauuuucac

SEQ ID NO: 66078 - RNA, 23 nt, Artificial Sequence
  RNA Oligomer
gaacugacaugggaagauuuuca

SEQ ID NO: 66079 - RNA, 23 nt, Artificial Sequence
  RNA Oligomer
ucauuuccaaggaugaguucauc

SEQ ID NO: 66080 - RNA, 23 nt, Artificial Sequence
  RNA Oligomer
cucauuuccaaggaugaguucau

SEQ ID NO: 66081 - RNA, 23 nt, Artificial Sequence
  RNA Oligomer
ccucauuuccaaggaugaguuca

SEQ ID NO: 66082 - RNA, 23 nt, Artificial Sequence
  RNA Oligomer
gccucauuuccaaggaugaguuc

SEQ ID NO: 66083 - RNA, 23 nt, Artificial Sequence
  RNA Oligomer
ggccucauuuccaaggaugaguu

SEQ ID NO: 66084 - RNA, 23 nt, Artificial Sequence
  RNA Oligomer
guggucuucaugaaaggcucucc

SEQ ID NO: 66085 - RNA, 23 nt, Artificial Sequence
  RNA Oligomer
gguggucuucaugaaaggcucuc

SEQ ID NO: 66086 - RNA, 23 nt, Artificial Sequence
  RNA Oligomer
ugguggucuucaugaaaggcucu

SEQ ID NO: 66087 - RNA, 23 nt, Artificial Sequence
  RNA Oligomer
cugguggucuucaugaaaggcuc

SEQ ID NO: 66088 - RNA, 23 nt, Artificial Sequence
  RNA Oligomer
ccugguggucuucaugaaaggcu

SEQ ID NO: 66089 - RNA, 23 nt, Artificial Sequence
  RNA Oligomer
uccugguggucuucaugaaaggc

SEQ ID NO: 66090 - RNA, 23 nt, Artificial Sequence
  RNA Oligomer
auccugguggucuucaugaaagg

SEQ ID NO: 66091 - RNA, 23 nt, Artificial Sequence
  RNA Oligomer
cauccugguggucuucaugaaag

SEQ ID NO: 66092 - RNA, 23 nt, Artificial Sequence
  RNA Oligomer
cuguuuaacuuggaggaagagcg

SEQ ID NO: 66093 - RNA, 23 nt, Artificial Sequence
  RNA Oligomer
ggcauggaagcuuuggaauggca

SEQ ID NO: 66094 - RNA, 23 nt, Artificial Sequence
  RNA Oligomer
ugacuauuuugagggcaguggau

SEQ ID NO: 66095 - RNA, 23 nt, Artificial Sequence
  RNA Oligomer
gugacuauuuugagggcagugga

SEQ ID NO: 66096 - RNA, 23 nt, Artificial Sequence
  RNA Oligomer
gguugaagaugugcgggauuucu

SEQ ID NO: 66097 - RNA, 23 nt, Artificial Sequence
  RNA Oligomer
ugguugaagaugugcgggauuuc

SEQ ID NO: 66098 - RNA, 23 nt, Artificial Sequence
  RNA Oligomer
uugguugaagaugugcgggauuu

SEQ ID NO: 66099 - RNA, 23 nt, Artificial Sequence
  RNA Oligomer
guugguugaagaugugcgggauu

SEQ ID NO: 66100 - RNA, 23 nt, Artificial Sequence
  RNA Oligomer
uguugguugaagaugugcgggau

SEQ ID NO: 66101 - RNA, 23 nt, Artificial Sequence
  RNA Oligomer
ucgccaccuaccagaacaucgcu

SEQ ID NO: 66102 - RNA, 23 nt, Artificial Sequence
  RNA Oligomer
aucgccaccuaccagaacaucgc

SEQ ID NO: 66103 - RNA, 23 nt, Artificial Sequence
  RNA Oligomer
caucgccaccuaccagaacaucg

SEQ ID NO: 66104 - RNA, 23 nt, Artificial Sequence
  RNA Oligomer
ucaucgccaccuaccagaacauc

SEQ ID NO: 66105 - RNA, 23 nt, Artificial Sequence
  RNA Oligomer
gucaucgccaccuaccagaacau

SEQ ID NO: 66106 - RNA, 23 nt, Artificial Sequence
  RNA Oligomer
ugagaaaccgcacaguguugggg

SEQ ID NO: 66107 - RNA, 23 nt, Artificial Sequence
  RNA Oligomer
cugagaaaccgcacaguguuggg

SEQ ID NO: 66108 - RNA, 23 nt, Artificial Sequence
  RNA Oligomer
ccugagaaaccgcacaguguugg

SEQ ID NO: 66109 - RNA, 23 nt, Artificial Sequence
  RNA Oligomer
cccugagaaaccgcacaguguug

SEQ ID NO: 66110 - RNA, 23 nt, Artificial Sequence
  RNA Oligomer
ucccugagaaaccgcacaguguu

SEQ ID NO: 66111 - RNA, 23 nt, Artificial Sequence
  RNA Oligomer
ucccauaccuccuccucuucugg

SEQ ID NO: 66112 - RNA, 23 nt, Artificial Sequence
  RNA Oligomer
cucccauaccuccuccucuucug

SEQ ID NO: 66113 - RNA, 23 nt, Artificial Sequence
  RNA Oligomer
acucccauaccuccuccucuucu

SEQ ID NO: 66114 - RNA, 23 nt, Artificial Sequence
  RNA Oligomer
uacucccauaccuccuccucuuc

SEQ ID NO: 66115 - RNA, 23 nt, Artificial Sequence
  RNA Oligomer
cuacucccauaccuccuccucuu

SEQ ID NO: 66116 - RNA, 23 nt, Artificial Sequence
  RNA Oligomer
ugugugcaugucuguaugugugu

SEQ ID NO: 66117 - RNA, 23 nt, Artificial Sequence
  RNA Oligomer
gugugugcaugucuguaugugug

SEQ ID NO: 66118 - RNA, 23 nt, Artificial Sequence
  RNA Oligomer
agguggccauagucagucaccau

SEQ ID NO: 66119 - RNA, 23 nt, Artificial Sequence
  RNA Oligomer
cagguggccauagucagucacca

SEQ ID NO: 66120 - RNA, 23 nt, Artificial Sequence
  RNA Oligomer
ccagguggccauagucagucacc

SEQ ID NO: 66121 - RNA, 23 nt, Artificial Sequence
  RNA Oligomer
uccagguggccauagucagucac

SEQ ID NO: 66122 - RNA, 23 nt, Artificial Sequence
  RNA Oligomer
uuccagguggccauagucaguca

SEQ ID NO: 66123 - RNA, 23 nt, Artificial Sequence
  RNA Oligomer
accggacucacuucucccaccau

SEQ ID NO: 66124 - RNA, 23 nt, Artificial Sequence
  RNA Oligomer
cgauuugaugggugguacaacaa

SEQ ID NO: 66125 - RNA, 23 nt, Artificial Sequence
  RNA Oligomer
gugcagcgauuugauggguggua

SEQ ID NO: 66126 - RNA, 23 nt, Artificial Sequence
  RNA Oligomer
gaaccggagucuauucacaggcc

SEQ ID NO: 66127 - RNA, 23 nt, Artificial Sequence
  RNA Oligomer
ugaaccggagucuauucacaggc

SEQ ID NO: 66128 - RNA, 23 nt, Artificial Sequence
  RNA Oligomer
cugaaccggagucuauucacagg

SEQ ID NO: 66129 - RNA, 23 nt, Artificial Sequence
  RNA Oligomer
ucugaaccggagucuauucacag

SEQ ID NO: 66130 - RNA, 23 nt, Artificial Sequence
  RNA Oligomer
uucugaaccggagucuauucaca

SEQ ID NO: 66131 - RNA, 23 nt, Artificial Sequence
  RNA Oligomer
ccucaggaccacuaugcuguaca

SEQ ID NO: 66132 - RNA, 23 nt, Artificial Sequence
  RNA Oligomer
accucaggaccacuaugcuguac

SEQ ID NO: 66133 - RNA, 23 nt, Artificial Sequence
  RNA Oligomer
agcauggacacuucugguugggg

SEQ ID NO: 66134 - RNA, 23 nt, Artificial Sequence
  RNA Oligomer
uagcauggacacuucugguuggg

SEQ ID NO: 66135 - RNA, 23 nt, Artificial Sequence
  RNA Oligomer
cuagcauggacacuucugguugg

SEQ ID NO: 66136 - RNA, 23 nt, Artificial Sequence
  RNA Oligomer
ucuagcauggacacuucugguug

SEQ ID NO: 66137 - RNA, 23 nt, Artificial Sequence
  RNA Oligomer
cucuagcauggacacuucugguu

SEQ ID NO: 66138 - RNA, 23 nt, Artificial Sequence
  RNA Oligomer
ucaucauccaugguagcuuugcc

SEQ ID NO: 66139 - RNA, 23 nt, Artificial Sequence
  RNA Oligomer
cucaucauccaugguagcuuugc

SEQ ID NO: 66140 - RNA, 23 nt, Artificial Sequence
  RNA Oligomer
gcucaucauccaugguagcuuug

SEQ ID NO: 66141 - RNA, 23 nt, Artificial Sequence
  RNA Oligomer
ugcucaucauccaugguagcuuu

SEQ ID NO: 66142 - RNA, 23 nt, Artificial Sequence
  RNA Oligomer
cguccucacagucuuacacagug

SEQ ID NO: 66143 - RNA, 23 nt, Artificial Sequence
  RNA Oligomer
ucguccucacagucuuacacagu

SEQ ID NO: 66144 - RNA, 23 nt, Artificial Sequence
  RNA Oligomer
aucguccucacagucuuacacag

SEQ ID NO: 66145 - RNA, 23 nt, Artificial Sequence
  RNA Oligomer
caucguccucacagucuuacaca

SEQ ID NO: 66146 - RNA, 23 nt, Artificial Sequence
  RNA Oligomer
caagaagguaacgucauuccagc

SEQ ID NO: 66147 - RNA, 23 nt, Artificial Sequence
  RNA Oligomer
caugggaagauuuucacuucaug

SEQ ID NO: 66148 - RNA, 23 nt, Artificial Sequence
  RNA Oligomer
acaugggaagauuuucacuucau

SEQ ID NO: 66149 - RNA, 23 nt, Artificial Sequence
  RNA Oligomer
gacaugggaagauuuucacuuca

SEQ ID NO: 66150 - RNA, 23 nt, Artificial Sequence
  RNA Oligomer
cgcauguacgacuuugaugggaa

SEQ ID NO: 66151 - RNA, 23 nt, Artificial Sequence
  RNA Oligomer
ccgcauguacgacuuugauggga

SEQ ID NO: 66152 - RNA, 23 nt, Artificial Sequence
  RNA Oligomer
uccgcauguacgacuuugauggg

SEQ ID NO: 66153 - RNA, 23 nt, Artificial Sequence
  RNA Oligomer
uuccgcauguacgacuuugaugg

SEQ ID NO: 66154 - RNA, 23 nt, Artificial Sequence
  RNA Oligomer
guuccgcauguacgacuuugaug

SEQ ID NO: 66155 - RNA, 23 nt, Artificial Sequence
  RNA Oligomer
uggucuucaugaaaggcucuccu

SEQ ID NO: 66156 - RNA, 23 nt, Artificial Sequence
  RNA Oligomer
uguucucucuggcugacaaggau

SEQ ID NO: 66157 - RNA, 23 nt, Artificial Sequence
  RNA Oligomer
auguucucucuggcugacaagga

SEQ ID NO: 66158 - RNA, 23 nt, Artificial Sequence
  RNA Oligomer
cauguucucucuggcugacaagg

SEQ ID NO: 66159 - RNA, 23 nt, Artificial Sequence
  RNA Oligomer
ccauguucucucuggcugacaag

SEQ ID NO: 66160 - RNA, 23 nt, Artificial Sequence
  RNA Oligomer
uccauguucucucuggcugacaa

SEQ ID NO: 66161 - RNA, 23 nt, Artificial Sequence
  RNA Oligomer
ccaggacauguuuguggagucca

SEQ ID NO: 66162 - RNA, 23 nt, Artificial Sequence
  RNA Oligomer
cccaggacauguuuguggagucc

SEQ ID NO: 66163 - RNA, 23 nt, Artificial Sequence
  RNA Oligomer
ccccaggacauguuuguggaguc

SEQ ID NO: 66164 - RNA, 23 nt, Artificial Sequence
  RNA Oligomer
gccccaggacauguuuguggagu

SEQ ID NO: 66165 - RNA, 23 nt, Artificial Sequence
  RNA Oligomer
agccccaggacauguuuguggag

SEQ ID NO: 66166 - RNA, 23 nt, Artificial Sequence
  RNA Oligomer
aggcgcugguggaaaaucuccgg

SEQ ID NO: 66167 - RNA, 23 nt, Artificial Sequence
  RNA Oligomer
caggcgcugguggaaaaucuccg

SEQ ID NO: 66168 - RNA, 23 nt, Artificial Sequence
  RNA Oligomer
gcaggcgcugguggaaaaucucc

SEQ ID NO: 66169 - RNA, 23 nt, Artificial Sequence
  RNA Oligomer
ggcaggcgcugguggaaaaucuc

SEQ ID NO: 66170 - RNA, 23 nt, Artificial Sequence
  RNA Oligomer
cggcaggcgcugguggaaaaucu

SEQ ID NO: 66171 - RNA, 23 nt, Artificial Sequence
  RNA Oligomer
gugcugcuguuuaacuuggagga

SEQ ID NO: 66172 - RNA, 23 nt, Artificial Sequence
  RNA Oligomer
ggugcugcuguuuaacuuggagg

SEQ ID NO: 66173 - RNA, 23 nt, Artificial Sequence
  RNA Oligomer
guaugaccuggugcugcuguuua

SEQ ID NO: 66174 - RNA, 23 nt, Artificial Sequence
  RNA Oligomer
acuucguccuguccagcaaccgu

SEQ ID NO: 66175 - RNA, 23 nt, Artificial Sequence
  RNA Oligomer
aacuucguccuguccagcaaccg

SEQ ID NO: 66176 - RNA, 23 nt, Artificial Sequence
  RNA Oligomer
caacuucguccuguccagcaacc

SEQ ID NO: 66177 - RNA, 23 nt, Artificial Sequence
  RNA Oligomer
ucaacuucguccuguccagcaac

SEQ ID NO: 66178 - RNA, 23 nt, Artificial Sequence
  RNA Oligomer
gucaacuucguccuguccagcaa

SEQ ID NO: 66179 - RNA, 23 nt, Artificial Sequence
  RNA Oligomer
cggcuccggaugagaaauuucaa

SEQ ID NO: 66180 - RNA, 23 nt, Artificial Sequence
  RNA Oligomer
ugcucccucuguuguucgugacu

SEQ ID NO: 66181 - RNA, 23 nt, Artificial Sequence
  RNA Oligomer
gaccucuguucagcaccaucguc

SEQ ID NO: 66182 - RNA, 23 nt, Artificial Sequence
  RNA Oligomer
ggaccucuguucagcaccaucgu

SEQ ID NO: 66183 - RNA, 23 nt, Artificial Sequence
  RNA Oligomer
uggaccucuguucagcaccaucg

SEQ ID NO: 66184 - RNA, 23 nt, Artificial Sequence
  RNA Oligomer
cuggaccucuguucagcaccauc

SEQ ID NO: 66185 - RNA, 23 nt, Artificial Sequence
  RNA Oligomer
ccuggaccucuguucagcaccau

SEQ ID NO: 66186 - RNA, 23 nt, Artificial Sequence
  RNA Oligomer
gcaaugacacuguacuggaggcc

SEQ ID NO: 66187 - RNA, 23 nt, Artificial Sequence
  RNA Oligomer
agcaaugacacuguacuggaggc

SEQ ID NO: 66188 - RNA, 23 nt, Artificial Sequence
  RNA Oligomer
gagcaaugacacuguacuggagg

SEQ ID NO: 66189 - RNA, 23 nt, Artificial Sequence
  RNA Oligomer
acaaagugcugaagauguggaug

SEQ ID NO: 66190 - RNA, 23 nt, Artificial Sequence
  RNA Oligomer
uacaaagugcugaagauguggau

SEQ ID NO: 66191 - RNA, 23 nt, Artificial Sequence
  RNA Oligomer
cuacaaagugcugaagaugugga

SEQ ID NO: 66192 - RNA, 23 nt, Artificial Sequence
  RNA Oligomer
guguaaggaugcagugggagcau

SEQ ID NO: 66193 - RNA, 23 nt, Artificial Sequence
  RNA Oligomer
aguguaaggaugcagugggagca

SEQ ID NO: 66194 - RNA, 23 nt, Artificial Sequence
  RNA Oligomer
gaguguaaggaugcagugggagc

SEQ ID NO: 66195 - RNA, 23 nt, Artificial Sequence
  RNA Oligomer
ugaguguaaggaugcagugggag

SEQ ID NO: 66196 - RNA, 23 nt, Artificial Sequence
  RNA Oligomer
gugaguguaaggaugcaguggga

SEQ ID NO: 66197 - RNA, 23 nt, Artificial Sequence
  RNA Oligomer
cuaugugugugcaugucuguaug

SEQ ID NO: 66198 - RNA, 23 nt, Artificial Sequence
  RNA Oligomer
acuaugugugugcaugucuguau

SEQ ID NO: 66199 - RNA, 23 nt, Artificial Sequence
  RNA Oligomer
guacuaugugugugcaugucugu

SEQ ID NO: 66200 - RNA, 23 nt, Artificial Sequence
  RNA Oligomer
aguacuaugugugugcaugucug

SEQ ID NO: 66201 - RNA, 23 nt, Artificial Sequence
  RNA Oligomer
caaguacuaugugugugcauguc

SEQ ID NO: 66202 - RNA, 23 nt, Artificial Sequence
  RNA Oligomer
acaaguacuaugugugugcaugu

SEQ ID NO: 66203 - RNA, 23 nt, Artificial Sequence
  RNA Oligomer
gacaaguacuaugugugugcaug

SEQ ID NO: 66204 - RNA, 23 nt, Artificial Sequence
  RNA Oligomer
ugacaaguacuaugugugugcau

SEQ ID NO: 66205 - RNA, 23 nt, Artificial Sequence
  RNA Oligomer
cugacaaguacuaugugugugca

SEQ ID NO: 66206 - RNA, 23 nt, Artificial Sequence
  RNA Oligomer
ccugacaaguacuaugugugugc

SEQ ID NO: 66207 - RNA, 23 nt, Artificial Sequence
  RNA Oligomer
accugacaaguacuaugugugug

SEQ ID NO: 66208 - RNA, 23 nt, Artificial Sequence
  RNA Oligomer
gaccugacaaguacuaugugugu

SEQ ID NO: 66209 - RNA, 23 nt, Artificial Sequence
  RNA Oligomer
ugaccugacaaguacuaugugug

SEQ ID NO: 66210 - RNA, 23 nt, Artificial Sequence
  RNA Oligomer
cugaccugacaaguacuaugugu

SEQ ID NO: 66211 - RNA, 23 nt, Artificial Sequence
  RNA Oligomer
acaccucaccucuguucuuccua

SEQ ID NO: 66212 - RNA, 23 nt, Artificial Sequence
  RNA Oligomer
cacaccucaccucuguucuuccu

SEQ ID NO: 66213 - RNA, 23 nt, Artificial Sequence
  RNA Oligomer
ccacaccucaccucuguucuucc

SEQ ID NO: 66214 - RNA, 23 nt, Artificial Sequence
  RNA Oligomer
cccacaccucaccucuguucuuc

SEQ ID NO: 66215 - RNA, 23 nt, Artificial Sequence
  RNA Oligomer
gcccacaccucaccucuguucuu

SEQ ID NO: 66216 - RNA, 23 nt, Artificial Sequence
  RNA Oligomer
ccaguugagcagagguuugagcc

SEQ ID NO: 66217 - RNA, 23 nt, Artificial Sequence
  RNA Oligomer
cccaguugagcagagguuugagc

SEQ ID NO: 66218 - RNA, 23 nt, Artificial Sequence
  RNA Oligomer
gcccaguugagcagagguuugag

SEQ ID NO: 66219 - RNA, 23 nt, Artificial Sequence
  RNA Oligomer
ugcccaguugagcagagguuuga

SEQ ID NO: 66220 - RNA, 23 nt, Artificial Sequence
  RNA Oligomer
cugcccaguugagcagagguuug

SEQ ID NO: 66221 - RNA, 23 nt, Artificial Sequence
  RNA Oligomer
ccuucuucaacucccugcaggag

SEQ ID NO: 66222 - RNA, 23 nt, Artificial Sequence
  RNA Oligomer
cccuucuucaacucccugcagga

SEQ ID NO: 66223 - RNA, 23 nt, Artificial Sequence
  RNA Oligomer
gcccuucuucaacucccugcagg

SEQ ID NO: 66224 - RNA, 23 nt, Artificial Sequence
  RNA Oligomer
agcccuucuucaacucccugcag

SEQ ID NO: 66225 - RNA, 23 nt, Artificial Sequence
  RNA Oligomer
gagcccuucuucaacucccugca

SEQ ID NO: 66226 - RNA, 23 nt, Artificial Sequence
  RNA Oligomer
acaucuacaucacccagcuggcu

SEQ ID NO: 66227 - RNA, 23 nt, Artificial Sequence
  RNA Oligomer
cacaucuacaucacccagcuggc

SEQ ID NO: 66228 - RNA, 23 nt, Artificial Sequence
  RNA Oligomer
gcacaucuacaucacccagcugg

SEQ ID NO: 66229 - RNA, 23 nt, Artificial Sequence
  RNA Oligomer
ugcacaucuacaucacccagcug

SEQ ID NO: 66230 - RNA, 23 nt, Artificial Sequence
  RNA Oligomer
gugcacaucuacaucacccagcu

SEQ ID NO: 66231 - RNA, 23 nt, Artificial Sequence
  RNA Oligomer
ugaggugucaguguuagugggag

SEQ ID NO: 66232 - RNA, 23 nt, Artificial Sequence
  RNA Oligomer
uugaggugucaguguuaguggga

SEQ ID NO: 66233 - RNA, 23 nt, Artificial Sequence
  RNA Oligomer
uuugaggugucaguguuaguggg

SEQ ID NO: 66234 - RNA, 23 nt, Artificial Sequence
  RNA Oligomer
guuugaggugucaguguuagugg

SEQ ID NO: 66235 - RNA, 23 nt, Artificial Sequence
  RNA Oligomer
aguuugaggugucaguguuagug

SEQ ID NO: 66236 - RNA, 23 nt, Artificial Sequence
  RNA Oligomer
gaguacaagucagggcagugggu

SEQ ID NO: 66237 - RNA, 23 nt, Artificial Sequence
  RNA Oligomer
ugaguacaagucagggcaguggg

SEQ ID NO: 66238 - RNA, 23 nt, Artificial Sequence
  RNA Oligomer
uugaguacaagucagggcagugg

SEQ ID NO: 66239 - RNA, 23 nt, Artificial Sequence
  RNA Oligomer
uuugaguacaagucagggcagug

SEQ ID NO: 66240 - RNA, 23 nt, Artificial Sequence
  RNA Oligomer
cuuugaguacaagucagggcagu

SEQ ID NO: 66241 - RNA, 23 nt, Artificial Sequence
  RNA Oligomer
gauccuggccaucauguaugucu

SEQ ID NO: 66242 - RNA, 23 nt, Artificial Sequence
  RNA Oligomer
ggccucuuccaugaugauggguc

SEQ ID NO: 66243 - RNA, 23 nt, Artificial Sequence
  RNA Oligomer
uggccucuuccaugaugaugggu

SEQ ID NO: 66244 - RNA, 23 nt, Artificial Sequence
  RNA Oligomer
cuggccucuuccaugaugauggg

SEQ ID NO: 66245 - RNA, 23 nt, Artificial Sequence
  RNA Oligomer
ccuggccucuuccaugaugaugg

SEQ ID NO: 66246 - RNA, 23 nt, Artificial Sequence
  RNA Oligomer
uccuggccucuuccaugaugaug

SEQ ID NO: 66247 - RNA, 23 nt, Artificial Sequence
  RNA Oligomer
ccauguggugaauguguaccugu

SEQ ID NO: 66248 - RNA, 23 nt, Artificial Sequence
  RNA Oligomer
gccauguggugaauguguaccug

SEQ ID NO: 66249 - RNA, 23 nt, Artificial Sequence
  RNA Oligomer
ggccauguggugaauguguaccu

SEQ ID NO: 66250 - RNA, 23 nt, Artificial Sequence
  RNA Oligomer
gggccauguggugaauguguacc

SEQ ID NO: 66251 - RNA, 23 nt, Artificial Sequence
  RNA Oligomer
ugggccauguggugaauguguac

SEQ ID NO: 66252 - RNA, 23 nt, Artificial Sequence
  RNA Oligomer
uccucacagucuuacacagugug

SEQ ID NO: 66253 - RNA, 23 nt, Artificial Sequence
  RNA Oligomer
guccucacagucuuacacagugu

SEQ ID NO: 66254 - RNA, 23 nt, Artificial Sequence
  RNA Oligomer
gggaagauuuucacuucaugcug

SEQ ID NO: 66255 - RNA, 23 nt, Artificial Sequence
  RNA Oligomer
ugggaagauuuucacuucaugcu

SEQ ID NO: 66256 - RNA, 23 nt, Artificial Sequence
  RNA Oligomer
augggaagauuuucacuucaugc

SEQ ID NO: 66257 - RNA, 23 nt, Artificial Sequence
  RNA Oligomer
ggaggaacugacaugggaagauu

SEQ ID NO: 66258 - RNA, 23 nt, Artificial Sequence
  RNA Oligomer
aggaggaacugacaugggaagau

SEQ ID NO: 66259 - RNA, 23 nt, Artificial Sequence
  RNA Oligomer
aaggaggaacugacaugggaaga

SEQ ID NO: 66260 - RNA, 23 nt, Artificial Sequence
  RNA Oligomer
caaggaggaacugacaugggaag

SEQ ID NO: 66261 - RNA, 23 nt, Artificial Sequence
  RNA Oligomer
acaaggaggaacugacaugggaa

SEQ ID NO: 66262 - RNA, 23 nt, Artificial Sequence
  RNA Oligomer
agaucuccaacaacugccugucc

SEQ ID NO: 66263 - RNA, 23 nt, Artificial Sequence
  RNA Oligomer
gagaucuccaacaacugccuguc

SEQ ID NO: 66264 - RNA, 23 nt, Artificial Sequence
  RNA Oligomer
cgagaucuccaacaacugccugu

SEQ ID NO: 66265 - RNA, 23 nt, Artificial Sequence
  RNA Oligomer
ucgagaucuccaacaacugccug

SEQ ID NO: 66266 - RNA, 23 nt, Artificial Sequence
  RNA Oligomer
aucgagaucuccaacaacugccu

SEQ ID NO: 66267 - RNA, 23 nt, Artificial Sequence
  RNA Oligomer
uguuuaacuuggaggaagagcgg

SEQ ID NO: 66268 - RNA, 23 nt, Artificial Sequence
  RNA Oligomer
aguaugaccuggugcugcuguuu

SEQ ID NO: 66269 - RNA, 23 nt, Artificial Sequence
  RNA Oligomer
ggucaacuucguccuguccagca

SEQ ID NO: 66270 - RNA, 23 nt, Artificial Sequence
  RNA Oligomer
aggucaacuucguccuguccagc

SEQ ID NO: 66271 - RNA, 23 nt, Artificial Sequence
  RNA Oligomer
aaggucaacuucguccuguccag

SEQ ID NO: 66272 - RNA, 23 nt, Artificial Sequence
  RNA Oligomer
caaugacacuguacuggaggcca

SEQ ID NO: 66273 - RNA, 23 nt, Artificial Sequence
  RNA Oligomer
ccauaccuccuccucuucugggc

SEQ ID NO: 66274 - RNA, 23 nt, Artificial Sequence
  RNA Oligomer
cccauaccuccuccucuucuggg

SEQ ID NO: 66275 - RNA, 23 nt, Artificial Sequence
  RNA Oligomer
ggugaguguaaggaugcaguggg

SEQ ID NO: 66276 - RNA, 23 nt, Artificial Sequence
  RNA Oligomer
ugagcccuucuucaacucccugc

SEQ ID NO: 66277 - RNA, 23 nt, Artificial Sequence
  RNA Oligomer
uugagcccuucuucaacucccug

SEQ ID NO: 66278 - RNA, 23 nt, Artificial Sequence
  RNA Oligomer
uuugagcccuucuucaacucccu

SEQ ID NO: 66279 - RNA, 23 nt, Artificial Sequence
  RNA Oligomer
gcauggacacuucugguuggggc

SEQ ID NO: 66280 - RNA, 23 nt, Artificial Sequence
  RNA Oligomer
ccucuacauccugcucuaugucc

SEQ ID NO: 66281 - RNA, 23 nt, Artificial Sequence
  RNA Oligomer
ugacccaccaccucuacauccug

SEQ ID NO: 66282 - RNA, 23 nt, Artificial Sequence
  RNA Oligomer
cugacccaccaccucuacauccu

SEQ ID NO: 66283 - RNA, 23 nt, Artificial Sequence
  RNA Oligomer
gcugacccaccaccucuacaucc

SEQ ID NO: 66284 - RNA, 23 nt, Artificial Sequence
  RNA Oligomer
ggcugacccaccaccucuacauc

SEQ ID NO: 66285 - RNA, 23 nt, Artificial Sequence
  RNA Oligomer
uggcugacccaccaccucuacau

SEQ ID NO: 66286 - RNA, 23 nt, Artificial Sequence
  RNA Oligomer
ugauccuggccaucauguauguc

SEQ ID NO: 66287 - RNA, 23 nt, Artificial Sequence
  RNA Oligomer
cugauccuggccaucauguaugu

SEQ ID NO: 66288 - RNA, 23 nt, Artificial Sequence
  RNA Oligomer
gcaaccucaucaccuuccugcga

SEQ ID NO: 66289 - RNA, 23 nt, Artificial Sequence
  RNA Oligomer
cgcaaccucaucaccuuccugcg

SEQ ID NO: 66290 - RNA, 23 nt, Artificial Sequence
  RNA Oligomer
ccgcaaccucaucaccuuccugc

SEQ ID NO: 66291 - RNA, 23 nt, Artificial Sequence
  RNA Oligomer
gccgcaaccucaucaccuuccug

SEQ ID NO: 66292 - RNA, 23 nt, Artificial Sequence
  RNA Oligomer
ugccgcaaccucaucaccuuccu

SEQ ID NO: 66293 - RNA, 23 nt, Artificial Sequence
  RNA Oligomer
acaucuugcucaccaugugccgc

SEQ ID NO: 66294 - RNA, 23 nt, Artificial Sequence
  RNA Oligomer
uacaucuugcucaccaugugccg

SEQ ID NO: 66295 - RNA, 23 nt, Artificial Sequence
  RNA Oligomer
cuacaucuugcucaccaugugcc

SEQ ID NO: 66296 - RNA, 23 nt, Artificial Sequence
  RNA Oligomer
agguuuggcaagaagguaacguc

SEQ ID NO: 66297 - RNA, 23 nt, Artificial Sequence
  RNA Oligomer
gagguuuggcaagaagguaacgu

SEQ ID NO: 66298 - RNA, 23 nt, Artificial Sequence
  RNA Oligomer
ggagguuuggcaagaagguaacg

SEQ ID NO: 66299 - RNA, 23 nt, Artificial Sequence
  RNA Oligomer
cggagguuuggcaagaagguaac

SEQ ID NO: 66300 - RNA, 23 nt, Artificial Sequence
  RNA Oligomer
gcggagguuuggcaagaagguaa

SEQ ID NO: 66301 - RNA, 23 nt, Artificial Sequence
  RNA Oligomer
ggacaaggaggaacugacauggg

SEQ ID NO: 66302 - RNA, 23 nt, Artificial Sequence
  RNA Oligomer
aggacaaggaggaacugacaugg

SEQ ID NO: 66303 - RNA, 23 nt, Artificial Sequence
  RNA Oligomer
caggacaaggaggaacugacaug

SEQ ID NO: 66304 - RNA, 23 nt, Artificial Sequence
  RNA Oligomer
ccaggacaaggaggaacugacau

SEQ ID NO: 66305 - RNA, 23 nt, Artificial Sequence
  RNA Oligomer
uccaggacaaggaggaacugaca

SEQ ID NO: 66306 - RNA, 23 nt, Artificial Sequence
  RNA Oligomer
gaaauuucaagaggcuccagggc

SEQ ID NO: 66307 - RNA, 23 nt, Artificial Sequence
  RNA Oligomer
agaaauuucaagaggcuccaggg

SEQ ID NO: 66308 - RNA, 23 nt, Artificial Sequence
  RNA Oligomer
gagaaauuucaagaggcuccagg

SEQ ID NO: 66309 - RNA, 23 nt, Artificial Sequence
  RNA Oligomer
gugcucccucuguuguucgugac

SEQ ID NO: 66310 - RNA, 23 nt, Artificial Sequence
  RNA Oligomer
ugugcucccucuguuguucguga

SEQ ID NO: 66311 - RNA, 23 nt, Artificial Sequence
  RNA Oligomer
ccaucguccuugaacaauuugug

SEQ ID NO: 66312 - RNA, 23 nt, Artificial Sequence
  RNA Oligomer
accaucguccuugaacaauuugu

SEQ ID NO: 66313 - RNA, 23 nt, Artificial Sequence
  RNA Oligomer
caccaucguccuugaacaauuug

SEQ ID NO: 66314 - RNA, 23 nt, Artificial Sequence
  RNA Oligomer
gcaccaucguccuugaacaauuu

SEQ ID NO: 66315 - RNA, 23 nt, Artificial Sequence
  RNA Oligomer
agcaccaucguccuugaacaauu

SEQ ID NO: 66316 - RNA, 23 nt, Artificial Sequence
  RNA Oligomer
uugaagaugugcgggauuucugg

SEQ ID NO: 66317 - RNA, 23 nt, Artificial Sequence
  RNA Oligomer
guugaagaugugcgggauuucug

SEQ ID NO: 66318 - RNA, 23 nt, Artificial Sequence
  RNA Oligomer
gcuaucacgugcuuucagaccug

SEQ ID NO: 66319 - RNA, 23 nt, Artificial Sequence
  RNA Oligomer
ggcuaucacgugcuuucagaccu

SEQ ID NO: 66320 - RNA, 23 nt, Artificial Sequence
  RNA Oligomer
uggcuaucacgugcuuucagacc

SEQ ID NO: 66321 - RNA, 23 nt, Artificial Sequence
  RNA Oligomer
uuggcuaucacgugcuuucagac

SEQ ID NO: 66322 - RNA, 23 nt, Artificial Sequence
  RNA Oligomer
uuuggcuaucacgugcuuucaga

SEQ ID NO: 66323 - RNA, 23 nt, Artificial Sequence
  RNA Oligomer
ccaauaccuauguaugcaaugcu

SEQ ID NO: 66324 - RNA, 23 nt, Artificial Sequence
  RNA Oligomer
cccaauaccuauguaugcaaugc

SEQ ID NO: 66325 - RNA, 23 nt, Artificial Sequence
  RNA Oligomer
gcccaauaccuauguaugcaaug

SEQ ID NO: 66326 - RNA, 23 nt, Artificial Sequence
  RNA Oligomer
ggcccaauaccuauguaugcaau

SEQ ID NO: 66327 - RNA, 23 nt, Artificial Sequence
  RNA Oligomer
uggcccaauaccuauguaugcaa

SEQ ID NO: 66328 - RNA, 23 nt, Artificial Sequence
  RNA Oligomer
caguugagcagagguuugagccc

SEQ ID NO: 66329 - RNA, 23 nt, Artificial Sequence
  RNA Oligomer
ugugcacaucuacaucacccagc

SEQ ID NO: 66330 - RNA, 23 nt, Artificial Sequence
  RNA Oligomer
cugugcacaucuacaucacccag

SEQ ID NO: 66331 - RNA, 23 nt, Artificial Sequence
  RNA Oligomer
gucuucaagucauccgucagcug

SEQ ID NO: 66332 - RNA, 23 nt, Artificial Sequence
  RNA Oligomer
ggucuucaagucauccgucagcu

SEQ ID NO: 66333 - RNA, 23 nt, Artificial Sequence
  RNA Oligomer
uggucuucaagucauccgucagc

SEQ ID NO: 66334 - RNA, 23 nt, Artificial Sequence
  RNA Oligomer
cuggucuucaagucauccgucag

SEQ ID NO: 66335 - RNA, 23 nt, Artificial Sequence
  RNA Oligomer
ccuggucuucaagucauccguca

SEQ ID NO: 66336 - RNA, 23 nt, Artificial Sequence
  RNA Oligomer
caucauccaugguagcuuugccc

SEQ ID NO: 66337 - RNA, 23 nt, Artificial Sequence
  RNA Oligomer
guguaccuguucuccaucagccc

SEQ ID NO: 66338 - RNA, 23 nt, Artificial Sequence
  RNA Oligomer
uguguaccuguucuccaucagcc

SEQ ID NO: 66339 - RNA, 23 nt, Artificial Sequence
  RNA Oligomer
auguguaccuguucuccaucagc

SEQ ID NO: 66340 - RNA, 23 nt, Artificial Sequence
  RNA Oligomer
aauguguaccuguucuccaucag

SEQ ID NO: 66341 - RNA, 23 nt, Artificial Sequence
  RNA Oligomer
gaauguguaccuguucuccauca

SEQ ID NO: 66342 - RNA, 23 nt, Artificial Sequence
  RNA Oligomer
ugaauguguaccuguucuccauc

SEQ ID NO: 66343 - RNA, 23 nt, Artificial Sequence
  RNA Oligomer
gugaauguguaccuguucuccau

SEQ ID NO: 66344 - RNA, 23 nt, Artificial Sequence
  RNA Oligomer
ggugaauguguaccuguucucca

SEQ ID NO: 66345 - RNA, 23 nt, Artificial Sequence
  RNA Oligomer
uggugaauguguaccuguucucc

SEQ ID NO: 66346 - RNA, 23 nt, Artificial Sequence
  RNA Oligomer
guggugaauguguaccuguucuc

SEQ ID NO: 66347 - RNA, 23 nt, Artificial Sequence
  RNA Oligomer
uguggugaauguguaccuguucu

SEQ ID NO: 66348 - RNA, 23 nt, Artificial Sequence
  RNA Oligomer
gguuuggcaagaagguaacguca

SEQ ID NO: 66349 - RNA, 23 nt, Artificial Sequence
  RNA Oligomer
gacauugagacugaguugacacc

SEQ ID NO: 66350 - RNA, 23 nt, Artificial Sequence
  RNA Oligomer
cucagugccuggauuguugcccg

SEQ ID NO: 66351 - RNA, 23 nt, Artificial Sequence
  RNA Oligomer
gcucagugccuggauuguugccc

SEQ ID NO: 66352 - RNA, 23 nt, Artificial Sequence
  RNA Oligomer
ugcucagugccuggauuguugcc

SEQ ID NO: 66353 - RNA, 23 nt, Artificial Sequence
  RNA Oligomer
cugcucagugccuggauuguugc

SEQ ID NO: 66354 - RNA, 23 nt, Artificial Sequence
  RNA Oligomer
ccugcucagugccuggauuguug

SEQ ID NO: 66355 - RNA, 23 nt, Artificial Sequence
  RNA Oligomer
gugugcucccucuguuguucgug

SEQ ID NO: 66356 - RNA, 23 nt, Artificial Sequence
  RNA Oligomer
cgugugcucccucuguuguucgu

SEQ ID NO: 66357 - RNA, 23 nt, Artificial Sequence
  RNA Oligomer
guguugguugaagaugugcggga

SEQ ID NO: 66358 - RNA, 23 nt, Artificial Sequence
  RNA Oligomer
cccagcuuccugcagaaaacacu

SEQ ID NO: 66359 - RNA, 23 nt, Artificial Sequence
  RNA Oligomer
gcccagcuuccugcagaaaacac

SEQ ID NO: 66360 - RNA, 23 nt, Artificial Sequence
  RNA Oligomer
ugcccagcuuccugcagaaaaca

SEQ ID NO: 66361 - RNA, 23 nt, Artificial Sequence
  RNA Oligomer
cugcccagcuuccugcagaaaac

SEQ ID NO: 66362 - RNA, 23 nt, Artificial Sequence
  RNA Oligomer
gcugcccagcuuccugcagaaaa

SEQ ID NO: 66363 - RNA, 23 nt, Artificial Sequence
  RNA Oligomer
ugcuuucagaccuggugagcgug

SEQ ID NO: 66364 - RNA, 23 nt, Artificial Sequence
  RNA Oligomer
gugcuuucagaccuggugagcgu

SEQ ID NO: 66365 - RNA, 23 nt, Artificial Sequence
  RNA Oligomer
cgugcuuucagaccuggugagcg

SEQ ID NO: 66366 - RNA, 23 nt, Artificial Sequence
  RNA Oligomer
acgugcuuucagaccuggugagc

SEQ ID NO: 66367 - RNA, 23 nt, Artificial Sequence
  RNA Oligomer
cacgugcuuucagaccuggugag

SEQ ID NO: 66368 - RNA, 23 nt, Artificial Sequence
  RNA Oligomer
aaguacuaugugugugcaugucu

SEQ ID NO: 66369 - RNA, 23 nt, Artificial Sequence
  RNA Oligomer
agccuucucugauuucccaccuc

SEQ ID NO: 66370 - RNA, 23 nt, Artificial Sequence
  RNA Oligomer
cagccuucucugauuucccaccu

SEQ ID NO: 66371 - RNA, 23 nt, Artificial Sequence
  RNA Oligomer
ucagccuucucugauuucccacc

SEQ ID NO: 66372 - RNA, 23 nt, Artificial Sequence
  RNA Oligomer
cucagccuucucugauuucccac

SEQ ID NO: 66373 - RNA, 23 nt, Artificial Sequence
  RNA Oligomer
ccucagccuucucugauuuccca

SEQ ID NO: 66374 - RNA, 23 nt, Artificial Sequence
  RNA Oligomer
ggugcagcgauuugauggguggu

SEQ ID NO: 66375 - RNA, 23 nt, Artificial Sequence
  RNA Oligomer
aggugcagcgauuugaugggugg

SEQ ID NO: 66376 - RNA, 23 nt, Artificial Sequence
  RNA Oligomer
gaggugcagcgauuugaugggug

SEQ ID NO: 66377 - RNA, 23 nt, Artificial Sequence
  RNA Oligomer
ucugugcacaucuacaucaccca

SEQ ID NO: 66378 - RNA, 23 nt, Artificial Sequence
  RNA Oligomer
accuggucuucaagucauccguc

SEQ ID NO: 66379 - RNA, 23 nt, Artificial Sequence
  RNA Oligomer
gaccuggucuucaagucauccgu

SEQ ID NO: 66380 - RNA, 23 nt, Artificial Sequence
  RNA Oligomer
ccuuuugccuccauccucaaaga

SEQ ID NO: 66381 - RNA, 23 nt, Artificial Sequence
  RNA Oligomer
cccuuuugccuccauccucaaag

SEQ ID NO: 66382 - RNA, 23 nt, Artificial Sequence
  RNA Oligomer
ccccuuuugccuccauccucaaa

SEQ ID NO: 66383 - RNA, 23 nt, Artificial Sequence
  RNA Oligomer
accccuuuugccuccauccucaa

SEQ ID NO: 66384 - RNA, 23 nt, Artificial Sequence
  RNA Oligomer
caccccuuuugccuccauccuca

SEQ ID NO: 66385 - RNA, 23 nt, Artificial Sequence
  RNA Oligomer
agaugugccagauacccaaagcu

SEQ ID NO: 66386 - RNA, 23 nt, Artificial Sequence
  RNA Oligomer
cagaugugccagauacccaaagc

SEQ ID NO: 66387 - RNA, 23 nt, Artificial Sequence
  RNA Oligomer
acagaugugccagauacccaaag

SEQ ID NO: 66388 - RNA, 23 nt, Artificial Sequence
  RNA Oligomer
gacagaugugccagauacccaaa

SEQ ID NO: 66389 - RNA, 23 nt, Artificial Sequence
  RNA Oligomer
ugacagaugugccagauacccaa

SEQ ID NO: 66390 - RNA, 23 nt, Artificial Sequence
  RNA Oligomer
ucuauguccugcucaucauccau

SEQ ID NO: 66391 - RNA, 23 nt, Artificial Sequence
  RNA Oligomer
cucuauguccugcucaucaucca

SEQ ID NO: 66392 - RNA, 23 nt, Artificial Sequence
  RNA Oligomer
gcucuauguccugcucaucaucc

SEQ ID NO: 66393 - RNA, 23 nt, Artificial Sequence
  RNA Oligomer
ugcucuauguccugcucaucauc

SEQ ID NO: 66394 - RNA, 23 nt, Artificial Sequence
  RNA Oligomer
cugcucuauguccugcucaucau

SEQ ID NO: 66395 - RNA, 23 nt, Artificial Sequence
  RNA Oligomer
ccaccaccucuacauccugcucu

SEQ ID NO: 66396 - RNA, 23 nt, Artificial Sequence
  RNA Oligomer
ggcggagguuuggcaagaaggua

SEQ ID NO: 66397 - RNA, 23 nt, Artificial Sequence
  RNA Oligomer
cggcggagguuuggcaagaaggu

SEQ ID NO: 66398 - RNA, 23 nt, Artificial Sequence
  RNA Oligomer
ggaacugacaugggaagauuuuc

SEQ ID NO: 66399 - RNA, 23 nt, Artificial Sequence
  RNA Oligomer
aggaacugacaugggaagauuuu

SEQ ID NO: 66400 - RNA, 23 nt, Artificial Sequence
  RNA Oligomer
gaggaacugacaugggaagauuu

SEQ ID NO: 66401 - RNA, 23 nt, Artificial Sequence
  RNA Oligomer
gacaaggaggaacugacauggga

SEQ ID NO: 66402 - RNA, 23 nt, Artificial Sequence
  RNA Oligomer
cuccuggagaccuuuuucaggca

SEQ ID NO: 66403 - RNA, 23 nt, Artificial Sequence
  RNA Oligomer
ccuccuggagaccuuuuucaggc

SEQ ID NO: 66404 - RNA, 23 nt, Artificial Sequence
  RNA Oligomer
accuccuggagaccuuuuucagg

SEQ ID NO: 66405 - RNA, 23 nt, Artificial Sequence
  RNA Oligomer
caccuccuggagaccuuuuucag

SEQ ID NO: 66406 - RNA, 23 nt, Artificial Sequence
  RNA Oligomer
gcaccuccuggagaccuuuuuca

SEQ ID NO: 66407 - RNA, 23 nt, Artificial Sequence
  RNA Oligomer
ggaccauguguugguugaagaug

SEQ ID NO: 66408 - RNA, 23 nt, Artificial Sequence
  RNA Oligomer
aggaccauguguugguugaagau

SEQ ID NO: 66409 - RNA, 23 nt, Artificial Sequence
  RNA Oligomer
gaggaccauguguugguugaaga

SEQ ID NO: 66410 - RNA, 23 nt, Artificial Sequence
  RNA Oligomer
agaggaccauguguugguugaag

SEQ ID NO: 66411 - RNA, 23 nt, Artificial Sequence
  RNA Oligomer
gagaggaccauguguugguugaa

SEQ ID NO: 66412 - RNA, 23 nt, Artificial Sequence
  RNA Oligomer
ucaagugucuccagagcucuccg

SEQ ID NO: 66413 - RNA, 23 nt, Artificial Sequence
  RNA Oligomer
cucaagugucuccagagcucucc

SEQ ID NO: 66414 - RNA, 23 nt, Artificial Sequence
  RNA Oligomer
acucaagugucuccagagcucuc

SEQ ID NO: 66415 - RNA, 23 nt, Artificial Sequence
  RNA Oligomer
aacucaagugucuccagagcucu

SEQ ID NO: 66416 - RNA, 23 nt, Artificial Sequence
  RNA Oligomer
gaacucaagugucuccagagcuc

SEQ ID NO: 66417 - RNA, 23 nt, Artificial Sequence
  RNA Oligomer
gaacaucgcuguguaugaguggc

SEQ ID NO: 66418 - RNA, 23 nt, Artificial Sequence
  RNA Oligomer
agaacaucgcuguguaugagugg

SEQ ID NO: 66419 - RNA, 23 nt, Artificial Sequence
  RNA Oligomer
cagaacaucgcuguguaugagug

SEQ ID NO: 66420 - RNA, 23 nt, Artificial Sequence
  RNA Oligomer
ccagaacaucgcuguguaugagu

SEQ ID NO: 66421 - RNA, 23 nt, Artificial Sequence
  RNA Oligomer
accagaacaucgcuguguaugag

SEQ ID NO: 66422 - RNA, 23 nt, Artificial Sequence
  RNA Oligomer
acaaccucauggagcacagaugg

SEQ ID NO: 66423 - RNA, 23 nt, Artificial Sequence
  RNA Oligomer
aacaaccucauggagcacagaug

SEQ ID NO: 66424 - RNA, 23 nt, Artificial Sequence
  RNA Oligomer
caacaaccucauggagcacagau

SEQ ID NO: 66425 - RNA, 23 nt, Artificial Sequence
  RNA Oligomer
acaacaaccucauggagcacaga

SEQ ID NO: 66426 - RNA, 23 nt, Artificial Sequence
  RNA Oligomer
uacaacaaccucauggagcacag

SEQ ID NO: 66427 - RNA, 23 nt, Artificial Sequence
  RNA Oligomer
cucuguucuuccuauuucuggcu

SEQ ID NO: 66428 - RNA, 23 nt, Artificial Sequence
  RNA Oligomer
uggagaucagcguggugaaggcg

SEQ ID NO: 66429 - RNA, 23 nt, Artificial Sequence
  RNA Oligomer
guggagaucagcguggugaaggc

SEQ ID NO: 66430 - RNA, 23 nt, Artificial Sequence
  RNA Oligomer
gguggagaucagcguggugaagg

SEQ ID NO: 66431 - RNA, 23 nt, Artificial Sequence
  RNA Oligomer
agguggagaucagcguggugaag

SEQ ID NO: 66432 - RNA, 23 nt, Artificial Sequence
  RNA Oligomer
aagguggagaucagcguggugaa

SEQ ID NO: 66433 - RNA, 23 nt, Artificial Sequence
  RNA Oligomer
gcgugugcucccucuguuguucg

SEQ ID NO: 66434 - RNA, 23 nt, Artificial Sequence
  RNA Oligomer
agcgugugcucccucuguuguuc

SEQ ID NO: 66435 - RNA, 23 nt, Artificial Sequence
  RNA Oligomer
cagcgugugcucccucuguuguu

SEQ ID NO: 66436 - RNA, 23 nt, Artificial Sequence
  RNA Oligomer
cuccaagaaggagauugaagaaa

SEQ ID NO: 66437 - RNA, 23 nt, Artificial Sequence
  RNA Oligomer
ucuccaagaaggagauugaagaa

SEQ ID NO: 66438 - RNA, 23 nt, Artificial Sequence
  RNA Oligomer
uucuccaagaaggagauugaaga

SEQ ID NO: 66439 - RNA, 23 nt, Artificial Sequence
  RNA Oligomer
ucgcuguguaugaguggcugccc

SEQ ID NO: 66440 - RNA, 23 nt, Artificial Sequence
  RNA Oligomer
aucgcuguguaugaguggcugcc

SEQ ID NO: 66441 - RNA, 23 nt, Artificial Sequence
  RNA Oligomer
caucgcuguguaugaguggcugc

SEQ ID NO: 66442 - RNA, 23 nt, Artificial Sequence
  RNA Oligomer
acaucgcuguguaugaguggcug

SEQ ID NO: 66443 - RNA, 23 nt, Artificial Sequence
  RNA Oligomer
aacaucgcuguguaugaguggcu

SEQ ID NO: 66444 - RNA, 23 nt, Artificial Sequence
  RNA Oligomer
cuaauuucacccaagguuuuaag

SEQ ID NO: 66445 - RNA, 23 nt, Artificial Sequence
  RNA Oligomer
acuaauuucacccaagguuuuaa

SEQ ID NO: 66446 - RNA, 23 nt, Artificial Sequence
  RNA Oligomer
aacuaauuucacccaagguuuua

SEQ ID NO: 66447 - RNA, 23 nt, Artificial Sequence
  RNA Oligomer
guaagaagaucuacuucaucugg

SEQ ID NO: 66448 - RNA, 23 nt, Artificial Sequence
  RNA Oligomer
uguaagaagaucuacuucaucug

SEQ ID NO: 66449 - RNA, 23 nt, Artificial Sequence
  RNA Oligomer
cuguaagaagaucuacuucaucu

SEQ ID NO: 66450 - RNA, 23 nt, Artificial Sequence
  RNA Oligomer
ucuguaagaagaucuacuucauc

SEQ ID NO: 66451 - RNA, 23 nt, Artificial Sequence
  RNA Oligomer
uucuguaagaagaucuacuucau

SEQ ID NO: 66452 - RNA, 23 nt, Artificial Sequence
  RNA Oligomer
ucagcugccaaguguucuguaag

SEQ ID NO: 66453 - RNA, 23 nt, Artificial Sequence
  RNA Oligomer
gucagcugccaaguguucuguaa

SEQ ID NO: 66454 - RNA, 23 nt, Artificial Sequence
  RNA Oligomer
ggaagaagguggagaucagcgug

SEQ ID NO: 66455 - RNA, 23 nt, Artificial Sequence
  RNA Oligomer
cggaagaagguggagaucagcgu

SEQ ID NO: 66456 - RNA, 23 nt, Artificial Sequence
  RNA Oligomer
ccggaagaagguggagaucagcg

SEQ ID NO: 66457 - RNA, 23 nt, Artificial Sequence
  RNA Oligomer
gccggaagaagguggagaucagc

SEQ ID NO: 66458 - RNA, 23 nt, Artificial Sequence
  RNA Oligomer
agccggaagaagguggagaucag

SEQ ID NO: 66459 - RNA, 23 nt, Artificial Sequence
  RNA Oligomer
gcacucugcugcucaagaucccc

SEQ ID NO: 66460 - RNA, 23 nt, Artificial Sequence
  RNA Oligomer
cgcacucugcugcucaagauccc

SEQ ID NO: 66461 - RNA, 23 nt, Artificial Sequence
  RNA Oligomer
ccgcacucugcugcucaagaucc

SEQ ID NO: 66462 - RNA, 23 nt, Artificial Sequence
  RNA Oligomer
gccgcacucugcugcucaagauc

SEQ ID NO: 66463 - RNA, 23 nt, Artificial Sequence
  RNA Oligomer
cgccgcacucugcugcucaagau

SEQ ID NO: 66464 - RNA, 23 nt, Artificial Sequence
  RNA Oligomer
cccuguacaaccaggacuuaucc

SEQ ID NO: 66465 - RNA, 23 nt, Artificial Sequence
  RNA Oligomer
gcccuguacaaccaggacuuauc

SEQ ID NO: 66466 - RNA, 23 nt, Artificial Sequence
  RNA Oligomer
ugcccuguacaaccaggacuuau

SEQ ID NO: 66467 - RNA, 23 nt, Artificial Sequence
  RNA Oligomer
cugcccuguacaaccaggacuua

SEQ ID NO: 66468 - RNA, 23 nt, Artificial Sequence
  RNA Oligomer
gcugcccuguacaaccaggacuu

SEQ ID NO: 66469 - RNA, 23 nt, Artificial Sequence
  RNA Oligomer
ccagcuuccugcagaaaacacuc

SEQ ID NO: 66470 - RNA, 23 nt, Artificial Sequence
  RNA Oligomer
gcacguucuuucaucagacccug

SEQ ID NO: 66471 - RNA, 23 nt, Artificial Sequence
  RNA Oligomer
agcacguucuuucaucagacccu

SEQ ID NO: 66472 - RNA, 23 nt, Artificial Sequence
  RNA Oligomer
aagcacguucuuucaucagaccc

SEQ ID NO: 66473 - RNA, 23 nt, Artificial Sequence
  RNA Oligomer
uaagcacguucuuucaucagacc

SEQ ID NO: 66474 - RNA, 23 nt, Artificial Sequence
  RNA Oligomer
uuaagcacguucuuucaucagac

SEQ ID NO: 66475 - RNA, 23 nt, Artificial Sequence
  RNA Oligomer
ccccagggcuuugaguacaaguc

SEQ ID NO: 66476 - RNA, 23 nt, Artificial Sequence
  RNA Oligomer
gccccagggcuuugaguacaagu

SEQ ID NO: 66477 - RNA, 23 nt, Artificial Sequence
  RNA Oligomer
ggccccagggcuuugaguacaag

SEQ ID NO: 66478 - RNA, 23 nt, Artificial Sequence
  RNA Oligomer
auguccugcucaucauccauggu

SEQ ID NO: 66479 - RNA, 23 nt, Artificial Sequence
  RNA Oligomer
uauguccugcucaucauccaugg

SEQ ID NO: 66480 - RNA, 23 nt, Artificial Sequence
  RNA Oligomer
cuauguccugcucaucauccaug

SEQ ID NO: 66481 - RNA, 23 nt, Artificial Sequence
  RNA Oligomer
ugugggccauguggugaaugugu

SEQ ID NO: 66482 - RNA, 23 nt, Artificial Sequence
  RNA Oligomer
gugugggccauguggugaaugug

SEQ ID NO: 66483 - RNA, 23 nt, Artificial Sequence
  RNA Oligomer
agugugggccauguggugaaugu

SEQ ID NO: 66484 - RNA, 23 nt, Artificial Sequence
  RNA Oligomer
cagugugggccauguggugaaug

SEQ ID NO: 66485 - RNA, 23 nt, Artificial Sequence
  RNA Oligomer
acagugugggccauguggugaau

SEQ ID NO: 66486 - RNA, 23 nt, Artificial Sequence
  RNA Oligomer
ggacuuccaucgccucauugccu

SEQ ID NO: 66487 - RNA, 23 nt, Artificial Sequence
  RNA Oligomer
uggacuuccaucgccucauugcc

SEQ ID NO: 66488 - RNA, 23 nt, Artificial Sequence
  RNA Oligomer
guggacuuccaucgccucauugc

SEQ ID NO: 66489 - RNA, 23 nt, Artificial Sequence
  RNA Oligomer
cguggacuuccaucgccucauug

SEQ ID NO: 66490 - RNA, 23 nt, Artificial Sequence
  RNA Oligomer
ccguggacuuccaucgccucauu

SEQ ID NO: 66491 - RNA, 23 nt, Artificial Sequence
  RNA Oligomer
gcaauggcuaccuguccuuccga

SEQ ID NO: 66492 - RNA, 23 nt, Artificial Sequence
  RNA Oligomer
ggcaauggcuaccuguccuuccg

SEQ ID NO: 66493 - RNA, 23 nt, Artificial Sequence
  RNA Oligomer
uggcaauggcuaccuguccuucc

SEQ ID NO: 66494 - RNA, 23 nt, Artificial Sequence
  RNA Oligomer
auggcaauggcuaccuguccuuc

SEQ ID NO: 66495 - RNA, 23 nt, Artificial Sequence
  RNA Oligomer
gauggcaauggcuaccuguccuu

SEQ ID NO: 66496 - RNA, 23 nt, Artificial Sequence
  RNA Oligomer
ccggcuccggaugagaaauuuca

SEQ ID NO: 66497 - RNA, 23 nt, Artificial Sequence
  RNA Oligomer
cccggcuccggaugagaaauuuc

SEQ ID NO: 66498 - RNA, 23 nt, Artificial Sequence
  RNA Oligomer
gcccggcuccggaugagaaauuu

SEQ ID NO: 66499 - RNA, 23 nt, Artificial Sequence
  RNA Oligomer
ugcccggcuccggaugagaaauu

SEQ ID NO: 66500 - RNA, 23 nt, Artificial Sequence
  RNA Oligomer
cguccuugaacaauuugugcggc

SEQ ID NO: 66501 - RNA, 23 nt, Artificial Sequence
  RNA Oligomer
ucguccuugaacaauuugugcgg

SEQ ID NO: 66502 - RNA, 23 nt, Artificial Sequence
  RNA Oligomer
aucguccuugaacaauuugugcg

SEQ ID NO: 66503 - RNA, 23 nt, Artificial Sequence
  RNA Oligomer
caucguccuugaacaauuugugc

SEQ ID NO: 66504 - RNA, 23 nt, Artificial Sequence
  RNA Oligomer
ccauggcaagccauuuacagaaa

SEQ ID NO: 66505 - RNA, 23 nt, Artificial Sequence
  RNA Oligomer
ugcuggcaucuuagaacccuccc

SEQ ID NO: 66506 - RNA, 23 nt, Artificial Sequence
  RNA Oligomer
augcuggcaucuuagaacccucc

SEQ ID NO: 66507 - RNA, 23 nt, Artificial Sequence
  RNA Oligomer
gaugcuggcaucuuagaacccuc

SEQ ID NO: 66508 - RNA, 23 nt, Artificial Sequence
  RNA Oligomer
ggaugcuggcaucuuagaacccu

SEQ ID NO: 66509 - RNA, 23 nt, Artificial Sequence
  RNA Oligomer
gucuagggacuagagugagaagu

SEQ ID NO: 66510 - RNA, 23 nt, Artificial Sequence
  RNA Oligomer
ugucuagggacuagagugagaag

SEQ ID NO: 66511 - RNA, 23 nt, Artificial Sequence
  RNA Oligomer
gugucuagggacuagagugagaa

SEQ ID NO: 66512 - RNA, 23 nt, Artificial Sequence
  RNA Oligomer
gccucagccuucucugauuuccc

SEQ ID NO: 66513 - RNA, 23 nt, Artificial Sequence
  RNA Oligomer
ugccucagccuucucugauuucc

SEQ ID NO: 66514 - RNA, 23 nt, Artificial Sequence
  RNA Oligomer
cugccucagccuucucugauuuc

SEQ ID NO: 66515 - RNA, 23 nt, Artificial Sequence
  RNA Oligomer
gcugccucagccuucucugauuu

SEQ ID NO: 66516 - RNA, 23 nt, Artificial Sequence
  RNA Oligomer
ggcugccucagccuucucugauu

SEQ ID NO: 66517 - RNA, 23 nt, Artificial Sequence
  RNA Oligomer
aggccugucagcucaucaacagg

SEQ ID NO: 66518 - RNA, 23 nt, Artificial Sequence
  RNA Oligomer
aaggccugucagcucaucaacag

SEQ ID NO: 66519 - RNA, 23 nt, Artificial Sequence
  RNA Oligomer
aaaggccugucagcucaucaaca

SEQ ID NO: 66520 - RNA, 23 nt, Artificial Sequence
  RNA Oligomer
aaaaggccugucagcucaucaac

SEQ ID NO: 66521 - RNA, 23 nt, Artificial Sequence
  RNA Oligomer
gaaaaggccugucagcucaucaa

SEQ ID NO: 66522 - RNA, 23 nt, Artificial Sequence
  RNA Oligomer
ugagauccuucaucgagaucucc

SEQ ID NO: 66523 - RNA, 23 nt, Artificial Sequence
  RNA Oligomer
cugagauccuucaucgagaucuc

SEQ ID NO: 66524 - RNA, 23 nt, Artificial Sequence
  RNA Oligomer
gcugagauccuucaucgagaucu

SEQ ID NO: 66525 - RNA, 23 nt, Artificial Sequence
  RNA Oligomer
ugcugagauccuucaucgagauc

SEQ ID NO: 66526 - RNA, 23 nt, Artificial Sequence
  RNA Oligomer
augcugagauccuucaucgagau

SEQ ID NO: 66527 - RNA, 23 nt, Artificial Sequence
  RNA Oligomer
uggccucauuuccaaggaugagu

SEQ ID NO: 66528 - RNA, 23 nt, Artificial Sequence
  RNA Oligomer
auggccucauuuccaaggaugag

SEQ ID NO: 66529 - RNA, 23 nt, Artificial Sequence
  RNA Oligomer
aauggccucauuuccaaggauga

SEQ ID NO: 66530 - RNA, 23 nt, Artificial Sequence
  RNA Oligomer
gaauggccucauuuccaaggaug

SEQ ID NO: 66531 - RNA, 23 nt, Artificial Sequence
  RNA Oligomer
ggaauggccucauuuccaaggau

SEQ ID NO: 66532 - RNA, 23 nt, Artificial Sequence
  RNA Oligomer
cagcaccaucguccuugaacaau

SEQ ID NO: 66533 - RNA, 23 nt, Artificial Sequence
  RNA Oligomer
ucagcaccaucguccuugaacaa

SEQ ID NO: 66534 - RNA, 23 nt, Artificial Sequence
  RNA Oligomer
uucagcaccaucguccuugaaca

SEQ ID NO: 66535 - RNA, 23 nt, Artificial Sequence
  RNA Oligomer
ccauguguugguugaagaugugc

SEQ ID NO: 66536 - RNA, 23 nt, Artificial Sequence
  RNA Oligomer
accauguguugguugaagaugug

SEQ ID NO: 66537 - RNA, 23 nt, Artificial Sequence
  RNA Oligomer
gaccauguguugguugaagaugu

SEQ ID NO: 66538 - RNA, 23 nt, Artificial Sequence
  RNA Oligomer
ugagcacccaagccuacaaagug

SEQ ID NO: 66539 - RNA, 23 nt, Artificial Sequence
  RNA Oligomer
gugagcacccaagccuacaaagu

SEQ ID NO: 66540 - RNA, 23 nt, Artificial Sequence
  RNA Oligomer
cgugagcacccaagccuacaaag

SEQ ID NO: 66541 - RNA, 23 nt, Artificial Sequence
  RNA Oligomer
ccgugagcacccaagccuacaaa

SEQ ID NO: 66542 - RNA, 23 nt, Artificial Sequence
  RNA Oligomer
gccgugagcacccaagccuacaa

SEQ ID NO: 66543 - RNA, 23 nt, Artificial Sequence
  RNA Oligomer
cuggcccaauaccuauguaugca

SEQ ID NO: 66544 - RNA, 23 nt, Artificial Sequence
  RNA Oligomer
acccauggcaagccauuuacaga

SEQ ID NO: 66545 - RNA, 23 nt, Artificial Sequence
  RNA Oligomer
gacccauggcaagccauuuacag

SEQ ID NO: 66546 - RNA, 23 nt, Artificial Sequence
  RNA Oligomer
ggacccauggcaagccauuuaca

SEQ ID NO: 66547 - RNA, 23 nt, Artificial Sequence
  RNA Oligomer
uggacccauggcaagccauuuac

SEQ ID NO: 66548 - RNA, 23 nt, Artificial Sequence
  RNA Oligomer
cuggacccauggcaagccauuua

SEQ ID NO: 66549 - RNA, 23 nt, Artificial Sequence
  RNA Oligomer
cuaugcagauggcguguaccagc

SEQ ID NO: 66550 - RNA, 23 nt, Artificial Sequence
  RNA Oligomer
gcauggaugcuggcaucuuagaa

SEQ ID NO: 66551 - RNA, 23 nt, Artificial Sequence
  RNA Oligomer
agcauggaugcuggcaucuuaga

SEQ ID NO: 66552 - RNA, 23 nt, Artificial Sequence
  RNA Oligomer
gagcauggaugcuggcaucuuag

SEQ ID NO: 66553 - RNA, 23 nt, Artificial Sequence
  RNA Oligomer
ggagcauggaugcuggcaucuua

SEQ ID NO: 66554 - RNA, 23 nt, Artificial Sequence
  RNA Oligomer
gggagcauggaugcuggcaucuu

SEQ ID NO: 66555 - RNA, 23 nt, Artificial Sequence
  RNA Oligomer
ggugguacaacaaccucauggag

SEQ ID NO: 66556 - RNA, 23 nt, Artificial Sequence
  RNA Oligomer
gggugguacaacaaccucaugga

SEQ ID NO: 66557 - RNA, 23 nt, Artificial Sequence
  RNA Oligomer
ugggugguacaacaaccucaugg

SEQ ID NO: 66558 - RNA, 23 nt, Artificial Sequence
  RNA Oligomer
augggugguacaacaaccucaug

SEQ ID NO: 66559 - RNA, 23 nt, Artificial Sequence
  RNA Oligomer
gaugggugguacaacaaccucau

SEQ ID NO: 66560 - RNA, 23 nt, Artificial Sequence
  RNA Oligomer
uucucccaccauuaugagaacuu

SEQ ID NO: 66561 - RNA, 23 nt, Artificial Sequence
  RNA Oligomer
aaguuugaggugucaguguuagu

SEQ ID NO: 66562 - RNA, 23 nt, Artificial Sequence
  RNA Oligomer
uaaguuugaggugucaguguuag

SEQ ID NO: 66563 - RNA, 23 nt, Artificial Sequence
  RNA Oligomer
auaaguuugaggugucaguguua

SEQ ID NO: 66564 - RNA, 23 nt, Artificial Sequence
  RNA Oligomer
cauaaguuugaggugucaguguu

SEQ ID NO: 66565 - RNA, 23 nt, Artificial Sequence
  RNA Oligomer
ugauggaccauuuggagagggcc

SEQ ID NO: 66566 - RNA, 23 nt, Artificial Sequence
  RNA Oligomer
uugauggaccauuuggagagggc

SEQ ID NO: 66567 - RNA, 23 nt, Artificial Sequence
  RNA Oligomer
cuugauggaccauuuggagaggg

SEQ ID NO: 66568 - RNA, 23 nt, Artificial Sequence
  RNA Oligomer
ccuugauggaccauuuggagagg

SEQ ID NO: 66569 - RNA, 23 nt, Artificial Sequence
  RNA Oligomer
accuugauggaccauuuggagag

SEQ ID NO: 66570 - RNA, 23 nt, Artificial Sequence
  RNA Oligomer
gcacagcagccagcaucucuuuc

SEQ ID NO: 66571 - RNA, 23 nt, Artificial Sequence
  RNA Oligomer
ggcacagcagccagcaucucuuu

SEQ ID NO: 66572 - RNA, 23 nt, Artificial Sequence
  RNA Oligomer
gggcacagcagccagcaucucuu

SEQ ID NO: 66573 - RNA, 23 nt, Artificial Sequence
  RNA Oligomer
ucaucgagaucuccaacaacugc

SEQ ID NO: 66574 - RNA, 23 nt, Artificial Sequence
  RNA Oligomer
uucaucgagaucuccaacaacug

SEQ ID NO: 66575 - RNA, 23 nt, Artificial Sequence
  RNA Oligomer
cuucaucgagaucuccaacaacu

SEQ ID NO: 66576 - RNA, 23 nt, Artificial Sequence
  RNA Oligomer
acauccugguggucuucaugaaa

SEQ ID NO: 66577 - RNA, 23 nt, Artificial Sequence
  RNA Oligomer
cuccacagaaggucaacuucguc

SEQ ID NO: 66578 - RNA, 23 nt, Artificial Sequence
  RNA Oligomer
ccuccacagaaggucaacuucgu

SEQ ID NO: 66579 - RNA, 23 nt, Artificial Sequence
  RNA Oligomer
gccuccacagaaggucaacuucg

SEQ ID NO: 66580 - RNA, 23 nt, Artificial Sequence
  RNA Oligomer
agccuccacagaaggucaacuuc

SEQ ID NO: 66581 - RNA, 23 nt, Artificial Sequence
  RNA Oligomer
cagccuccacagaaggucaacuu

SEQ ID NO: 66582 - RNA, 23 nt, Artificial Sequence
  RNA Oligomer
uggaauggcaaggccacaaggag

SEQ ID NO: 66583 - RNA, 23 nt, Artificial Sequence
  RNA Oligomer
uuggaauggcaaggccacaagga

SEQ ID NO: 66584 - RNA, 23 nt, Artificial Sequence
  RNA Oligomer
uuuggaauggcaaggccacaagg

SEQ ID NO: 66585 - RNA, 23 nt, Artificial Sequence
  RNA Oligomer
cuuuggaauggcaaggccacaag

SEQ ID NO: 66586 - RNA, 23 nt, Artificial Sequence
  RNA Oligomer
gcuuuggaauggcaaggccacaa

SEQ ID NO: 66587 - RNA, 23 nt, Artificial Sequence
  RNA Oligomer
ggucgcuguuaucaacauugacc

SEQ ID NO: 66588 - RNA, 23 nt, Artificial Sequence
  RNA Oligomer
uggucgcuguuaucaacauugac

SEQ ID NO: 66589 - RNA, 23 nt, Artificial Sequence
  RNA Oligomer
cuggucgcuguuaucaacauuga

SEQ ID NO: 66590 - RNA, 23 nt, Artificial Sequence
  RNA Oligomer
gcuggucgcuguuaucaacauug

SEQ ID NO: 66591 - RNA, 23 nt, Artificial Sequence
  RNA Oligomer
ugcuggucgcuguuaucaacauu

SEQ ID NO: 66592 - RNA, 23 nt, Artificial Sequence
  RNA Oligomer
aaggagauugaagaaauccgaaa

SEQ ID NO: 66593 - RNA, 23 nt, Artificial Sequence
  RNA Oligomer
gaaggagauugaagaaauccgaa

SEQ ID NO: 66594 - RNA, 23 nt, Artificial Sequence
  RNA Oligomer
guucagcaccaucguccuugaac

SEQ ID NO: 66595 - RNA, 23 nt, Artificial Sequence
  RNA Oligomer
uguucagcaccaucguccuugaa

SEQ ID NO: 66596 - RNA, 23 nt, Artificial Sequence
  RNA Oligomer
cuguucagcaccaucguccuuga

SEQ ID NO: 66597 - RNA, 23 nt, Artificial Sequence
  RNA Oligomer
cgagaggaccauguguugguuga

SEQ ID NO: 66598 - RNA, 23 nt, Artificial Sequence
  RNA Oligomer
ccagcaucuccucagaguucgug

SEQ ID NO: 66599 - RNA, 23 nt, Artificial Sequence
  RNA Oligomer
cccagcaucuccucagaguucgu

SEQ ID NO: 66600 - RNA, 23 nt, Artificial Sequence
  RNA Oligomer
ccccagcaucuccucagaguucg

SEQ ID NO: 66601 - RNA, 23 nt, Artificial Sequence
  RNA Oligomer
accccagcaucuccucagaguuc

SEQ ID NO: 66602 - RNA, 23 nt, Artificial Sequence
  RNA Oligomer
gaccccagcaucuccucagaguu

SEQ ID NO: 66603 - RNA, 23 nt, Artificial Sequence
  RNA Oligomer
ccuggcccaauaccuauguaugc

SEQ ID NO: 66604 - RNA, 23 nt, Artificial Sequence
  RNA Oligomer
cccuggcccaauaccuauguaug

SEQ ID NO: 66605 - RNA, 23 nt, Artificial Sequence
  RNA Oligomer
acccuggcccaauaccuauguau

SEQ ID NO: 66606 - RNA, 23 nt, Artificial Sequence
  RNA Oligomer
gacccuggcccaauaccuaugua

SEQ ID NO: 66607 - RNA, 23 nt, Artificial Sequence
  RNA Oligomer
gaccuuagcaacaccaucucaag

SEQ ID NO: 66608 - RNA, 23 nt, Artificial Sequence
  RNA Oligomer
agaccuuagcaacaccaucucaa

SEQ ID NO: 66609 - RNA, 23 nt, Artificial Sequence
  RNA Oligomer
gagaccuuagcaacaccaucuca

SEQ ID NO: 66610 - RNA, 23 nt, Artificial Sequence
  RNA Oligomer
cccauggcaagccauuuacagaa

SEQ ID NO: 66611 - RNA, 23 nt, Artificial Sequence
  RNA Oligomer
ugugugugcaugucuguaugugu

SEQ ID NO: 66612 - RNA, 23 nt, Artificial Sequence
  RNA Oligomer
augugugugcaugucuguaugug

SEQ ID NO: 66613 - RNA, 23 nt, Artificial Sequence
  RNA Oligomer
ccacuaugcuguacaucugugag

SEQ ID NO: 66614 - RNA, 23 nt, Artificial Sequence
  RNA Oligomer
accacuaugcuguacaucuguga

SEQ ID NO: 66615 - RNA, 23 nt, Artificial Sequence
  RNA Oligomer
gaccacuaugcuguacaucugug

SEQ ID NO: 66616 - RNA, 23 nt, Artificial Sequence
  RNA Oligomer
cccguuuccacaucuucuuccug

SEQ ID NO: 66617 - RNA, 23 nt, Artificial Sequence
  RNA Oligomer
ccccguuuccacaucuucuuccu

SEQ ID NO: 66618 - RNA, 23 nt, Artificial Sequence
  RNA Oligomer
gccccguuuccacaucuucuucc

SEQ ID NO: 66619 - RNA, 23 nt, Artificial Sequence
  RNA Oligomer
ugccccguuuccacaucuucuuc

SEQ ID NO: 66620 - RNA, 23 nt, Artificial Sequence
  RNA Oligomer
cugccccguuuccacaucuucuu

SEQ ID NO: 66621 - RNA, 23 nt, Artificial Sequence
  RNA Oligomer
gcgagaaaccuuccucaaccgcu

SEQ ID NO: 66622 - RNA, 23 nt, Artificial Sequence
  RNA Oligomer
ugcgagaaaccuuccucaaccgc

SEQ ID NO: 66623 - RNA, 23 nt, Artificial Sequence
  RNA Oligomer
cugcgagaaaccuuccucaaccg

SEQ ID NO: 66624 - RNA, 23 nt, Artificial Sequence
  RNA Oligomer
ccugcgagaaaccuuccucaacc

SEQ ID NO: 66625 - RNA, 23 nt, Artificial Sequence
  RNA Oligomer
uccugcgagaaaccuuccucaac

SEQ ID NO: 66626 - RNA, 23 nt, Artificial Sequence
  RNA Oligomer
ggaagauuuucacuucaugcugc

SEQ ID NO: 66627 - RNA, 23 nt, Artificial Sequence
  RNA Oligomer
ccaacaacugccuguccaaggcc

SEQ ID NO: 66628 - RNA, 23 nt, Artificial Sequence
  RNA Oligomer
uccaacaacugccuguccaaggc

SEQ ID NO: 66629 - RNA, 23 nt, Artificial Sequence
  RNA Oligomer
cuccaacaacugccuguccaagg

SEQ ID NO: 66630 - RNA, 23 nt, Artificial Sequence
  RNA Oligomer
ucuccaacaacugccuguccaag

SEQ ID NO: 66631 - RNA, 23 nt, Artificial Sequence
  RNA Oligomer
aucuccaacaacugccuguccaa

SEQ ID NO: 66632 - RNA, 23 nt, Artificial Sequence
  RNA Oligomer
ccaaggaugaguucaucaggaug

SEQ ID NO: 66633 - RNA, 23 nt, Artificial Sequence
  RNA Oligomer
uccaaggaugaguucaucaggau

SEQ ID NO: 66634 - RNA, 23 nt, Artificial Sequence
  RNA Oligomer
uuccaaggaugaguucaucagga

SEQ ID NO: 66635 - RNA, 23 nt, Artificial Sequence
  RNA Oligomer
uuuccaaggaugaguucaucagg

SEQ ID NO: 66636 - RNA, 23 nt, Artificial Sequence
  RNA Oligomer
auuuccaaggaugaguucaucag

SEQ ID NO: 66637 - RNA, 23 nt, Artificial Sequence
  RNA Oligomer
acgugcuggucgcuguuaucaac

SEQ ID NO: 66638 - RNA, 23 nt, Artificial Sequence
  RNA Oligomer
gacgugcuggucgcuguuaucaa

SEQ ID NO: 66639 - RNA, 23 nt, Artificial Sequence
  RNA Oligomer
ggacgugcuggucgcuguuauca

SEQ ID NO: 66640 - RNA, 23 nt, Artificial Sequence
  RNA Oligomer
aggacgugcuggucgcuguuauc

SEQ ID NO: 66641 - RNA, 23 nt, Artificial Sequence
  RNA Oligomer
caggacgugcuggucgcuguuau

SEQ ID NO: 66642 - RNA, 23 nt, Artificial Sequence
  RNA Oligomer
cuuagcaacaccaucucaagggg

SEQ ID NO: 66643 - RNA, 23 nt, Artificial Sequence
  RNA Oligomer
ccuuagcaacaccaucucaaggg

SEQ ID NO: 66644 - RNA, 23 nt, Artificial Sequence
  RNA Oligomer
accuuagcaacaccaucucaagg

SEQ ID NO: 66645 - RNA, 23 nt, Artificial Sequence
  RNA Oligomer
uaugugugugcaugucuguaugu

SEQ ID NO: 66646 - RNA, 23 nt, Artificial Sequence
  RNA Oligomer
guucuguaagaagaucuacuuca

SEQ ID NO: 66647 - RNA, 23 nt, Artificial Sequence
  RNA Oligomer
ccaccaggaguggcauaaguuug

SEQ ID NO: 66648 - RNA, 23 nt, Artificial Sequence
  RNA Oligomer
gccaccaggaguggcauaaguuu

SEQ ID NO: 66649 - RNA, 23 nt, Artificial Sequence
  RNA Oligomer
gagccggaagaagguggagauca

SEQ ID NO: 66650 - RNA, 23 nt, Artificial Sequence
  RNA Oligomer
ggucuccauuuugggacauucua

SEQ ID NO: 66651 - RNA, 23 nt, Artificial Sequence
  RNA Oligomer
gggucuccauuuugggacauucu

SEQ ID NO: 66652 - RNA, 23 nt, Artificial Sequence
  RNA Oligomer
agggucuccauuuugggacauuc

SEQ ID NO: 66653 - RNA, 23 nt, Artificial Sequence
  RNA Oligomer
aagggucuccauuuugggacauu

SEQ ID NO: 66654 - RNA, 23 nt, Artificial Sequence
  RNA Oligomer
agccaggauaugaucugucccuc

SEQ ID NO: 66655 - RNA, 23 nt, Artificial Sequence
  RNA Oligomer
cagccaggauaugaucugucccu

SEQ ID NO: 66656 - RNA, 23 nt, Artificial Sequence
  RNA Oligomer
ucagccaggauaugaucuguccc

SEQ ID NO: 66657 - RNA, 23 nt, Artificial Sequence
  RNA Oligomer
aucagccaggauaugaucugucc

SEQ ID NO: 66658 - RNA, 23 nt, Artificial Sequence
  RNA Oligomer
ggaugcugagauccuucaucgag

SEQ ID NO: 66659 - RNA, 23 nt, Artificial Sequence
  RNA Oligomer
aggaugcugagauccuucaucga

SEQ ID NO: 66660 - RNA, 23 nt, Artificial Sequence
  RNA Oligomer
caggaugcugagauccuucaucg

SEQ ID NO: 66661 - RNA, 23 nt, Artificial Sequence
  RNA Oligomer
ucaggaugcugagauccuucauc

SEQ ID NO: 66662 - RNA, 23 nt, Artificial Sequence
  RNA Oligomer
aucaggaugcugagauccuucau

SEQ ID NO: 66663 - RNA, 23 nt, Artificial Sequence
  RNA Oligomer
gggaauggccucauuuccaagga

SEQ ID NO: 66664 - RNA, 23 nt, Artificial Sequence
  RNA Oligomer
ugggaauggccucauuuccaagg

SEQ ID NO: 66665 - RNA, 23 nt, Artificial Sequence
  RNA Oligomer
augggaauggccucauuuccaag

SEQ ID NO: 66666 - RNA, 23 nt, Artificial Sequence
  RNA Oligomer
gaugggaauggccucauuuccaa

SEQ ID NO: 66667 - RNA, 23 nt, Artificial Sequence
  RNA Oligomer
ccaggacuuauccuggcuagagc

SEQ ID NO: 66668 - RNA, 23 nt, Artificial Sequence
  RNA Oligomer
accaggacuuauccuggcuagag

SEQ ID NO: 66669 - RNA, 23 nt, Artificial Sequence
  RNA Oligomer
aaccaggacuuauccuggcuaga

SEQ ID NO: 66670 - RNA, 23 nt, Artificial Sequence
  RNA Oligomer
caaccaggacuuauccuggcuag

SEQ ID NO: 66671 - RNA, 23 nt, Artificial Sequence
  RNA Oligomer
acaaccaggacuuauccuggcua

SEQ ID NO: 66672 - RNA, 23 nt, Artificial Sequence
  RNA Oligomer
ggaacucaagugucuccagagcu

SEQ ID NO: 66673 - RNA, 23 nt, Artificial Sequence
  RNA Oligomer
cggaacucaagugucuccagagc

SEQ ID NO: 66674 - RNA, 23 nt, Artificial Sequence
  RNA Oligomer
ucggaacucaagugucuccagag

SEQ ID NO: 66675 - RNA, 23 nt, Artificial Sequence
  RNA Oligomer
aucggaacucaagugucuccaga

SEQ ID NO: 66676 - RNA, 23 nt, Artificial Sequence
  RNA Oligomer
ucaaucggaacucaagugucucc

SEQ ID NO: 66677 - RNA, 23 nt, Artificial Sequence
  RNA Oligomer
aucaaucggaacucaagugucuc

SEQ ID NO: 66678 - RNA, 23 nt, Artificial Sequence
  RNA Oligomer
caucaaucggaacucaagugucu

SEQ ID NO: 66679 - RNA, 23 nt, Artificial Sequence
  RNA Oligomer
ucaucaaucggaacucaaguguc

SEQ ID NO: 66680 - RNA, 23 nt, Artificial Sequence
  RNA Oligomer
caguagucucccuuccaaauaaa

SEQ ID NO: 66681 - RNA, 23 nt, Artificial Sequence
  RNA Oligomer
uuuaagcacguucuuucaucaga

SEQ ID NO: 66682 - RNA, 23 nt, Artificial Sequence
  RNA Oligomer
cauggaugcuggcaucuuagaac

SEQ ID NO: 66683 - RNA, 23 nt, Artificial Sequence
  RNA Oligomer
guacaacaaccucauggagcaca

SEQ ID NO: 66684 - RNA, 23 nt, Artificial Sequence
  RNA Oligomer
gguacaacaaccucauggagcac

SEQ ID NO: 66685 - RNA, 23 nt, Artificial Sequence
  RNA Oligomer
ugguacaacaaccucauggagca

SEQ ID NO: 66686 - RNA, 23 nt, Artificial Sequence
  RNA Oligomer
ucagaaacaaaucucagaagaca

SEQ ID NO: 66687 - RNA, 23 nt, Artificial Sequence
  RNA Oligomer
uucagaaacaaaucucagaagac

SEQ ID NO: 66688 - RNA, 23 nt, Artificial Sequence
  RNA Oligomer
cuucagaaacaaaucucagaaga

SEQ ID NO: 66689 - RNA, 23 nt, Artificial Sequence
  RNA Oligomer
acuucagaaacaaaucucagaag

SEQ ID NO: 66690 - RNA, 23 nt, Artificial Sequence
  RNA Oligomer
gacuucagaaacaaaucucagaa

SEQ ID NO: 66691 - RNA, 23 nt, Artificial Sequence
  RNA Oligomer
ugaugggugguacaacaaccuca

SEQ ID NO: 66692 - RNA, 23 nt, Artificial Sequence
  RNA Oligomer
acaucugugagcggcacuuccag

SEQ ID NO: 66693 - RNA, 23 nt, Artificial Sequence
  RNA Oligomer
uacaucugugagcggcacuucca

SEQ ID NO: 66694 - RNA, 23 nt, Artificial Sequence
  RNA Oligomer
guacaucugugagcggcacuucc

SEQ ID NO: 66695 - RNA, 23 nt, Artificial Sequence
  RNA Oligomer
uguacaucugugagcggcacuuc

SEQ ID NO: 66696 - RNA, 23 nt, Artificial Sequence
  RNA Oligomer
cuguacaucugugagcggcacuu

SEQ ID NO: 66697 - RNA, 23 nt, Artificial Sequence
  RNA Oligomer
uuccugcgagaaaccuuccucaa

SEQ ID NO: 66698 - RNA, 23 nt, Artificial Sequence
  RNA Oligomer
ucaucaccuuccugcgagaaacc

SEQ ID NO: 66699 - RNA, 23 nt, Artificial Sequence
  RNA Oligomer
cucaucaccuuccugcgagaaac

SEQ ID NO: 66700 - RNA, 23 nt, Artificial Sequence
  RNA Oligomer
ccucaucaccuuccugcgagaaa

SEQ ID NO: 66701 - RNA, 23 nt, Artificial Sequence
  RNA Oligomer
accucaucaccuuccugcgagaa

SEQ ID NO: 66702 - RNA, 23 nt, Artificial Sequence
  RNA Oligomer
aaccucaucaccuuccugcgaga

SEQ ID NO: 66703 - RNA, 23 nt, Artificial Sequence
  RNA Oligomer
ucauguucuccuacaucuugcuc

SEQ ID NO: 66704 - RNA, 23 nt, Artificial Sequence
  RNA Oligomer
uucauguucuccuacaucuugcu

SEQ ID NO: 66705 - RNA, 23 nt, Artificial Sequence
  RNA Oligomer
uuucauguucuccuacaucuugc

SEQ ID NO: 66706 - RNA, 23 nt, Artificial Sequence
  RNA Oligomer
cuuucauguucuccuacaucuug

SEQ ID NO: 66707 - RNA, 23 nt, Artificial Sequence
  RNA Oligomer
gaagggucuccauuuugggacau

SEQ ID NO: 66708 - RNA, 23 nt, Artificial Sequence
  RNA Oligomer
agcgcuucauugagaacuaccgg

SEQ ID NO: 66709 - RNA, 23 nt, Artificial Sequence
  RNA Oligomer
aagcgcuucauugagaacuaccg

SEQ ID NO: 66710 - RNA, 23 nt, Artificial Sequence
  RNA Oligomer
caagcgcuucauugagaacuacc

SEQ ID NO: 66711 - RNA, 23 nt, Artificial Sequence
  RNA Oligomer
caaggaguaugaccuggugcugc

SEQ ID NO: 66712 - RNA, 23 nt, Artificial Sequence
  RNA Oligomer
ccaaggaguaugaccuggugcug

SEQ ID NO: 66713 - RNA, 23 nt, Artificial Sequence
  RNA Oligomer
cccaaggaguaugaccuggugcu

SEQ ID NO: 66714 - RNA, 23 nt, Artificial Sequence
  RNA Oligomer
ccccaaggaguaugaccuggugc

SEQ ID NO: 66715 - RNA, 23 nt, Artificial Sequence
  RNA Oligomer
uccccaaggaguaugaccuggug

SEQ ID NO: 66716 - RNA, 23 nt, Artificial Sequence
  RNA Oligomer
cacagaaggucaacuucguccug

SEQ ID NO: 66717 - RNA, 23 nt, Artificial Sequence
  RNA Oligomer
ccacagaaggucaacuucguccu

SEQ ID NO: 66718 - RNA, 23 nt, Artificial Sequence
  RNA Oligomer
uccacagaaggucaacuucgucc

SEQ ID NO: 66719 - RNA, 23 nt, Artificial Sequence
  RNA Oligomer
aggcauggaagcuuuggaauggc

SEQ ID NO: 66720 - RNA, 23 nt, Artificial Sequence
  RNA Oligomer
gaggcauggaagcuuuggaaugg

SEQ ID NO: 66721 - RNA, 23 nt, Artificial Sequence
  RNA Oligomer
ggaggcauggaagcuuuggaaug

SEQ ID NO: 66722 - RNA, 23 nt, Artificial Sequence
  RNA Oligomer
gggaggcauggaagcuuuggaau

SEQ ID NO: 66723 - RNA, 23 nt, Artificial Sequence
  RNA Oligomer
ugggaggcauggaagcuuuggaa

SEQ ID NO: 66724 - RNA, 23 nt, Artificial Sequence
  RNA Oligomer
gguuugagaacaccaggaauggg

SEQ ID NO: 66725 - RNA, 23 nt, Artificial Sequence
  RNA Oligomer
ugguuugagaacaccaggaaugg

SEQ ID NO: 66726 - RNA, 23 nt, Artificial Sequence
  RNA Oligomer
cugguuugagaacaccaggaaug

SEQ ID NO: 66727 - RNA, 23 nt, Artificial Sequence
  RNA Oligomer
acugguuugagaacaccaggaau

SEQ ID NO: 66728 - RNA, 23 nt, Artificial Sequence
  RNA Oligomer
uacugguuugagaacaccaggaa

SEQ ID NO: 66729 - RNA, 23 nt, Artificial Sequence
  RNA Oligomer
ugaccgcuacugguuugagaaca

SEQ ID NO: 66730 - RNA, 23 nt, Artificial Sequence
  RNA Oligomer
ccuguacaaccaggacuuauccu

SEQ ID NO: 66731 - RNA, 23 nt, Artificial Sequence
  RNA Oligomer
cugggcuugucucccauuacccg

SEQ ID NO: 66732 - RNA, 23 nt, Artificial Sequence
  RNA Oligomer
acugggcuugucucccauuaccc

SEQ ID NO: 66733 - RNA, 23 nt, Artificial Sequence
  RNA Oligomer
cacugggcuugucucccauuacc

SEQ ID NO: 66734 - RNA, 23 nt, Artificial Sequence
  RNA Oligomer
gcacugggcuugucucccauuac

SEQ ID NO: 66735 - RNA, 23 nt, Artificial Sequence
  RNA Oligomer
agcacugggcuugucucccauua

SEQ ID NO: 66736 - RNA, 23 nt, Artificial Sequence
  RNA Oligomer
gcgagaggaccauguguugguug

SEQ ID NO: 66737 - RNA, 23 nt, Artificial Sequence
  RNA Oligomer
ugcugaagauguggaugcacugc

SEQ ID NO: 66738 - RNA, 23 nt, Artificial Sequence
  RNA Oligomer
gugcugaagauguggaugcacug

SEQ ID NO: 66739 - RNA, 23 nt, Artificial Sequence
  RNA Oligomer
agugcugaagauguggaugcacu

SEQ ID NO: 66740 - RNA, 23 nt, Artificial Sequence
  RNA Oligomer
aagugcugaagauguggaugcac

SEQ ID NO: 66741 - RNA, 23 nt, Artificial Sequence
  RNA Oligomer
aaagugcugaagauguggaugca

SEQ ID NO: 66742 - RNA, 23 nt, Artificial Sequence
  RNA Oligomer
agaaaacacucccggaguauaca

SEQ ID NO: 66743 - RNA, 23 nt, Artificial Sequence
  RNA Oligomer
cagaaaacacucccggaguauac

SEQ ID NO: 66744 - RNA, 23 nt, Artificial Sequence
  RNA Oligomer
gcagaaaacacucccggaguaua

SEQ ID NO: 66745 - RNA, 23 nt, Artificial Sequence
  RNA Oligomer
ugcagaaaacacucccggaguau

SEQ ID NO: 66746 - RNA, 23 nt, Artificial Sequence
  RNA Oligomer
cugcagaaaacacucccggagua

SEQ ID NO: 66747 - RNA, 23 nt, Artificial Sequence
  RNA Oligomer
agacccuggcccaauaccuaugu

SEQ ID NO: 66748 - RNA, 23 nt, Artificial Sequence
  RNA Oligomer
agacuucagaaacaaaucucaga

SEQ ID NO: 66749 - RNA, 23 nt, Artificial Sequence
  RNA Oligomer
cagacuucagaaacaaaucucag

SEQ ID NO: 66750 - RNA, 23 nt, Artificial Sequence
  RNA Oligomer
ccauagucagucaccaugugugg

SEQ ID NO: 66751 - RNA, 23 nt, Artificial Sequence
  RNA Oligomer
gccauagucagucaccaugugug

SEQ ID NO: 66752 - RNA, 23 nt, Artificial Sequence
  RNA Oligomer
ggccauagucagucaccaugugu

SEQ ID NO: 66753 - RNA, 23 nt, Artificial Sequence
  RNA Oligomer
uggccauagucagucaccaugug

SEQ ID NO: 66754 - RNA, 23 nt, Artificial Sequence
  RNA Oligomer
guggccauagucagucaccaugu

SEQ ID NO: 66755 - RNA, 23 nt, Artificial Sequence
  RNA Oligomer
gguggccauagucagucaccaug

SEQ ID NO: 66756 - RNA, 23 nt, Artificial Sequence
  RNA Oligomer
cccuuugagcccuucuucaacuc

SEQ ID NO: 66757 - RNA, 23 nt, Artificial Sequence
  RNA Oligomer
ccccuuugagcccuucuucaacu

SEQ ID NO: 66758 - RNA, 23 nt, Artificial Sequence
  RNA Oligomer
cccccuuugagcccuucuucaac

SEQ ID NO: 66759 - RNA, 23 nt, Artificial Sequence
  RNA Oligomer
ccccccuuugagcccuucuucaa

SEQ ID NO: 66760 - RNA, 23 nt, Artificial Sequence
  RNA Oligomer
uccccccuuugagcccuucuuca

SEQ ID NO: 66761 - RNA, 23 nt, Artificial Sequence
  RNA Oligomer
cuaugcuguacaucugugagcgg

SEQ ID NO: 66762 - RNA, 23 nt, Artificial Sequence
  RNA Oligomer
acuaugcuguacaucugugagcg

SEQ ID NO: 66763 - RNA, 23 nt, Artificial Sequence
  RNA Oligomer
cacuaugcuguacaucugugagc

SEQ ID NO: 66764 - RNA, 23 nt, Artificial Sequence
  RNA Oligomer
gagagguggaggagaaugaccac

SEQ ID NO: 66765 - RNA, 23 nt, Artificial Sequence
  RNA Oligomer
cgagagguggaggagaaugacca

SEQ ID NO: 66766 - RNA, 23 nt, Artificial Sequence
  RNA Oligomer
ccgagagguggaggagaaugacc

SEQ ID NO: 66767 - RNA, 23 nt, Artificial Sequence
  RNA Oligomer
uccgagagguggaggagaaugac

SEQ ID NO: 66768 - RNA, 23 nt, Artificial Sequence
  RNA Oligomer
auccgagagguggaggagaauga

SEQ ID NO: 66769 - RNA, 23 nt, Artificial Sequence
  RNA Oligomer
cgucagcugccaaguguucugua

SEQ ID NO: 66770 - RNA, 23 nt, Artificial Sequence
  RNA Oligomer
cccccagaaguauuacugguggu

SEQ ID NO: 66771 - RNA, 23 nt, Artificial Sequence
  RNA Oligomer
ucccccagaaguauuacuggugg

SEQ ID NO: 66772 - RNA, 23 nt, Artificial Sequence
  RNA Oligomer
cucccccagaaguauuacuggug

SEQ ID NO: 66773 - RNA, 23 nt, Artificial Sequence
  RNA Oligomer
ggacauucuaaucccugagcccc

SEQ ID NO: 66774 - RNA, 23 nt, Artificial Sequence
  RNA Oligomer
gggacauucuaaucccugagccc

SEQ ID NO: 66775 - RNA, 23 nt, Artificial Sequence
  RNA Oligomer
ugggacauucuaaucccugagcc

SEQ ID NO: 66776 - RNA, 23 nt, Artificial Sequence
  RNA Oligomer
uugggacauucuaaucccugagc

SEQ ID NO: 66777 - RNA, 23 nt, Artificial Sequence
  RNA Oligomer
uuugggacauucuaaucccugag

SEQ ID NO: 66778 - RNA, 23 nt, Artificial Sequence
  RNA Oligomer
gugggccauguggugaaugugua

SEQ ID NO: 66779 - RNA, 23 nt, Artificial Sequence
  RNA Oligomer
gccuacuacuacgccuuugccgc

SEQ ID NO: 66780 - RNA, 23 nt, Artificial Sequence
  RNA Oligomer
ggccuacuacuacgccuuugccg

SEQ ID NO: 66781 - RNA, 23 nt, Artificial Sequence
  RNA Oligomer
gggccuacuacuacgccuuugcc

SEQ ID NO: 66782 - RNA, 23 nt, Artificial Sequence
  RNA Oligomer
agggccuacuacuacgccuuugc

SEQ ID NO: 66783 - RNA, 23 nt, Artificial Sequence
  RNA Oligomer
gagggccuacuacuacgccuuug

SEQ ID NO: 66784 - RNA, 23 nt, Artificial Sequence
  RNA Oligomer
agagggccuacuacuacgccuuu

SEQ ID NO: 66785 - RNA, 23 nt, Artificial Sequence
  RNA Oligomer
caucagccaggauaugaucuguc

SEQ ID NO: 66786 - RNA, 23 nt, Artificial Sequence
  RNA Oligomer
ugccugaagucaucaaggaccuc

SEQ ID NO: 66787 - RNA, 23 nt, Artificial Sequence
  RNA Oligomer
gugccugaagucaucaaggaccu

SEQ ID NO: 66788 - RNA, 23 nt, Artificial Sequence
  RNA Oligomer
ggugccugaagucaucaaggacc

SEQ ID NO: 66789 - RNA, 23 nt, Artificial Sequence
  RNA Oligomer
aggugccugaagucaucaaggac

SEQ ID NO: 66790 - RNA, 23 nt, Artificial Sequence
  RNA Oligomer
gaggugccugaagucaucaagga

SEQ ID NO: 66791 - RNA, 23 nt, Artificial Sequence
  RNA Oligomer
gucucgccuuauguuccgcaugu

SEQ ID NO: 66792 - RNA, 23 nt, Artificial Sequence
  RNA Oligomer
uccugaggaaaagucucgccuua

SEQ ID NO: 66793 - RNA, 23 nt, Artificial Sequence
  RNA Oligomer
auccccaaggaguaugaccuggu

SEQ ID NO: 66794 - RNA, 23 nt, Artificial Sequence
  RNA Oligomer
gcagccuccacagaaggucaacu

SEQ ID NO: 66795 - RNA, 23 nt, Artificial Sequence
  RNA Oligomer
ugcagccuccacagaaggucaac

SEQ ID NO: 66796 - RNA, 23 nt, Artificial Sequence
  RNA Oligomer
cugcagccuccacagaaggucaa

SEQ ID NO: 66797 - RNA, 23 nt, Artificial Sequence
  RNA Oligomer
gccugcucagugccuggauuguu

SEQ ID NO: 66798 - RNA, 23 nt, Artificial Sequence
  RNA Oligomer
gucgcuguuaucaacauugaccc

SEQ ID NO: 66799 - RNA, 23 nt, Artificial Sequence
  RNA Oligomer
gagcacccaagccuacaaagugc

SEQ ID NO: 66800 - RNA, 23 nt, Artificial Sequence
  RNA Oligomer
aaucggaacucaagugucuccag

SEQ ID NO: 66801 - RNA, 23 nt, Artificial Sequence
  RNA Oligomer
caaucggaacucaagugucucca

SEQ ID NO: 66802 - RNA, 23 nt, Artificial Sequence
  RNA Oligomer
uaccagaacaucgcuguguauga

SEQ ID NO: 66803 - RNA, 23 nt, Artificial Sequence
  RNA Oligomer
cuaccagaacaucgcuguguaug

SEQ ID NO: 66804 - RNA, 23 nt, Artificial Sequence
  RNA Oligomer
ccuaccagaacaucgcuguguau

SEQ ID NO: 66805 - RNA, 23 nt, Artificial Sequence
  RNA Oligomer
accuaccagaacaucgcugugua

SEQ ID NO: 66806 - RNA, 23 nt, Artificial Sequence
  RNA Oligomer
cguucuuucaucagacccuggcc

SEQ ID NO: 66807 - RNA, 23 nt, Artificial Sequence
  RNA Oligomer
acguucuuucaucagacccuggc

SEQ ID NO: 66808 - RNA, 23 nt, Artificial Sequence
  RNA Oligomer
cacguucuuucaucagacccugg

SEQ ID NO: 66809 - RNA, 23 nt, Artificial Sequence
  RNA Oligomer
caucuuagaacccucccuacucc

SEQ ID NO: 66810 - RNA, 23 nt, Artificial Sequence
  RNA Oligomer
agaaacaaaucucagaagacaag

SEQ ID NO: 66811 - RNA, 23 nt, Artificial Sequence
  RNA Oligomer
cagaaacaaaucucagaagacaa

SEQ ID NO: 66812 - RNA, 23 nt, Artificial Sequence
  RNA Oligomer
aggaccaggaugugucucagccu

SEQ ID NO: 66813 - RNA, 23 nt, Artificial Sequence
  RNA Oligomer
caggaccaggaugugucucagcc

SEQ ID NO: 66814 - RNA, 23 nt, Artificial Sequence
  RNA Oligomer
ccaggaccaggaugugucucagc

SEQ ID NO: 66815 - RNA, 23 nt, Artificial Sequence
  RNA Oligomer
cccaggaccaggaugugucucag

SEQ ID NO: 66816 - RNA, 23 nt, Artificial Sequence
  RNA Oligomer
ccccaggaccaggaugugucuca

SEQ ID NO: 66817 - RNA, 23 nt, Artificial Sequence
  RNA Oligomer
uccuauuucuggcugccucagcc

SEQ ID NO: 66818 - RNA, 23 nt, Artificial Sequence
  RNA Oligomer
uuccuauuucuggcugccucagc

SEQ ID NO: 66819 - RNA, 23 nt, Artificial Sequence
  RNA Oligomer
cuuccuauuucuggcugccucag

SEQ ID NO: 66820 - RNA, 23 nt, Artificial Sequence
  RNA Oligomer
ucuuccuauuucuggcugccuca

SEQ ID NO: 66821 - RNA, 23 nt, Artificial Sequence
  RNA Oligomer
uucuuccuauuucuggcugccuc

SEQ ID NO: 66822 - RNA, 23 nt, Artificial Sequence
  RNA Oligomer
ccugucagcucaucaacaggcag

SEQ ID NO: 66823 - RNA, 23 nt, Artificial Sequence
  RNA Oligomer
gccugucagcucaucaacaggca

SEQ ID NO: 66824 - RNA, 23 nt, Artificial Sequence
  RNA Oligomer
ggccugucagcucaucaacaggc

SEQ ID NO: 66825 - RNA, 23 nt, Artificial Sequence
  RNA Oligomer
ugaccaagaauguggaaaaggcc

SEQ ID NO: 66826 - RNA, 23 nt, Artificial Sequence
  RNA Oligomer
augaccaagaauguggaaaaggc

SEQ ID NO: 66827 - RNA, 23 nt, Artificial Sequence
  RNA Oligomer
caugaccaagaauguggaaaagg

SEQ ID NO: 66828 - RNA, 23 nt, Artificial Sequence
  RNA Oligomer
gcaugaccaagaauguggaaaag

SEQ ID NO: 66829 - RNA, 23 nt, Artificial Sequence
  RNA Oligomer
ggcaugaccaagaauguggaaaa

SEQ ID NO: 66830 - RNA, 23 nt, Artificial Sequence
  RNA Oligomer
ucaaagaccuggucuucaaguca

SEQ ID NO: 66831 - RNA, 23 nt, Artificial Sequence
  RNA Oligomer
cucaaagaccuggucuucaaguc

SEQ ID NO: 66832 - RNA, 23 nt, Artificial Sequence
  RNA Oligomer
ccucaaagaccuggucuucaagu

SEQ ID NO: 66833 - RNA, 23 nt, Artificial Sequence
  RNA Oligomer
uccucaaagaccuggucuucaag

SEQ ID NO: 66834 - RNA, 23 nt, Artificial Sequence
  RNA Oligomer
auccucaaagaccuggucuucaa

SEQ ID NO: 66835 - RNA, 23 nt, Artificial Sequence
  RNA Oligomer
gcucuagcauggacacuucuggu

SEQ ID NO: 66836 - RNA, 23 nt, Artificial Sequence
  RNA Oligomer
ggcucuagcauggacacuucugg

SEQ ID NO: 66837 - RNA, 23 nt, Artificial Sequence
  RNA Oligomer
uggcucuagcauggacacuucug

SEQ ID NO: 66838 - RNA, 23 nt, Artificial Sequence
  RNA Oligomer
cuggcucuagcauggacacuucu

SEQ ID NO: 66839 - RNA, 23 nt, Artificial Sequence
  RNA Oligomer
ccuggcucuagcauggacacuuc

SEQ ID NO: 66840 - RNA, 23 nt, Artificial Sequence
  RNA Oligomer
gccuggcucuagcauggacacuu

SEQ ID NO: 66841 - RNA, 23 nt, Artificial Sequence
  RNA Oligomer
aagcuguaccuugauggaccauu

SEQ ID NO: 66842 - RNA, 23 nt, Artificial Sequence
  RNA Oligomer
aaagcuguaccuugauggaccau

SEQ ID NO: 66843 - RNA, 23 nt, Artificial Sequence
  RNA Oligomer
caaagcuguaccuugauggacca

SEQ ID NO: 66844 - RNA, 23 nt, Artificial Sequence
  RNA Oligomer
ccaaagcuguaccuugauggacc

SEQ ID NO: 66845 - RNA, 23 nt, Artificial Sequence
  RNA Oligomer
cccaaagcuguaccuugauggac

SEQ ID NO: 66846 - RNA, 23 nt, Artificial Sequence
  RNA Oligomer
acccaaagcuguaccuugaugga

SEQ ID NO: 66847 - RNA, 23 nt, Artificial Sequence
  RNA Oligomer
uacccaaagcuguaccuugaugg

SEQ ID NO: 66848 - RNA, 23 nt, Artificial Sequence
  RNA Oligomer
auacccaaagcuguaccuugaug

SEQ ID NO: 66849 - RNA, 23 nt, Artificial Sequence
  RNA Oligomer
uuuugggacauucuaaucccuga

SEQ ID NO: 66850 - RNA, 23 nt, Artificial Sequence
  RNA Oligomer
gcgcuucauugagaacuaccggc

SEQ ID NO: 66851 - RNA, 23 nt, Artificial Sequence
  RNA Oligomer
ugaagggucuccauuuugggaca

SEQ ID NO: 66852 - RNA, 23 nt, Artificial Sequence
  RNA Oligomer
acggugcaacaguucaagcgcuu

SEQ ID NO: 66853 - RNA, 23 nt, Artificial Sequence
  RNA Oligomer
acaucagccaggauaugaucugu

SEQ ID NO: 66854 - RNA, 23 nt, Artificial Sequence
  RNA Oligomer
uacaucagccaggauaugaucug

SEQ ID NO: 66855 - RNA, 23 nt, Artificial Sequence
  RNA Oligomer
cuacaucagccaggauaugaucu

SEQ ID NO: 66856 - RNA, 23 nt, Artificial Sequence
  RNA Oligomer
ccuacaucagccaggauaugauc

SEQ ID NO: 66857 - RNA, 23 nt, Artificial Sequence
  RNA Oligomer
uccuacaucagccaggauaugau

SEQ ID NO: 66858 - RNA, 23 nt, Artificial Sequence
  RNA Oligomer
acaauagcgagcuccgcuucacg

SEQ ID NO: 66859 - RNA, 23 nt, Artificial Sequence
  RNA Oligomer
cacaauagcgagcuccgcuucac

SEQ ID NO: 66860 - RNA, 23 nt, Artificial Sequence
  RNA Oligomer
ccacaauagcgagcuccgcuuca

SEQ ID NO: 66861 - RNA, 23 nt, Artificial Sequence
  RNA Oligomer
accacaauagcgagcuccgcuuc

SEQ ID NO: 66862 - RNA, 23 nt, Artificial Sequence
  RNA Oligomer
gaccacaauagcgagcuccgcuu

SEQ ID NO: 66863 - RNA, 23 nt, Artificial Sequence
  RNA Oligomer
uguuccgcauguacgacuuugau

SEQ ID NO: 66864 - RNA, 23 nt, Artificial Sequence
  RNA Oligomer
gaaaggcucuccugaggaaaagu

SEQ ID NO: 66865 - RNA, 23 nt, Artificial Sequence
  RNA Oligomer
ugaaaggcucuccugaggaaaag

SEQ ID NO: 66866 - RNA, 23 nt, Artificial Sequence
  RNA Oligomer
augaaaggcucuccugaggaaaa

SEQ ID NO: 66867 - RNA, 23 nt, Artificial Sequence
  RNA Oligomer
caugaaaggcucuccugaggaaa

SEQ ID NO: 66868 - RNA, 23 nt, Artificial Sequence
  RNA Oligomer
ucaugaaaggcucuccugaggaa

SEQ ID NO: 66869 - RNA, 23 nt, Artificial Sequence
  RNA Oligomer
ggaaugggcuguucuccaagaag

SEQ ID NO: 66870 - RNA, 23 nt, Artificial Sequence
  RNA Oligomer
aggaaugggcuguucuccaagaa

SEQ ID NO: 66871 - RNA, 23 nt, Artificial Sequence
  RNA Oligomer
caggaaugggcuguucuccaaga

SEQ ID NO: 66872 - RNA, 23 nt, Artificial Sequence
  RNA Oligomer
ccaggaaugggcuguucuccaag

SEQ ID NO: 66873 - RNA, 23 nt, Artificial Sequence
  RNA Oligomer
accaggaaugggcuguucuccaa

SEQ ID NO: 66874 - RNA, 23 nt, Artificial Sequence
  RNA Oligomer
gcaucuccucagaguucguggcg

SEQ ID NO: 66875 - RNA, 23 nt, Artificial Sequence
  RNA Oligomer
agcaucuccucagaguucguggc

SEQ ID NO: 66876 - RNA, 23 nt, Artificial Sequence
  RNA Oligomer
cagcaucuccucagaguucgugg

SEQ ID NO: 66877 - RNA, 23 nt, Artificial Sequence
  RNA Oligomer
ggaguauacaggauaccggccau

SEQ ID NO: 66878 - RNA, 23 nt, Artificial Sequence
  RNA Oligomer
cggaguauacaggauaccggcca

SEQ ID NO: 66879 - RNA, 23 nt, Artificial Sequence
  RNA Oligomer
ccggaguauacaggauaccggcc

SEQ ID NO: 66880 - RNA, 23 nt, Artificial Sequence
  RNA Oligomer
cccggaguauacaggauaccggc

SEQ ID NO: 66881 - RNA, 23 nt, Artificial Sequence
  RNA Oligomer
ucccggaguauacaggauaccgg

SEQ ID NO: 66882 - RNA, 23 nt, Artificial Sequence
  RNA Oligomer
cucccggaguauacaggauaccg

SEQ ID NO: 66883 - RNA, 23 nt, Artificial Sequence
  RNA Oligomer
acucccggaguauacaggauacc

SEQ ID NO: 66884 - RNA, 23 nt, Artificial Sequence
  RNA Oligomer
cacucccggaguauacaggauac

SEQ ID NO: 66885 - RNA, 23 nt, Artificial Sequence
  RNA Oligomer
agcgccaucuaugguuccucgca

SEQ ID NO: 66886 - RNA, 23 nt, Artificial Sequence
  RNA Oligomer
cgccgaguuccucaacauucgca

SEQ ID NO: 66887 - RNA, 23 nt, Artificial Sequence
  RNA Oligomer
ccgccgaguuccucaacauucgc

SEQ ID NO: 66888 - RNA, 23 nt, Artificial Sequence
  RNA Oligomer
cccgccgaguuccucaacauucg

SEQ ID NO: 66889 - RNA, 23 nt, Artificial Sequence
  RNA Oligomer
ccccgccgaguuccucaacauuc

SEQ ID NO: 66890 - RNA, 23 nt, Artificial Sequence
  RNA Oligomer
gccccgccgaguuccucaacauu

SEQ ID NO: 66891 - RNA, 23 nt, Artificial Sequence
  RNA Oligomer
uuucacccaagguuuuaagcacg

SEQ ID NO: 66892 - RNA, 23 nt, Artificial Sequence
  RNA Oligomer
auuucacccaagguuuuaagcac

SEQ ID NO: 66893 - RNA, 23 nt, Artificial Sequence
  RNA Oligomer
aaccucugcuuccagacuucaga

SEQ ID NO: 66894 - RNA, 23 nt, Artificial Sequence
  RNA Oligomer
aaaccucugcuuccagacuucag

SEQ ID NO: 66895 - RNA, 23 nt, Artificial Sequence
  RNA Oligomer
gaaaccucugcuuccagacuuca

SEQ ID NO: 66896 - RNA, 23 nt, Artificial Sequence
  RNA Oligomer
ugaaaccucugcuuccagacuuc

SEQ ID NO: 66897 - RNA, 23 nt, Artificial Sequence
  RNA Oligomer
gugaaaccucugcuuccagacuu

SEQ ID NO: 66898 - RNA, 23 nt, Artificial Sequence
  RNA Oligomer
ucccaaccuuguuccagguggcc

SEQ ID NO: 66899 - RNA, 23 nt, Artificial Sequence
  RNA Oligomer
cucccaaccuuguuccagguggc

SEQ ID NO: 66900 - RNA, 23 nt, Artificial Sequence
  RNA Oligomer
ccucccaaccuuguuccaggugg

SEQ ID NO: 66901 - RNA, 23 nt, Artificial Sequence
  RNA Oligomer
accucccaaccuuguuccaggug

SEQ ID NO: 66902 - RNA, 23 nt, Artificial Sequence
  RNA Oligomer
caccucccaaccuuguuccaggu

SEQ ID NO: 66903 - RNA, 23 nt, Artificial Sequence
  RNA Oligomer
ggcacuuccagaagguucugaac

SEQ ID NO: 66904 - RNA, 23 nt, Artificial Sequence
  RNA Oligomer
cggcacuuccagaagguucugaa

SEQ ID NO: 66905 - RNA, 23 nt, Artificial Sequence
  RNA Oligomer
gcggcacuuccagaagguucuga

SEQ ID NO: 66906 - RNA, 23 nt, Artificial Sequence
  RNA Oligomer
agcggcacuuccagaagguucug

SEQ ID NO: 66907 - RNA, 23 nt, Artificial Sequence
  RNA Oligomer
gagcggcacuuccagaagguucu

SEQ ID NO: 66908 - RNA, 23 nt, Artificial Sequence
  RNA Oligomer
uggugucugugcacaucuacauc

SEQ ID NO: 66909 - RNA, 23 nt, Artificial Sequence
  RNA Oligomer
cuggugucugugcacaucuacau

SEQ ID NO: 66910 - RNA, 23 nt, Artificial Sequence
  RNA Oligomer
ccuggugucugugcacaucuaca

SEQ ID NO: 66911 - RNA, 23 nt, Artificial Sequence
  RNA Oligomer
accuggugucugugcacaucuac

SEQ ID NO: 66912 - RNA, 23 nt, Artificial Sequence
  RNA Oligomer
gaccuggugucugugcacaucua

SEQ ID NO: 66913 - RNA, 23 nt, Artificial Sequence
  RNA Oligomer
ggccaccaggaguggcauaaguu

SEQ ID NO: 66914 - RNA, 23 nt, Artificial Sequence
  RNA Oligomer
gggccaccaggaguggcauaagu

SEQ ID NO: 66915 - RNA, 23 nt, Artificial Sequence
  RNA Oligomer
gauacccaaagcuguaccuugau

SEQ ID NO: 66916 - RNA, 23 nt, Artificial Sequence
  RNA Oligomer
acacgcuuagccugcacauccgg

SEQ ID NO: 66917 - RNA, 23 nt, Artificial Sequence
  RNA Oligomer
gacacgcuuagccugcacauccg

SEQ ID NO: 66918 - RNA, 23 nt, Artificial Sequence
  RNA Oligomer
ggacacgcuuagccugcacaucc

SEQ ID NO: 66919 - RNA, 23 nt, Artificial Sequence
  RNA Oligomer
aggacacgcuuagccugcacauc

SEQ ID NO: 66920 - RNA, 23 nt, Artificial Sequence
  RNA Oligomer
gaggacacgcuuagccugcacau

SEQ ID NO: 66921 - RNA, 23 nt, Artificial Sequence
  RNA Oligomer
augguagcuuugcccugauccag

SEQ ID NO: 66922 - RNA, 23 nt, Artificial Sequence
  RNA Oligomer
caugguagcuuugcccugaucca

SEQ ID NO: 66923 - RNA, 23 nt, Artificial Sequence
  RNA Oligomer
ccaugguagcuuugcccugaucc

SEQ ID NO: 66924 - RNA, 23 nt, Artificial Sequence
  RNA Oligomer
uccaugguagcuuugcccugauc

SEQ ID NO: 66925 - RNA, 23 nt, Artificial Sequence
  RNA Oligomer
auccaugguagcuuugcccugau

SEQ ID NO: 66926 - RNA, 23 nt, Artificial Sequence
  RNA Oligomer
gccguggacuuccaucgccucau

SEQ ID NO: 66927 - RNA, 23 nt, Artificial Sequence
  RNA Oligomer
ccaccagacggugcaacaguuca

SEQ ID NO: 66928 - RNA, 23 nt, Artificial Sequence
  RNA Oligomer
uccaccagacggugcaacaguuc

SEQ ID NO: 66929 - RNA, 23 nt, Artificial Sequence
  RNA Oligomer
cuccaccagacggugcaacaguu

SEQ ID NO: 66930 - RNA, 23 nt, Artificial Sequence
  RNA Oligomer
caucaggaugcugagauccuuca

SEQ ID NO: 66931 - RNA, 23 nt, Artificial Sequence
  RNA Oligomer
ucaucaggaugcugagauccuuc

SEQ ID NO: 66932 - RNA, 23 nt, Artificial Sequence
  RNA Oligomer
uucaucaggaugcugagauccuu

SEQ ID NO: 66933 - RNA, 23 nt, Artificial Sequence
  RNA Oligomer
ggagaccuuuuucaggcaccuuu

SEQ ID NO: 66934 - RNA, 23 nt, Artificial Sequence
  RNA Oligomer
uggagaccuuuuucaggcaccuu

SEQ ID NO: 66935 - RNA, 23 nt, Artificial Sequence
  RNA Oligomer
cuggagaccuuuuucaggcaccu

SEQ ID NO: 66936 - RNA, 23 nt, Artificial Sequence
  RNA Oligomer
ccuggagaccuuuuucaggcacc

SEQ ID NO: 66937 - RNA, 23 nt, Artificial Sequence
  RNA Oligomer
uccuggagaccuuuuucaggcac

SEQ ID NO: 66938 - RNA, 23 nt, Artificial Sequence
  RNA Oligomer
gugggaggcauggaagcuuugga

SEQ ID NO: 66939 - RNA, 23 nt, Artificial Sequence
  RNA Oligomer
cgugggaggcauggaagcuuugg

SEQ ID NO: 66940 - RNA, 23 nt, Artificial Sequence
  RNA Oligomer
ucgugggaggcauggaagcuuug

SEQ ID NO: 66941 - RNA, 23 nt, Artificial Sequence
  RNA Oligomer
cucgugggaggcauggaagcuuu

SEQ ID NO: 66942 - RNA, 23 nt, Artificial Sequence
  RNA Oligomer
gugcuggucgcuguuaucaacau

SEQ ID NO: 66943 - RNA, 23 nt, Artificial Sequence
  RNA Oligomer
gugaccgcuacugguuugagaac

SEQ ID NO: 66944 - RNA, 23 nt, Artificial Sequence
  RNA Oligomer
cuguacaaccaggacuuauccug

SEQ ID NO: 66945 - RNA, 23 nt, Artificial Sequence
  RNA Oligomer
agauguggaugcacugcugcugg

SEQ ID NO: 66946 - RNA, 23 nt, Artificial Sequence
  RNA Oligomer
aagauguggaugcacugcugcug

SEQ ID NO: 66947 - RNA, 23 nt, Artificial Sequence
  RNA Oligomer
gaagauguggaugcacugcugcu

SEQ ID NO: 66948 - RNA, 23 nt, Artificial Sequence
  RNA Oligomer
ugaagauguggaugcacugcugc

SEQ ID NO: 66949 - RNA, 23 nt, Artificial Sequence
  RNA Oligomer
cugaagauguggaugcacugcug

SEQ ID NO: 66950 - RNA, 23 nt, Artificial Sequence
  RNA Oligomer
cccaagccuacaaagugcugaag

SEQ ID NO: 66951 - RNA, 23 nt, Artificial Sequence
  RNA Oligomer
acccaagccuacaaagugcugaa

SEQ ID NO: 66952 - RNA, 23 nt, Artificial Sequence
  RNA Oligomer
cacccaagccuacaaagugcuga

SEQ ID NO: 66953 - RNA, 23 nt, Artificial Sequence
  RNA Oligomer
gcacccaagccuacaaagugcug

SEQ ID NO: 66954 - RNA, 23 nt, Artificial Sequence
  RNA Oligomer
agcacccaagccuacaaagugcu

SEQ ID NO: 66955 - RNA, 23 nt, Artificial Sequence
  RNA Oligomer
ccgaguuccucaacauucgcauc

SEQ ID NO: 66956 - RNA, 23 nt, Artificial Sequence
  RNA Oligomer
gccgaguuccucaacauucgcau

SEQ ID NO: 66957 - RNA, 23 nt, Artificial Sequence
  RNA Oligomer
agauccccaaggaguaugaccug

SEQ ID NO: 66958 - RNA, 23 nt, Artificial Sequence
  RNA Oligomer
aagauccccaaggaguaugaccu

SEQ ID NO: 66959 - RNA, 23 nt, Artificial Sequence
  RNA Oligomer
caagauccccaaggaguaugacc

SEQ ID NO: 66960 - RNA, 23 nt, Artificial Sequence
  RNA Oligomer
ucaagauccccaaggaguaugac

SEQ ID NO: 66961 - RNA, 23 nt, Artificial Sequence
  RNA Oligomer
cucaagauccccaaggaguauga

SEQ ID NO: 66962 - RNA, 23 nt, Artificial Sequence
  RNA Oligomer
uugccuccauccucaaagaccug

SEQ ID NO: 66963 - RNA, 23 nt, Artificial Sequence
  RNA Oligomer
uuugccuccauccucaaagaccu

SEQ ID NO: 66964 - RNA, 23 nt, Artificial Sequence
  RNA Oligomer
uuuugccuccauccucaaagacc

SEQ ID NO: 66965 - RNA, 23 nt, Artificial Sequence
  RNA Oligomer
cuuuugccuccauccucaaagac

SEQ ID NO: 66966 - RNA, 23 nt, Artificial Sequence
  RNA Oligomer
ccuuuugccuccauccucaaaga

SEQ ID NO: 66967 - RNA, 23 nt, Artificial Sequence
  RNA Oligomer
accgagagaaguuccaacgcagc

SEQ ID NO: 66968 - RNA, 23 nt, Artificial Sequence
  RNA Oligomer
caccgagagaaguuccaacgcag

SEQ ID NO: 66969 - RNA, 23 nt, Artificial Sequence
  RNA Oligomer
gcaccgagagaaguuccaacgca

SEQ ID NO: 66970 - RNA, 23 nt, Artificial Sequence
  RNA Oligomer
cgcaccgagagaaguuccaacgc

SEQ ID NO: 66971 - RNA, 23 nt, Artificial Sequence
  RNA Oligomer
gcgcaccgagagaaguuccaacg

SEQ ID NO: 66972 - RNA, 23 nt, Artificial Sequence
  RNA Oligomer
gaagaaauccgaaauaccacccu

SEQ ID NO: 66973 - RNA, 23 nt, Artificial Sequence
  RNA Oligomer
gaaauccgaaauaccacccugca

SEQ ID NO: 66974 - RNA, 23 nt, Artificial Sequence
  RNA Oligomer
cagucuuacacagugugggccau

SEQ ID NO: 66975 - RNA, 23 nt, Artificial Sequence
  RNA Oligomer
ccuauguaugcaaugcuccucag

SEQ ID NO: 66976 - RNA, 23 nt, Artificial Sequence
  RNA Oligomer
gaguaugaccuggugcugcuguu

SEQ ID NO: 66977 - RNA, 23 nt, Artificial Sequence
  RNA Oligomer
gacuauuuugagggcaguggauu

SEQ ID NO: 66978 - RNA, 23 nt, Artificial Sequence
  RNA Oligomer
caguuugaguggcuggcugacau

SEQ ID NO: 66979 - RNA, 23 nt, Artificial Sequence
  RNA Oligomer
ucaagucauccgucagcugccaa

SEQ ID NO: 66980 - RNA, 23 nt, Artificial Sequence
  RNA Oligomer
cuccugaggaaaagucucgccuu

SEQ ID NO: 66981 - RNA, 23 nt, Artificial Sequence
  RNA Oligomer
acuacuacgccuuugccgcacau

SEQ ID NO: 66982 - RNA, 23 nt, Artificial Sequence
  RNA Oligomer
ggacauccugguggucuucauga

SEQ ID NO: 66983 - RNA, 23 nt, Artificial Sequence
  RNA Oligomer
guccuugaacaauuugugcggcu

SEQ ID NO: 66984 - RNA, 23 nt, Artificial Sequence
  RNA Oligomer
cucuuccaugaugaugggucuga

SEQ ID NO: 66985 - RNA, 23 nt, Artificial Sequence
  RNA Oligomer
ccucuuccaugaugaugggucug

SEQ ID NO: 66986 - RNA, 23 nt, Artificial Sequence
  RNA Oligomer
gaaguucgaccucaggaccacua

SEQ ID NO: 66987 - RNA, 23 nt, Artificial Sequence
  RNA Oligomer
cuauuucuggcugccucagccuu

SEQ ID NO: 66988 - RNA, 23 nt, Artificial Sequence
  RNA Oligomer
agaauguggaaaaggccugucag

SEQ ID NO: 66989 - RNA, 23 nt, Artificial Sequence
  RNA Oligomer
agagaaguuccaacgcagcuguc

SEQ ID NO: 66990 - RNA, 23 nt, Artificial Sequence
  RNA Oligomer
ggcuguucuccaagaaggagauu

SEQ ID NO: 66991 - RNA, 23 nt, Artificial Sequence
  RNA Oligomer
ccucugcuuccagacuucagaaa

SEQ ID NO: 66992 - RNA, 23 nt, Artificial Sequence
  RNA Oligomer
gagaaguuccaacgcagcugucu

SEQ ID NO: 66993 - RNA, 23 nt, Artificial Sequence
  RNA Oligomer
cuacugguuugagaacaccagga

SEQ ID NO: 66994 - RNA, 23 nt, Artificial Sequence
  RNA Oligomer
caaccuuguuccagguggccaua

SEQ ID NO: 66995 - RNA, 23 nt, Artificial Sequence
  RNA Oligomer
gaagguucugaaccggagucuau

SEQ ID NO: 66996 - RNA, 23 nt, Artificial Sequence
  RNA Oligomer
accuuccugcgagaaaccuuccu

SEQ ID NO: 66997 - RNA, 23 nt, Artificial Sequence
  RNA Oligomer
acgucauuccagcccuugcuguu

SEQ ID NO: 66998 - RNA, 23 nt, Artificial Sequence
  RNA Oligomer
agccuccuacaucagccaggaua

SEQ ID NO: 66999 - RNA, 23 nt, Artificial Sequence
  RNA Oligomer
uuauguuccgcauguacgacuuu

SEQ ID NO: 67000 - RNA, 23 nt, Artificial Sequence
  RNA Oligomer
gacauccugguggucuucaugaa

SEQ ID NO: 67001 - RNA, 23 nt, Artificial Sequence
  RNA Oligomer
gccuccuacaucagccaggauau

SEQ ID NO: 67002 - RNA, 23 nt, Artificial Sequence
  RNA Oligomer
ggugaccgcuacugguuugagaa

SEQ ID NO: 67003 - RNA, 23 nt, Artificial Sequence
  RNA Oligomer
cgaguuccucaacauucgcaucc

SEQ ID NO: 67004 - RNA, 23 nt, Artificial Sequence
  RNA Oligomer
gggcaaagugaaaccucugcuuc

SEQ ID NO: 67005 - RNA, 23 nt, Artificial Sequence
  RNA Oligomer
cugauuucccaccucccaaccuu

SEQ ID NO: 67006 - RNA, 23 nt, Artificial Sequence
  RNA Oligomer
cucuguucagcaccaucguccuu

SEQ ID NO: 67007 - RNA, 23 nt, Artificial Sequence
  RNA Oligomer
gcaaaugccuugcaggagguaga

SEQ ID NO: 67008 - RNA, 23 nt, Artificial Sequence
  RNA Oligomer
uggcaaaugccuugcaggaggua

SEQ ID NO: 67009 - RNA, 23 nt, Artificial Sequence
  RNA Oligomer
ggaugugucucagccuggagaaa

SEQ ID NO: 67010 - RNA, 23 nt, Artificial Sequence
  RNA Oligomer
guggaaaaggccugucagcucau

SEQ ID NO: 67011 - RNA, 23 nt, Artificial Sequence
  RNA Oligomer
ccuccuacaucagccaggauaug

SEQ ID NO: 67012 - RNA, 23 nt, Artificial Sequence
  RNA Oligomer
guggaggugccugaagucaucaa

SEQ ID NO: 67013 - RNA, 23 nt, Artificial Sequence
  RNA Oligomer
uggaguccauguucucucuggcu

SEQ ID NO: 67014 - RNA, 23 nt, Artificial Sequence
  RNA Oligomer
agaccuuuuucaggcaccuuuuc

SEQ ID NO: 67015 - RNA, 23 nt, Artificial Sequence
  RNA Oligomer
gugcucugcagcccaaugucuuu

SEQ ID NO: 67016 - RNA, 23 nt, Artificial Sequence
  RNA Oligomer
cuucuuuggcuaucacgugcuuu

SEQ ID NO: 67017 - RNA, 23 nt, Artificial Sequence
  RNA Oligomer
ucuucuuuggcuaucacgugcuu

SEQ ID NO: 67018 - RNA, 23 nt, Artificial Sequence
  RNA Oligomer
agaagguucugaaccggagucua

SEQ ID NO: 67019 - RNA, 23 nt, Artificial Sequence
  RNA Oligomer
agacugaguugacaccucagaga

SEQ ID NO: 67020 - RNA, 23 nt, Artificial Sequence
  RNA Oligomer
ccagauacccaaagcuguaccuu

SEQ ID NO: 67021 - RNA, 23 nt, Artificial Sequence
  RNA Oligomer
uuccuggucccagcaaucaucua

SEQ ID NO: 67022 - RNA, 23 nt, Artificial Sequence
  RNA Oligomer
uuccuggccucuuccaugaugau

SEQ ID NO: 67023 - RNA, 23 nt, Artificial Sequence
  RNA Oligomer
cauguggugaauguguaccuguu

SEQ ID NO: 67024 - RNA, 23 nt, Artificial Sequence
  RNA Oligomer
gccugaagucaucaaggaccucu

SEQ ID NO: 67025 - RNA, 23 nt, Artificial Sequence
  RNA Oligomer
cuuugaugggaauggccucauuu

SEQ ID NO: 67026 - RNA, 23 nt, Artificial Sequence
  RNA Oligomer
acuuugaugggaauggccucauu

SEQ ID NO: 67027 - RNA, 23 nt, Artificial Sequence
  RNA Oligomer
ccacugaaguuuucccgcacaga

SEQ ID NO: 67028 - RNA, 23 nt, Artificial Sequence
  RNA Oligomer
acacucccggaguauacaggaua

SEQ ID NO: 67029 - RNA, 23 nt, Artificial Sequence
  RNA Oligomer
ggaaaaggccugucagcucauca

SEQ ID NO: 67030 - RNA, 23 nt, Artificial Sequence
  RNA Oligomer
gaagcuuuggaauggcaaggcca

SEQ ID NO: 67031 - RNA, 23 nt, Artificial Sequence
  RNA Oligomer
gggcuguucuccaagaaggagau

SEQ ID NO: 67032 - RNA, 23 nt, Artificial Sequence
  RNA Oligomer
cacugaaguuuucccgcacagac

SEQ ID NO: 67033 - RNA, 23 nt, Artificial Sequence
  RNA Oligomer
gucuacaugagaaaugccagcug

SEQ ID NO: 67034 - RNA, 23 nt, Artificial Sequence
  RNA Oligomer
guauacaggauaccggccauuuc

SEQ ID NO: 67035 - RNA, 23 nt, Artificial Sequence
  RNA Oligomer
gaguauacaggauaccggccauu

SEQ ID NO: 67036 - RNA, 23 nt, Artificial Sequence
  RNA Oligomer
acaaaucucagaagacaagcuga

SEQ ID NO: 67037 - RNA, 23 nt, Artificial Sequence
  RNA Oligomer
ugagaaguucgaccucaggacca

SEQ ID NO: 67038 - RNA, 23 nt, Artificial Sequence
  RNA Oligomer
ggugucugugcacaucuacauca

SEQ ID NO: 67039 - RNA, 23 nt, Artificial Sequence
  RNA Oligomer
uccugauccuggccaucauguau

SEQ ID NO: 67040 - RNA, 23 nt, Artificial Sequence
  RNA Oligomer
cuccugauccuggccaucaugua

SEQ ID NO: 67041 - RNA, 23 nt, Artificial Sequence
  RNA Oligomer
gucuuacacagugugggccaugu

SEQ ID NO: 67042 - RNA, 23 nt, Artificial Sequence
  RNA Oligomer
ugagacugaguugacaccucaga

SEQ ID NO: 67043 - RNA, 23 nt, Artificial Sequence
  RNA Oligomer
ugaguucaucaggaugcugagau

SEQ ID NO: 67044 - RNA, 23 nt, Artificial Sequence
  RNA Oligomer
ggucuucaugaaaggcucuccug

SEQ ID NO: 67045 - RNA, 23 nt, Artificial Sequence
  RNA Oligomer
gaaggucaacuucguccugucca

SEQ ID NO: 67046 - RNA, 23 nt, Artificial Sequence
  RNA Oligomer
acagaaggucaacuucguccugu

SEQ ID NO: 67047 - RNA, 23 nt, Artificial Sequence
  RNA Oligomer
aggacuuauccuggcuagagcug

SEQ ID NO: 67048 - RNA, 23 nt, Artificial Sequence
  RNA Oligomer
ucagacccuggcccaauaccuau

SEQ ID NO: 67049 - RNA, 23 nt, Artificial Sequence
  RNA Oligomer
caaaucucagaagacaagcugac

SEQ ID NO: 67050 - RNA, 23 nt, Artificial Sequence
  RNA Oligomer
uggaaaaggccugucagcucauc

SEQ ID NO: 67051 - RNA, 23 nt, Artificial Sequence
  RNA Oligomer
acauccugcucuauguccugcuc

SEQ ID NO: 67052 - RNA, 23 nt, Artificial Sequence
  RNA Oligomer
ggauuccaggacaaggaggaacu

SEQ ID NO: 67053 - RNA, 23 nt, Artificial Sequence
  RNA Oligomer
agcaucgugucugagaagcucgu

SEQ ID NO: 67054 - RNA, 23 nt, Artificial Sequence
  RNA Oligomer
gaacaccaggaaugggcuguucu

SEQ ID NO: 67055 - RNA, 23 nt, Artificial Sequence
  RNA Oligomer
ccaagccuacaaagugcugaaga

SEQ ID NO: 67056 - RNA, 23 nt, Artificial Sequence
  RNA Oligomer
caaagaccuggucuucaagucau

SEQ ID NO: 67057 - RNA, 23 nt, Artificial Sequence
  RNA Oligomer
gccagauacccaaagcuguaccu

SEQ ID NO: 67058 - RNA, 23 nt, Artificial Sequence
  RNA Oligomer
gcuuugaguacaagucagggcag

SEQ ID NO: 67059 - RNA, 23 nt, Artificial Sequence
  RNA Oligomer
acuggugguucuuccagaccgua

SEQ ID NO: 67060 - RNA, 23 nt, Artificial Sequence
  RNA Oligomer
gucuucaugaaaggcucuccuga

SEQ ID NO: 67061 - RNA, 23 nt, Artificial Sequence
  RNA Oligomer
ccucuguugcuucccuuugguga

SEQ ID NO: 67062 - RNA, 23 nt, Artificial Sequence
  RNA Oligomer
agaacaccaggaaugggcuguuc

SEQ ID NO: 67063 - RNA, 23 nt, Artificial Sequence
  RNA Oligomer
gugucucagccuggagaaauggu

SEQ ID NO: 67064 - RNA, 23 nt, Artificial Sequence
  RNA Oligomer
aguauacaggauaccggccauuu

SEQ ID NO: 67065 - RNA, 23 nt, Artificial Sequence
  RNA Oligomer
ggcaaagugaaaccucugcuucc

SEQ ID NO: 67066 - RNA, 23 nt, Artificial Sequence
  RNA Oligomer
cuggcaugaccaagaauguggaa

SEQ ID NO: 67067 - RNA, 23 nt, Artificial Sequence
  RNA Oligomer
gacuuugaugggaauggccucau

SEQ ID NO: 67068 - RNA, 23 nt, Artificial Sequence
  RNA Oligomer
gaccuuuuucaggcaccuuuucu

SEQ ID NO: 67069 - RNA, 23 nt, Artificial Sequence
  RNA Oligomer
gcgucuacaugagaaaugccagc

SEQ ID NO: 67070 - RNA, 23 nt, Artificial Sequence
  RNA Oligomer
uggcaugaccaagaauguggaaa

SEQ ID NO: 67071 - RNA, 23 nt, Artificial Sequence
  RNA Oligomer
gcuucacgcagcucugugucaaa

SEQ ID NO: 67072 - RNA, 23 nt, Artificial Sequence
  RNA Oligomer
ggaugaguucaucaggaugcuga

SEQ ID NO: 67073 - RNA, 23 nt, Artificial Sequence
  RNA Oligomer
aggaugaguucaucaggaugcug

SEQ ID NO: 67074 - RNA, 23 nt, Artificial Sequence
  RNA Oligomer
cuggacauccugguggucuucau

SEQ ID NO: 67075 - RNA, 23 nt, Artificial Sequence
  RNA Oligomer
gagaccuuuuucaggcaccuuuu

SEQ ID NO: 67076 - RNA, 23 nt, Artificial Sequence
  RNA Oligomer
ucauccgucagcugccaaguguu

SEQ ID NO: 67077 - RNA, 23 nt, Artificial Sequence
  RNA Oligomer
aggcaccuccuggagaccuuuuu

SEQ ID NO: 67078 - RNA, 23 nt, Artificial Sequence
  RNA Oligomer
gcuguucuccaagaaggagauug

SEQ ID NO: 67079 - RNA, 23 nt, Artificial Sequence
  RNA Oligomer
caccuaccagaacaucgcugugu

SEQ ID NO: 67080 - RNA, 23 nt, Artificial Sequence
  RNA Oligomer
agaagacaagcugaccugacaag

SEQ ID NO: 67081 - RNA, 23 nt, Artificial Sequence
  RNA Oligomer
gcagugucuagggacuagaguga

SEQ ID NO: 67082 - RNA, 23 nt, Artificial Sequence
  RNA Oligomer
gcugacaaggauggcaauggcua

SEQ ID NO: 67083 - RNA, 23 nt, Artificial Sequence
  RNA Oligomer
uguucuccaagaaggagauugaa

SEQ ID NO: 67084 - RNA, 23 nt, Artificial Sequence
  RNA Oligomer
gcacuuccagaagguucugaacc

SEQ ID NO: 67085 - RNA, 23 nt, Artificial Sequence
  RNA Oligomer
cuccauccucaaagaccuggucu

SEQ ID NO: 67086 - RNA, 23 nt, Artificial Sequence
  RNA Oligomer
acgggugacagaugugccagaua

SEQ ID NO: 67087 - RNA, 23 nt, Artificial Sequence
  RNA Oligomer
ccugcucuauguccugcucauca

SEQ ID NO: 67088 - RNA, 23 nt, Artificial Sequence
  RNA Oligomer
uccuuccgagaguuccuggacau

SEQ ID NO: 67089 - RNA, 23 nt, Artificial Sequence
  RNA Oligomer
caaggauggcaauggcuaccugu

SEQ ID NO: 67090 - RNA, 23 nt, Artificial Sequence
  RNA Oligomer
cagaagacaagcugaccugacaa

SEQ ID NO: 67091 - RNA, 23 nt, Artificial Sequence
  RNA Oligomer
gaagaucuacuucaucuggguga

SEQ ID NO: 67092 - RNA, 23 nt, Artificial Sequence
  RNA Oligomer
acaaggauggcaauggcuaccug

SEQ ID NO: 67093 - RNA, 23 nt, Artificial Sequence
  RNA Oligomer
aggaugugucucagccuggagaa

SEQ ID NO: 67094 - RNA, 23 nt, Artificial Sequence
  RNA Oligomer
agaagaucuacuucaucugggug

SEQ ID NO: 67095 - RNA, 23 nt, Artificial Sequence
  RNA Oligomer
uccauccucaaagaccuggucuu

SEQ ID NO: 67096 - RNA, 23 nt, Artificial Sequence
  RNA Oligomer
caucuucuuccuggucccagcaa

SEQ ID NO: 67097 - RNA, 23 nt, Artificial Sequence
  RNA Oligomer
gagauccuucaucgagaucucca

SEQ ID NO: 67098 - RNA, 23 nt, Artificial Sequence
  RNA Oligomer
aagacaagcugaccugacaagua

SEQ ID NO: 67099 - RNA, 23 nt, Artificial Sequence
  RNA Oligomer
auccugcucuauguccugcucau

SEQ ID NO: 67100 - RNA, 23 nt, Artificial Sequence
  RNA Oligomer
gcaaagugaaaccucugcuucca

SEQ ID NO: 67101 - RNA, 23 nt, Artificial Sequence
  RNA Oligomer
ccauccucaaagaccuggucuuc

SEQ ID NO: 67102 - RNA, 23 nt, Artificial Sequence
  RNA Oligomer
ugagaaaugccagcugccacuuc

SEQ ID NO: 67103 - RNA, 23 nt, Artificial Sequence
  RNA Oligomer
caagaauguggaaaaggccuguc

SEQ ID NO: 67104 - RNA, 23 nt, Artificial Sequence
  RNA Oligomer
ucauccgagagguggaggagaau

SEQ ID NO: 67105 - RNA, 23 nt, Artificial Sequence
  RNA Oligomer
ccguuuccacaucuucuuccugg

SEQ ID NO: 67106 - RNA, 23 nt, Artificial Sequence
  RNA Oligomer
cucagaagacaagcugaccugac

SEQ ID NO: 67107 - RNA, 23 nt, Artificial Sequence
  RNA Oligomer
uccacaucuucuuccugguccca

SEQ ID NO: 67108 - RNA, 23 nt, Artificial Sequence
  RNA Oligomer
gaguugacaccucagagacugca

SEQ ID NO: 67109 - RNA, 23 nt, Artificial Sequence
  RNA Oligomer
gaccaagaauguggaaaaggccu

SEQ ID NO: 67110 - RNA, 23 nt, Artificial Sequence
  RNA Oligomer
ccaagaauguggaaaaggccugu

SEQ ID NO: 67111 - RNA, 23 nt, Artificial Sequence
  RNA Oligomer
aaccuugggugaaauuaguugug

SEQ ID NO: 67112 - RNA, 23 nt, Artificial Sequence
  RNA Oligomer
accuugggugaaauuaguugugg

SEQ ID NO: 67113 - RNA, 23 nt, Artificial Sequence
  RNA Oligomer
ccuugggugaaauuaguuguggu

SEQ ID NO: 67114 - RNA, 23 nt, Artificial Sequence
  RNA Oligomer
cuugggugaaauuaguuguggug

SEQ ID NO: 67115 - RNA, 23 nt, Artificial Sequence
  RNA Oligomer
uugggugaaauuaguuguggugu

SEQ ID NO: 67116 - RNA, 23 nt, Artificial Sequence
  RNA Oligomer
ugggugaaauuaguugugguguu

SEQ ID NO: 67117 - RNA, 23 nt, Artificial Sequence
  RNA Oligomer
aaaccuugggugaaauuaguugu

SEQ ID NO: 67118 - RNA, 23 nt, Artificial Sequence
  RNA Oligomer
aaagaacgugcuuaaaaccuugg

SEQ ID NO: 67119 - RNA, 23 nt, Artificial Sequence
  RNA Oligomer
aagaacgugcuuaaaaccuuggg

SEQ ID NO: 67120 - RNA, 23 nt, Artificial Sequence
  RNA Oligomer
agaacgugcuuaaaaccuugggu

SEQ ID NO: 67121 - RNA, 23 nt, Artificial Sequence
  RNA Oligomer
gaacgugcuuaaaaccuugggug

SEQ ID NO: 67122 - RNA, 23 nt, Artificial Sequence
  RNA Oligomer
aacgugcuuaaaaccuuggguga

SEQ ID NO: 67123 - RNA, 23 nt, Artificial Sequence
  RNA Oligomer
ugagauuuguuucugaagucugg

SEQ ID NO: 67124 - RNA, 23 nt, Artificial Sequence
  RNA Oligomer
gagauuuguuucugaagucugga

SEQ ID NO: 67125 - RNA, 23 nt, Artificial Sequence
  RNA Oligomer
agauuuguuucugaagucuggaa

SEQ ID NO: 67126 - RNA, 23 nt, Artificial Sequence
  RNA Oligomer
gauuuguuucugaagucuggaag

SEQ ID NO: 67127 - RNA, 23 nt, Artificial Sequence
  RNA Oligomer
auuuguuucugaagucuggaagc

SEQ ID NO: 67128 - RNA, 23 nt, Artificial Sequence
  RNA Oligomer
guaggagaacaugaaagagaugc

SEQ ID NO: 67129 - RNA, 23 nt, Artificial Sequence
  RNA Oligomer
uaggagaacaugaaagagaugcu

SEQ ID NO: 67130 - RNA, 23 nt, Artificial Sequence
  RNA Oligomer
aggagaacaugaaagagaugcug

SEQ ID NO: 67131 - RNA, 23 nt, Artificial Sequence
  RNA Oligomer
ggagaacaugaaagagaugcugg

SEQ ID NO: 67132 - RNA, 23 nt, Artificial Sequence
  RNA Oligomer
gagaacaugaaagagaugcuggc

SEQ ID NO: 67133 - RNA, 23 nt, Artificial Sequence
  RNA Oligomer
acagauguacagcauaguggucc

SEQ ID NO: 67134 - RNA, 23 nt, Artificial Sequence
  RNA Oligomer
cagauguacagcauagugguccu

SEQ ID NO: 67135 - RNA, 23 nt, Artificial Sequence
  RNA Oligomer
agauguacagcauagugguccug

SEQ ID NO: 67136 - RNA, 23 nt, Artificial Sequence
  RNA Oligomer
gauguacagcauagugguccuga

SEQ ID NO: 67137 - RNA, 23 nt, Artificial Sequence
  RNA Oligomer
auguacagcauagugguccugag

SEQ ID NO: 67138 - RNA, 23 nt, Artificial Sequence
  RNA Oligomer
gggauuagaaugucccaaaaugg

SEQ ID NO: 67139 - RNA, 23 nt, Artificial Sequence
  RNA Oligomer
ggauuagaaugucccaaaaugga

SEQ ID NO: 67140 - RNA, 23 nt, Artificial Sequence
  RNA Oligomer
gauuagaaugucccaaaauggag

SEQ ID NO: 67141 - RNA, 23 nt, Artificial Sequence
  RNA Oligomer
auuagaaugucccaaaauggaga

SEQ ID NO: 67142 - RNA, 23 nt, Artificial Sequence
  RNA Oligomer
uuagaaugucccaaaauggagac

SEQ ID NO: 67143 - RNA, 23 nt, Artificial Sequence
  RNA Oligomer
acuugaguuccgauugaugaccc

SEQ ID NO: 67144 - RNA, 23 nt, Artificial Sequence
  RNA Oligomer
cuugaguuccgauugaugacccc

SEQ ID NO: 67145 - RNA, 23 nt, Artificial Sequence
  RNA Oligomer
uugaguuccgauugaugaccccc

SEQ ID NO: 67146 - RNA, 23 nt, Artificial Sequence
  RNA Oligomer
ugaguuccgauugaugacccccu

SEQ ID NO: 67147 - RNA, 23 nt, Artificial Sequence
  RNA Oligomer
gaguuccgauugaugacccccug

SEQ ID NO: 67148 - RNA, 23 nt, Artificial Sequence
  RNA Oligomer
gaguagggaggguucuaagaugc

SEQ ID NO: 67149 - RNA, 23 nt, Artificial Sequence
  RNA Oligomer
aguagggaggguucuaagaugcc

SEQ ID NO: 67150 - RNA, 23 nt, Artificial Sequence
  RNA Oligomer
guagggaggguucuaagaugcca

SEQ ID NO: 67151 - RNA, 23 nt, Artificial Sequence
  RNA Oligomer
uagggaggguucuaagaugccag

SEQ ID NO: 67152 - RNA, 23 nt, Artificial Sequence
  RNA Oligomer
agggaggguucuaagaugccagc

SEQ ID NO: 67153 - RNA, 23 nt, Artificial Sequence
  RNA Oligomer
agcccaugaugaaaauaauaggg

SEQ ID NO: 67154 - RNA, 23 nt, Artificial Sequence
  RNA Oligomer
gcccaugaugaaaauaauagggg

SEQ ID NO: 67155 - RNA, 23 nt, Artificial Sequence
  RNA Oligomer
cccaugaugaaaauaauaggggc

SEQ ID NO: 67156 - RNA, 23 nt, Artificial Sequence
  RNA Oligomer
ccaugaugaaaauaauaggggcu

SEQ ID NO: 67157 - RNA, 23 nt, Artificial Sequence
  RNA Oligomer
caugaugaaaauaauaggggcuc

SEQ ID NO: 67158 - RNA, 23 nt, Artificial Sequence
  RNA Oligomer
ugccaucuaccacacggaucugc

SEQ ID NO: 67159 - RNA, 23 nt, Artificial Sequence
  RNA Oligomer
gccaucuaccacacggaucugcc

SEQ ID NO: 67160 - RNA, 23 nt, Artificial Sequence
  RNA Oligomer
ccaucuaccacacggaucugccc

SEQ ID NO: 67161 - RNA, 23 nt, Artificial Sequence
  RNA Oligomer
caucuaccacacggaucugcccg

SEQ ID NO: 67162 - RNA, 23 nt, Artificial Sequence
  RNA Oligomer
aucuaccacacggaucugcccgg

SEQ ID NO: 67163 - RNA, 23 nt, Artificial Sequence
  RNA Oligomer
cccguagccgcacaaauuguuca

SEQ ID NO: 67164 - RNA, 23 nt, Artificial Sequence
  RNA Oligomer
ccguagccgcacaaauuguucaa

SEQ ID NO: 67165 - RNA, 23 nt, Artificial Sequence
  RNA Oligomer
cguagccgcacaaauuguucaag

SEQ ID NO: 67166 - RNA, 23 nt, Artificial Sequence
  RNA Oligomer
guagccgcacaaauuguucaagg

SEQ ID NO: 67167 - RNA, 23 nt, Artificial Sequence
  RNA Oligomer
uagccgcacaaauuguucaagga

SEQ ID NO: 67168 - RNA, 23 nt, Artificial Sequence
  RNA Oligomer
cacuugaguuccgauugaugacc

SEQ ID NO: 67169 - RNA, 23 nt, Artificial Sequence
  RNA Oligomer
acgugcuuaaaaccuugggugaa

SEQ ID NO: 67170 - RNA, 23 nt, Artificial Sequence
  RNA Oligomer
aaaaccuugggugaaauuaguug

SEQ ID NO: 67171 - RNA, 23 nt, Artificial Sequence
  RNA Oligomer
guggguuucuguaaauggcuugc

SEQ ID NO: 67172 - RNA, 23 nt, Artificial Sequence
  RNA Oligomer
uggguuucuguaaauggcuugcc

SEQ ID NO: 67173 - RNA, 23 nt, Artificial Sequence
  RNA Oligomer
ggguuucuguaaauggcuugcca

SEQ ID NO: 67174 - RNA, 23 nt, Artificial Sequence
  RNA Oligomer
gguuucuguaaauggcuugccau

SEQ ID NO: 67175 - RNA, 23 nt, Artificial Sequence
  RNA Oligomer
guuucuguaaauggcuugccaug

SEQ ID NO: 67176 - RNA, 23 nt, Artificial Sequence
  RNA Oligomer
aacaugaaagagaugcuggcugc

SEQ ID NO: 67177 - RNA, 23 nt, Artificial Sequence
  RNA Oligomer
acaugaaagagaugcuggcugcu

SEQ ID NO: 67178 - RNA, 23 nt, Artificial Sequence
  RNA Oligomer
caugaaagagaugcuggcugcug

SEQ ID NO: 67179 - RNA, 23 nt, Artificial Sequence
  RNA Oligomer
augaaagagaugcuggcugcugu

SEQ ID NO: 67180 - RNA, 23 nt, Artificial Sequence
  RNA Oligomer
ugaaagagaugcuggcugcugug

SEQ ID NO: 67181 - RNA, 23 nt, Artificial Sequence
  RNA Oligomer
ugcguuggaacuucucucggugc

SEQ ID NO: 67182 - RNA, 23 nt, Artificial Sequence
  RNA Oligomer
gcguuggaacuucucucggugcg

SEQ ID NO: 67183 - RNA, 23 nt, Artificial Sequence
  RNA Oligomer
cguuggaacuucucucggugcgc

SEQ ID NO: 67184 - RNA, 23 nt, Artificial Sequence
  RNA Oligomer
guuggaacuucucucggugcgcc

SEQ ID NO: 67185 - RNA, 23 nt, Artificial Sequence
  RNA Oligomer
uuggaacuucucucggugcgccu

SEQ ID NO: 67186 - RNA, 23 nt, Artificial Sequence
  RNA Oligomer
gucguacaugcggaacauaaggc

SEQ ID NO: 67187 - RNA, 23 nt, Artificial Sequence
  RNA Oligomer
ucguacaugcggaacauaaggcg

SEQ ID NO: 67188 - RNA, 23 nt, Artificial Sequence
  RNA Oligomer
cguacaugcggaacauaaggcga

SEQ ID NO: 67189 - RNA, 23 nt, Artificial Sequence
  RNA Oligomer
guacaugcggaacauaaggcgag

SEQ ID NO: 67190 - RNA, 23 nt, Artificial Sequence
  RNA Oligomer
uacaugcggaacauaaggcgaga

SEQ ID NO: 67191 - RNA, 23 nt, Artificial Sequence
  RNA Oligomer
uuuaugccagacaaagacauugg

SEQ ID NO: 67192 - RNA, 23 nt, Artificial Sequence
  RNA Oligomer
uuaugccagacaaagacauuggg

SEQ ID NO: 67193 - RNA, 23 nt, Artificial Sequence
  RNA Oligomer
uaugccagacaaagacauugggc

SEQ ID NO: 67194 - RNA, 23 nt, Artificial Sequence
  RNA Oligomer
augccagacaaagacauugggcu

SEQ ID NO: 67195 - RNA, 23 nt, Artificial Sequence
  RNA Oligomer
ugccagacaaagacauugggcug

SEQ ID NO: 67196 - RNA, 23 nt, Artificial Sequence
  RNA Oligomer
ccaguacagugucauugcuccgg

SEQ ID NO: 67197 - RNA, 23 nt, Artificial Sequence
  RNA Oligomer
caguacagugucauugcuccggg

SEQ ID NO: 67198 - RNA, 23 nt, Artificial Sequence
  RNA Oligomer
aguacagugucauugcuccggga

SEQ ID NO: 67199 - RNA, 23 nt, Artificial Sequence
  RNA Oligomer
guacagugucauugcuccgggag

SEQ ID NO: 67200 - RNA, 23 nt, Artificial Sequence
  RNA Oligomer
uacagugucauugcuccgggaga

SEQ ID NO: 67201 - RNA, 23 nt, Artificial Sequence
  RNA Oligomer
acacuugaguuccgauugaugac

SEQ ID NO: 67202 - RNA, 23 nt, Artificial Sequence
  RNA Oligomer
gagaugguguugcuaaggucucg

SEQ ID NO: 67203 - RNA, 23 nt, Artificial Sequence
  RNA Oligomer
agaugguguugcuaaggucucgg

SEQ ID NO: 67204 - RNA, 23 nt, Artificial Sequence
  RNA Oligomer
gaugguguugcuaaggucucggg

SEQ ID NO: 67205 - RNA, 23 nt, Artificial Sequence
  RNA Oligomer
augguguugcuaaggucucgggg

SEQ ID NO: 67206 - RNA, 23 nt, Artificial Sequence
  RNA Oligomer
ugguguugcuaaggucucggggg

SEQ ID NO: 67207 - RNA, 23 nt, Artificial Sequence
  RNA Oligomer
auuaguugugguguuagacuggg

SEQ ID NO: 67208 - RNA, 23 nt, Artificial Sequence
  RNA Oligomer
uuaguugugguguuagacugggg

SEQ ID NO: 67209 - RNA, 23 nt, Artificial Sequence
  RNA Oligomer
uaguugugguguuagacuggggu

SEQ ID NO: 67210 - RNA, 23 nt, Artificial Sequence
  RNA Oligomer
aguugugguguuagacuggggug

SEQ ID NO: 67211 - RNA, 23 nt, Artificial Sequence
  RNA Oligomer
guugugguguuagacuggggugc

SEQ ID NO: 67212 - RNA, 23 nt, Artificial Sequence
  RNA Oligomer
ggccuagaaguucucauaauggu

SEQ ID NO: 67213 - RNA, 23 nt, Artificial Sequence
  RNA Oligomer
gccuagaaguucucauaauggug

SEQ ID NO: 67214 - RNA, 23 nt, Artificial Sequence
  RNA Oligomer
ccuagaaguucucauaauggugg

SEQ ID NO: 67215 - RNA, 23 nt, Artificial Sequence
  RNA Oligomer
cuagaaguucucauaaugguggg

SEQ ID NO: 67216 - RNA, 23 nt, Artificial Sequence
  RNA Oligomer
uagaaguucucauaaugguggga

SEQ ID NO: 67217 - RNA, 23 nt, Artificial Sequence
  RNA Oligomer
cuccaaaugguccaucaagguac

SEQ ID NO: 67218 - RNA, 23 nt, Artificial Sequence
  RNA Oligomer
uccaaaugguccaucaagguaca

SEQ ID NO: 67219 - RNA, 23 nt, Artificial Sequence
  RNA Oligomer
ccaaaugguccaucaagguacag

SEQ ID NO: 67220 - RNA, 23 nt, Artificial Sequence
  RNA Oligomer
caaaugguccaucaagguacagc

SEQ ID NO: 67221 - RNA, 23 nt, Artificial Sequence
  RNA Oligomer
aaaugguccaucaagguacagcu

SEQ ID NO: 67222 - RNA, 23 nt, Artificial Sequence
  RNA Oligomer
caggaaagaggcaagagaggacg

SEQ ID NO: 67223 - RNA, 23 nt, Artificial Sequence
  RNA Oligomer
aggaaagaggcaagagaggacgc

SEQ ID NO: 67224 - RNA, 23 nt, Artificial Sequence
  RNA Oligomer
ggaaagaggcaagagaggacgcu

SEQ ID NO: 67225 - RNA, 23 nt, Artificial Sequence
  RNA Oligomer
gaaagaggcaagagaggacgcug

SEQ ID NO: 67226 - RNA, 23 nt, Artificial Sequence
  RNA Oligomer
aaagaggcaagagaggacgcuga

SEQ ID NO: 67227 - RNA, 23 nt, Artificial Sequence
  RNA Oligomer
guguaagacugugaggacgaugg

SEQ ID NO: 67228 - RNA, 23 nt, Artificial Sequence
  RNA Oligomer
uguaagacugugaggacgauggc

SEQ ID NO: 67229 - RNA, 23 nt, Artificial Sequence
  RNA Oligomer
guaagacugugaggacgauggcg

SEQ ID NO: 67230 - RNA, 23 nt, Artificial Sequence
  RNA Oligomer
uaagacugugaggacgauggcgg

SEQ ID NO: 67231 - RNA, 23 nt, Artificial Sequence
  RNA Oligomer
aagacugugaggacgauggcggu

SEQ ID NO: 67232 - RNA, 23 nt, Artificial Sequence
  RNA Oligomer
gauguaggagaacaugaaagaga

SEQ ID NO: 67233 - RNA, 23 nt, Artificial Sequence
  RNA Oligomer
auguaggagaacaugaaagagau

SEQ ID NO: 67234 - RNA, 23 nt, Artificial Sequence
  RNA Oligomer
uguaggagaacaugaaagagaug

SEQ ID NO: 67235 - RNA, 23 nt, Artificial Sequence
  RNA Oligomer
agaacaugaaagagaugcuggcu

SEQ ID NO: 67236 - RNA, 23 nt, Artificial Sequence
  RNA Oligomer
gaacaugaaagagaugcuggcug

SEQ ID NO: 67237 - RNA, 23 nt, Artificial Sequence
  RNA Oligomer
cuggaaugacguuaccuucuugc

SEQ ID NO: 67238 - RNA, 23 nt, Artificial Sequence
  RNA Oligomer
uggaaugacguuaccuucuugcc

SEQ ID NO: 67239 - RNA, 23 nt, Artificial Sequence
  RNA Oligomer
ggaaugacguuaccuucuugcca

SEQ ID NO: 67240 - RNA, 23 nt, Artificial Sequence
  RNA Oligomer
gaaugacguuaccuucuugccaa

SEQ ID NO: 67241 - RNA, 23 nt, Artificial Sequence
  RNA Oligomer
aaugacguuaccuucuugccaaa

SEQ ID NO: 67242 - RNA, 23 nt, Artificial Sequence
  RNA Oligomer
ggaacauaaggcgagacuuuucc

SEQ ID NO: 67243 - RNA, 23 nt, Artificial Sequence
  RNA Oligomer
gaacauaaggcgagacuuuuccu

SEQ ID NO: 67244 - RNA, 23 nt, Artificial Sequence
  RNA Oligomer
aacauaaggcgagacuuuuccuc

SEQ ID NO: 67245 - RNA, 23 nt, Artificial Sequence
  RNA Oligomer
acauaaggcgagacuuuuccuca

SEQ ID NO: 67246 - RNA, 23 nt, Artificial Sequence
  RNA Oligomer
cauaaggcgagacuuuuccucag

SEQ ID NO: 67247 - RNA, 23 nt, Artificial Sequence
  RNA Oligomer
caccaaagggaagcaacagaggg

SEQ ID NO: 67248 - RNA, 23 nt, Artificial Sequence
  RNA Oligomer
accaaagggaagcaacagagggu

SEQ ID NO: 67249 - RNA, 23 nt, Artificial Sequence
  RNA Oligomer
ccaaagggaagcaacagaggguc

SEQ ID NO: 67250 - RNA, 23 nt, Artificial Sequence
  RNA Oligomer
caaagggaagcaacagagggucc

SEQ ID NO: 67251 - RNA, 23 nt, Artificial Sequence
  RNA Oligomer
aaagggaagcaacagaggguccc

SEQ ID NO: 67252 - RNA, 23 nt, Artificial Sequence
  RNA Oligomer
aagggaagcaacagagggucccg

SEQ ID NO: 67253 - RNA, 23 nt, Artificial Sequence
  RNA Oligomer
gccagacaaagacauugggcugc

SEQ ID NO: 67254 - RNA, 23 nt, Artificial Sequence
  RNA Oligomer
ccagacaaagacauugggcugca

SEQ ID NO: 67255 - RNA, 23 nt, Artificial Sequence
  RNA Oligomer
cagacaaagacauugggcugcag

SEQ ID NO: 67256 - RNA, 23 nt, Artificial Sequence
  RNA Oligomer
agacaaagacauugggcugcaga

SEQ ID NO: 67257 - RNA, 23 nt, Artificial Sequence
  RNA Oligomer
gacaaagacauugggcugcagag

SEQ ID NO: 67258 - RNA, 23 nt, Artificial Sequence
  RNA Oligomer
ucggauuucuucaaucuccuucu

SEQ ID NO: 67259 - RNA, 23 nt, Artificial Sequence
  RNA Oligomer
cggauuucuucaaucuccuucuu

SEQ ID NO: 67260 - RNA, 23 nt, Artificial Sequence
  RNA Oligomer
ggauuucuucaaucuccuucuug

SEQ ID NO: 67261 - RNA, 23 nt, Artificial Sequence
  RNA Oligomer
gauuucuucaaucuccuucuugg

SEQ ID NO: 67262 - RNA, 23 nt, Artificial Sequence
  RNA Oligomer
auuucuucaaucuccuucuugga

SEQ ID NO: 67263 - RNA, 23 nt, Artificial Sequence
  RNA Oligomer
agaaguucucauaauggugggag

SEQ ID NO: 67264 - RNA, 23 nt, Artificial Sequence
  RNA Oligomer
gaaguucucauaauggugggaga

SEQ ID NO: 67265 - RNA, 23 nt, Artificial Sequence
  RNA Oligomer
gaucuucuuacagaacacuuggc

SEQ ID NO: 67266 - RNA, 23 nt, Artificial Sequence
  RNA Oligomer
aucuucuuacagaacacuuggca

SEQ ID NO: 67267 - RNA, 23 nt, Artificial Sequence
  RNA Oligomer
ucuucuuacagaacacuuggcag

SEQ ID NO: 67268 - RNA, 23 nt, Artificial Sequence
  RNA Oligomer
cuucuuacagaacacuuggcagc

SEQ ID NO: 67269 - RNA, 23 nt, Artificial Sequence
  RNA Oligomer
uucuuacagaacacuuggcagcu

SEQ ID NO: 67270 - RNA, 23 nt, Artificial Sequence
  RNA Oligomer
acacugacaccucaaacuuaugc

SEQ ID NO: 67271 - RNA, 23 nt, Artificial Sequence
  RNA Oligomer
cacugacaccucaaacuuaugcc

SEQ ID NO: 67272 - RNA, 23 nt, Artificial Sequence
  RNA Oligomer
acugacaccucaaacuuaugcca

SEQ ID NO: 67273 - RNA, 23 nt, Artificial Sequence
  RNA Oligomer
cugacaccucaaacuuaugccac

SEQ ID NO: 67274 - RNA, 23 nt, Artificial Sequence
  RNA Oligomer
ugacaccucaaacuuaugccacu

SEQ ID NO: 67275 - RNA, 23 nt, Artificial Sequence
  RNA Oligomer
gacaccucaaacuuaugccacuc

SEQ ID NO: 67276 - RNA, 23 nt, Artificial Sequence
  RNA Oligomer
acaccucaaacuuaugccacucc

SEQ ID NO: 67277 - RNA, 23 nt, Artificial Sequence
  RNA Oligomer
caccucaaacuuaugccacuccu

SEQ ID NO: 67278 - RNA, 23 nt, Artificial Sequence
  RNA Oligomer
accucaaacuuaugccacuccug

SEQ ID NO: 67279 - RNA, 23 nt, Artificial Sequence
  RNA Oligomer
ccucaaacuuaugccacuccugg

SEQ ID NO: 67280 - RNA, 23 nt, Artificial Sequence
  RNA Oligomer
cucaaacuuaugccacuccuggu

SEQ ID NO: 67281 - RNA, 23 nt, Artificial Sequence
  RNA Oligomer
aggcaaagacauacaugauggcc

SEQ ID NO: 67282 - RNA, 23 nt, Artificial Sequence
  RNA Oligomer
ggcaaagacauacaugauggcca

SEQ ID NO: 67283 - RNA, 23 nt, Artificial Sequence
  RNA Oligomer
gcaaagacauacaugauggccag

SEQ ID NO: 67284 - RNA, 23 nt, Artificial Sequence
  RNA Oligomer
caaagacauacaugauggccagg

SEQ ID NO: 67285 - RNA, 23 nt, Artificial Sequence
  RNA Oligomer
aaagacauacaugauggccagga

SEQ ID NO: 67286 - RNA, 23 nt, Artificial Sequence
  RNA Oligomer
gaagaaccaccaguaauacuucu

SEQ ID NO: 67287 - RNA, 23 nt, Artificial Sequence
  RNA Oligomer
aagaaccaccaguaauacuucug

SEQ ID NO: 67288 - RNA, 23 nt, Artificial Sequence
  RNA Oligomer
agaaccaccaguaauacuucugg

SEQ ID NO: 67289 - RNA, 23 nt, Artificial Sequence
  RNA Oligomer
gaaccaccaguaauacuucuggg

SEQ ID NO: 67290 - RNA, 23 nt, Artificial Sequence
  RNA Oligomer
aaccaccaguaauacuucugggg

SEQ ID NO: 67291 - RNA, 23 nt, Artificial Sequence
  RNA Oligomer
cacguagcgguugaggaagguuu

SEQ ID NO: 67292 - RNA, 23 nt, Artificial Sequence
  RNA Oligomer
acguagcgguugaggaagguuuc

SEQ ID NO: 67293 - RNA, 23 nt, Artificial Sequence
  RNA Oligomer
cguagcgguugaggaagguuucu

SEQ ID NO: 67294 - RNA, 23 nt, Artificial Sequence
  RNA Oligomer
guagcgguugaggaagguuucuc

SEQ ID NO: 67295 - RNA, 23 nt, Artificial Sequence
  RNA Oligomer
uagcgguugaggaagguuucucg

SEQ ID NO: 67296 - RNA, 23 nt, Artificial Sequence
  RNA Oligomer
aaccaacacaugguccucucgcu

SEQ ID NO: 67297 - RNA, 23 nt, Artificial Sequence
  RNA Oligomer
accaacacaugguccucucgcuc

SEQ ID NO: 67298 - RNA, 23 nt, Artificial Sequence
  RNA Oligomer
ccaacacaugguccucucgcucu

SEQ ID NO: 67299 - RNA, 23 nt, Artificial Sequence
  RNA Oligomer
caacacaugguccucucgcucug

SEQ ID NO: 67300 - RNA, 23 nt, Artificial Sequence
  RNA Oligomer
aacacaugguccucucgcucugc

SEQ ID NO: 67301 - RNA, 23 nt, Artificial Sequence
  RNA Oligomer
augaaagaacgugcuuaaaaccu

SEQ ID NO: 67302 - RNA, 23 nt, Artificial Sequence
  RNA Oligomer
ugaaagaacgugcuuaaaaccuu

SEQ ID NO: 67303 - RNA, 23 nt, Artificial Sequence
  RNA Oligomer
gaaagaacgugcuuaaaaccuug

SEQ ID NO: 67304 - RNA, 23 nt, Artificial Sequence
  RNA Oligomer
ggugaaauuaguugugguguuag

SEQ ID NO: 67305 - RNA, 23 nt, Artificial Sequence
  RNA Oligomer
gugaaauuaguugugguguuaga

SEQ ID NO: 67306 - RNA, 23 nt, Artificial Sequence
  RNA Oligomer
ugaaauuaguugugguguuagac

SEQ ID NO: 67307 - RNA, 23 nt, Artificial Sequence
  RNA Oligomer
gaaauuaguugugguguuagacu

SEQ ID NO: 67308 - RNA, 23 nt, Artificial Sequence
  RNA Oligomer
aaauuaguugugguguuagacug

SEQ ID NO: 67309 - RNA, 23 nt, Artificial Sequence
  RNA Oligomer
aauuaguugugguguuagacugg

SEQ ID NO: 67310 - RNA, 23 nt, Artificial Sequence
  RNA Oligomer
ccccaacacacauacagacaugc

SEQ ID NO: 67311 - RNA, 23 nt, Artificial Sequence
  RNA Oligomer
cccaacacacauacagacaugca

SEQ ID NO: 67312 - RNA, 23 nt, Artificial Sequence
  RNA Oligomer
ccaacacacauacagacaugcac

SEQ ID NO: 67313 - RNA, 23 nt, Artificial Sequence
  RNA Oligomer
caacacacauacagacaugcaca

SEQ ID NO: 67314 - RNA, 23 nt, Artificial Sequence
  RNA Oligomer
aacacacauacagacaugcacac

SEQ ID NO: 67315 - RNA, 23 nt, Artificial Sequence
  RNA Oligomer
uccccuacuucucacucuagucc

SEQ ID NO: 67316 - RNA, 23 nt, Artificial Sequence
  RNA Oligomer
ccccuacuucucacucuaguccc

SEQ ID NO: 67317 - RNA, 23 nt, Artificial Sequence
  RNA Oligomer
cccuacuucucacucuagucccu

SEQ ID NO: 67318 - RNA, 23 nt, Artificial Sequence
  RNA Oligomer
ccuacuucucacucuagucccua

SEQ ID NO: 67319 - RNA, 23 nt, Artificial Sequence
  RNA Oligomer
cuacuucucacucuagucccuag

SEQ ID NO: 67320 - RNA, 23 nt, Artificial Sequence
  RNA Oligomer
gccagaaauaggaagaacagagg

SEQ ID NO: 67321 - RNA, 23 nt, Artificial Sequence
  RNA Oligomer
ccagaaauaggaagaacagaggu

SEQ ID NO: 67322 - RNA, 23 nt, Artificial Sequence
  RNA Oligomer
cagaaauaggaagaacagaggug

SEQ ID NO: 67323 - RNA, 23 nt, Artificial Sequence
  RNA Oligomer
agaaauaggaagaacagagguga

SEQ ID NO: 67324 - RNA, 23 nt, Artificial Sequence
  RNA Oligomer
gaaauaggaagaacagaggugag

SEQ ID NO: 67325 - RNA, 23 nt, Artificial Sequence
  RNA Oligomer
ccccauagaugauugcugggacc

SEQ ID NO: 67326 - RNA, 23 nt, Artificial Sequence
  RNA Oligomer
cccauagaugauugcugggacca

SEQ ID NO: 67327 - RNA, 23 nt, Artificial Sequence
  RNA Oligomer
ccauagaugauugcugggaccag

SEQ ID NO: 67328 - RNA, 23 nt, Artificial Sequence
  RNA Oligomer
cauagaugauugcugggaccagg

SEQ ID NO: 67329 - RNA, 23 nt, Artificial Sequence
  RNA Oligomer
auagaugauugcugggaccagga

SEQ ID NO: 67330 - RNA, 23 nt, Artificial Sequence
  RNA Oligomer
aguggugggaggcaaagacauac

SEQ ID NO: 67331 - RNA, 23 nt, Artificial Sequence
  RNA Oligomer
guggugggaggcaaagacauaca

SEQ ID NO: 67332 - RNA, 23 nt, Artificial Sequence
  RNA Oligomer
uggugggaggcaaagacauacau

SEQ ID NO: 67333 - RNA, 23 nt, Artificial Sequence
  RNA Oligomer
ggugggaggcaaagacauacaug

SEQ ID NO: 67334 - RNA, 23 nt, Artificial Sequence
  RNA Oligomer
gugggaggcaaagacauacauga

SEQ ID NO: 67335 - RNA, 23 nt, Artificial Sequence
  RNA Oligomer
agggauuagaaugucccaaaaug

SEQ ID NO: 67336 - RNA, 23 nt, Artificial Sequence
  RNA Oligomer
acagcugcguuggaacuucucuc

SEQ ID NO: 67337 - RNA, 23 nt, Artificial Sequence
  RNA Oligomer
cagcugcguuggaacuucucucg

SEQ ID NO: 67338 - RNA, 23 nt, Artificial Sequence
  RNA Oligomer
agcugcguuggaacuucucucgg

SEQ ID NO: 67339 - RNA, 23 nt, Artificial Sequence
  RNA Oligomer
gcugcguuggaacuucucucggu

SEQ ID NO: 67340 - RNA, 23 nt, Artificial Sequence
  RNA Oligomer
cugcguuggaacuucucucggug

SEQ ID NO: 67341 - RNA, 23 nt, Artificial Sequence
  RNA Oligomer
ugucaacucagucucaaugucgc

SEQ ID NO: 67342 - RNA, 23 nt, Artificial Sequence
  RNA Oligomer
gucaacucagucucaaugucgcu

SEQ ID NO: 67343 - RNA, 23 nt, Artificial Sequence
  RNA Oligomer
ucaacucagucucaaugucgcug

SEQ ID NO: 67344 - RNA, 23 nt, Artificial Sequence
  RNA Oligomer
caacucagucucaaugucgcugc

SEQ ID NO: 67345 - RNA, 23 nt, Artificial Sequence
  RNA Oligomer
aacucagucucaaugucgcugcg

SEQ ID NO: 67346 - RNA, 23 nt, Artificial Sequence
  RNA Oligomer
ugggagagggacagaucauaucc

SEQ ID NO: 67347 - RNA, 23 nt, Artificial Sequence
  RNA Oligomer
gggagagggacagaucauauccu

SEQ ID NO: 67348 - RNA, 23 nt, Artificial Sequence
  RNA Oligomer
ggagagggacagaucauauccug

SEQ ID NO: 67349 - RNA, 23 nt, Artificial Sequence
  RNA Oligomer
gagagggacagaucauauccugg

SEQ ID NO: 67350 - RNA, 23 nt, Artificial Sequence
  RNA Oligomer
agagggacagaucauauccuggc

SEQ ID NO: 67351 - RNA, 23 nt, Artificial Sequence
  RNA Oligomer
guuguuggagaucucgaugaagg

SEQ ID NO: 67352 - RNA, 23 nt, Artificial Sequence
  RNA Oligomer
uuguuggagaucucgaugaagga

SEQ ID NO: 67353 - RNA, 23 nt, Artificial Sequence
  RNA Oligomer
uguuggagaucucgaugaaggau

SEQ ID NO: 67354 - RNA, 23 nt, Artificial Sequence
  RNA Oligomer
guuggagaucucgaugaaggauc

SEQ ID NO: 67355 - RNA, 23 nt, Artificial Sequence
  RNA Oligomer
uuggagaucucgaugaaggaucu

SEQ ID NO: 67356 - RNA, 23 nt, Artificial Sequence
  RNA Oligomer
gagcuucucagacacgaugcucu

SEQ ID NO: 67357 - RNA, 23 nt, Artificial Sequence
  RNA Oligomer
agcuucucagacacgaugcucug

SEQ ID NO: 67358 - RNA, 23 nt, Artificial Sequence
  RNA Oligomer
gcuucucagacacgaugcucugg

SEQ ID NO: 67359 - RNA, 23 nt, Artificial Sequence
  RNA Oligomer
cuucucagacacgaugcucuggc

SEQ ID NO: 67360 - RNA, 23 nt, Artificial Sequence
  RNA Oligomer
uucucagacacgaugcucuggcg

SEQ ID NO: 67361 - RNA, 23 nt, Artificial Sequence
  RNA Oligomer
cuuuaugccagacaaagacauug

SEQ ID NO: 67362 - RNA, 23 nt, Artificial Sequence
  RNA Oligomer
aggaaugcgaggaaccauagaug

SEQ ID NO: 67363 - RNA, 23 nt, Artificial Sequence
  RNA Oligomer
ggaaugcgaggaaccauagaugg

SEQ ID NO: 67364 - RNA, 23 nt, Artificial Sequence
  RNA Oligomer
gaaugcgaggaaccauagauggc

SEQ ID NO: 67365 - RNA, 23 nt, Artificial Sequence
  RNA Oligomer
aaugcgaggaaccauagauggcg

SEQ ID NO: 67366 - RNA, 23 nt, Artificial Sequence
  RNA Oligomer
augcgaggaaccauagauggcgc

SEQ ID NO: 67367 - RNA, 23 nt, Artificial Sequence
  RNA Oligomer
gaugaaagaacgugcuuaaaacc

SEQ ID NO: 67368 - RNA, 23 nt, Artificial Sequence
  RNA Oligomer
uacuucucacucuagucccuaga

SEQ ID NO: 67369 - RNA, 23 nt, Artificial Sequence
  RNA Oligomer
aaauaggaagaacagaggugagg

SEQ ID NO: 67370 - RNA, 23 nt, Artificial Sequence
  RNA Oligomer
aauaggaagaacagaggugaggu

SEQ ID NO: 67371 - RNA, 23 nt, Artificial Sequence
  RNA Oligomer
gcgcaggccugugaauagacucc

SEQ ID NO: 67372 - RNA, 23 nt, Artificial Sequence
  RNA Oligomer
cgcaggccugugaauagacuccg

SEQ ID NO: 67373 - RNA, 23 nt, Artificial Sequence
  RNA Oligomer
gcaggccugugaauagacuccgg

SEQ ID NO: 67374 - RNA, 23 nt, Artificial Sequence
  RNA Oligomer
caggccugugaauagacuccggu

SEQ ID NO: 67375 - RNA, 23 nt, Artificial Sequence
  RNA Oligomer
aggccugugaauagacuccgguu

SEQ ID NO: 67376 - RNA, 23 nt, Artificial Sequence
  RNA Oligomer
ugcccugacuuguacucaaagcc

SEQ ID NO: 67377 - RNA, 23 nt, Artificial Sequence
  RNA Oligomer
gcccugacuuguacucaaagccc

SEQ ID NO: 67378 - RNA, 23 nt, Artificial Sequence
  RNA Oligomer
cccugacuuguacucaaagcccu

SEQ ID NO: 67379 - RNA, 23 nt, Artificial Sequence
  RNA Oligomer
ccugacuuguacucaaagcccug

SEQ ID NO: 67380 - RNA, 23 nt, Artificial Sequence
  RNA Oligomer
cugacuuguacucaaagcccugg

SEQ ID NO: 67381 - RNA, 23 nt, Artificial Sequence
  RNA Oligomer
gaggcaaagacauacaugauggc

SEQ ID NO: 67382 - RNA, 23 nt, Artificial Sequence
  RNA Oligomer
gcacauggugagcaagauguagg

SEQ ID NO: 67383 - RNA, 23 nt, Artificial Sequence
  RNA Oligomer
cacauggugagcaagauguagga

SEQ ID NO: 67384 - RNA, 23 nt, Artificial Sequence
  RNA Oligomer
acauggugagcaagauguaggag

SEQ ID NO: 67385 - RNA, 23 nt, Artificial Sequence
  RNA Oligomer
cauggugagcaagauguaggaga

SEQ ID NO: 67386 - RNA, 23 nt, Artificial Sequence
  RNA Oligomer
auggugagcaagauguaggagaa

SEQ ID NO: 67387 - RNA, 23 nt, Artificial Sequence
  RNA Oligomer
gcgcuugaacuguugcaccgucu

SEQ ID NO: 67388 - RNA, 23 nt, Artificial Sequence
  RNA Oligomer
cgcuugaacuguugcaccgucug

SEQ ID NO: 67389 - RNA, 23 nt, Artificial Sequence
  RNA Oligomer
gcuugaacuguugcaccgucugg

SEQ ID NO: 67390 - RNA, 23 nt, Artificial Sequence
  RNA Oligomer
cuugaacuguugcaccgucuggu

SEQ ID NO: 67391 - RNA, 23 nt, Artificial Sequence
  RNA Oligomer
uugaacuguugcaccgucuggug

SEQ ID NO: 67392 - RNA, 23 nt, Artificial Sequence
  RNA Oligomer
gaacauggacuccacaaacaugu

SEQ ID NO: 67393 - RNA, 23 nt, Artificial Sequence
  RNA Oligomer
aacauggacuccacaaacauguc

SEQ ID NO: 67394 - RNA, 23 nt, Artificial Sequence
  RNA Oligomer
acauggacuccacaaacaugucc

SEQ ID NO: 67395 - RNA, 23 nt, Artificial Sequence
  RNA Oligomer
cauggacuccacaaacauguccu

SEQ ID NO: 67396 - RNA, 23 nt, Artificial Sequence
  RNA Oligomer
auggacuccacaaacauguccug

SEQ ID NO: 67397 - RNA, 23 nt, Artificial Sequence
  RNA Oligomer
gagccucuugaaauuucucaucc

SEQ ID NO: 67398 - RNA, 23 nt, Artificial Sequence
  RNA Oligomer
agccucuugaaauuucucauccg

SEQ ID NO: 67399 - RNA, 23 nt, Artificial Sequence
  RNA Oligomer
gccucuugaaauuucucauccgg

SEQ ID NO: 67400 - RNA, 23 nt, Artificial Sequence
  RNA Oligomer
ccucuugaaauuucucauccgga

SEQ ID NO: 67401 - RNA, 23 nt, Artificial Sequence
  RNA Oligomer
cucuugaaauuucucauccggag

SEQ ID NO: 67402 - RNA, 23 nt, Artificial Sequence
  RNA Oligomer
ucuccuuuaugccagacaaagac

SEQ ID NO: 67403 - RNA, 23 nt, Artificial Sequence
  RNA Oligomer
cuccuuuaugccagacaaagaca

SEQ ID NO: 67404 - RNA, 23 nt, Artificial Sequence
  RNA Oligomer
uccuuuaugccagacaaagacau

SEQ ID NO: 67405 - RNA, 23 nt, Artificial Sequence
  RNA Oligomer
ccuuuaugccagacaaagacauu

SEQ ID NO: 67406 - RNA, 23 nt, Artificial Sequence
  RNA Oligomer
ccugguguucucaaaccaguagc

SEQ ID NO: 67407 - RNA, 23 nt, Artificial Sequence
  RNA Oligomer
cugguguucucaaaccaguagcg

SEQ ID NO: 67408 - RNA, 23 nt, Artificial Sequence
  RNA Oligomer
ugguguucucaaaccaguagcgg

SEQ ID NO: 67409 - RNA, 23 nt, Artificial Sequence
  RNA Oligomer
gguguucucaaaccaguagcggu

SEQ ID NO: 67410 - RNA, 23 nt, Artificial Sequence
  RNA Oligomer
guguucucaaaccaguagcgguc

SEQ ID NO: 67411 - RNA, 23 nt, Artificial Sequence
  RNA Oligomer
cuccaguacagugucauugcucc

SEQ ID NO: 67412 - RNA, 23 nt, Artificial Sequence
  RNA Oligomer
uccaguacagugucauugcuccg

SEQ ID NO: 67413 - RNA, 23 nt, Artificial Sequence
  RNA Oligomer
ccacaucuucagcacuuuguagg

SEQ ID NO: 67414 - RNA, 23 nt, Artificial Sequence
  RNA Oligomer
cacaucuucagcacuuuguaggc

SEQ ID NO: 67415 - RNA, 23 nt, Artificial Sequence
  RNA Oligomer
acaucuucagcacuuuguaggcu

SEQ ID NO: 67416 - RNA, 23 nt, Artificial Sequence
  RNA Oligomer
caucuucagcacuuuguaggcuu

SEQ ID NO: 67417 - RNA, 23 nt, Artificial Sequence
  RNA Oligomer
aucuucagcacuuuguaggcuug

SEQ ID NO: 67418 - RNA, 23 nt, Artificial Sequence
  RNA Oligomer
caggaaugcgaggaaccauagau

SEQ ID NO: 67419 - RNA, 23 nt, Artificial Sequence
  RNA Oligomer
auaggaagaacagaggugaggug

SEQ ID NO: 67420 - RNA, 23 nt, Artificial Sequence
  RNA Oligomer
gggccuagaaguucucauaaugg

SEQ ID NO: 67421 - RNA, 23 nt, Artificial Sequence
  RNA Oligomer
ucaaacuuaugccacuccuggug

SEQ ID NO: 67422 - RNA, 23 nt, Artificial Sequence
  RNA Oligomer
ggaggcaaagacauacaugaugg

SEQ ID NO: 67423 - RNA, 23 nt, Artificial Sequence
  RNA Oligomer
aagacauacaugauggccaggau

SEQ ID NO: 67424 - RNA, 23 nt, Artificial Sequence
  RNA Oligomer
ccaggaaagaggcaagagaggac

SEQ ID NO: 67425 - RNA, 23 nt, Artificial Sequence
  RNA Oligomer
ucucaaugaagcgcuugaacugu

SEQ ID NO: 67426 - RNA, 23 nt, Artificial Sequence
  RNA Oligomer
cucaaugaagcgcuugaacuguu

SEQ ID NO: 67427 - RNA, 23 nt, Artificial Sequence
  RNA Oligomer
ucaaugaagcgcuugaacuguug

SEQ ID NO: 67428 - RNA, 23 nt, Artificial Sequence
  RNA Oligomer
caaugaagcgcuugaacuguugc

SEQ ID NO: 67429 - RNA, 23 nt, Artificial Sequence
  RNA Oligomer
aaugaagcgcuugaacuguugca

SEQ ID NO: 67430 - RNA, 23 nt, Artificial Sequence
  RNA Oligomer
ggccauucccaucaaagucguac

SEQ ID NO: 67431 - RNA, 23 nt, Artificial Sequence
  RNA Oligomer
gccauucccaucaaagucguaca

SEQ ID NO: 67432 - RNA, 23 nt, Artificial Sequence
  RNA Oligomer
ccauucccaucaaagucguacau

SEQ ID NO: 67433 - RNA, 23 nt, Artificial Sequence
  RNA Oligomer
cauucccaucaaagucguacaug

SEQ ID NO: 67434 - RNA, 23 nt, Artificial Sequence
  RNA Oligomer
auucccaucaaagucguacaugc

SEQ ID NO: 67435 - RNA, 23 nt, Artificial Sequence
  RNA Oligomer
caaguuaaacagcagcaccaggu

SEQ ID NO: 67436 - RNA, 23 nt, Artificial Sequence
  RNA Oligomer
aaguuaaacagcagcaccagguc

SEQ ID NO: 67437 - RNA, 23 nt, Artificial Sequence
  RNA Oligomer
aguuaaacagcagcaccagguca

SEQ ID NO: 67438 - RNA, 23 nt, Artificial Sequence
  RNA Oligomer
guuaaacagcagcaccaggucau

SEQ ID NO: 67439 - RNA, 23 nt, Artificial Sequence
  RNA Oligomer
uuaaacagcagcaccaggucaua

SEQ ID NO: 67440 - RNA, 23 nt, Artificial Sequence
  RNA Oligomer
ggccuugccauuccaaagcuucc

SEQ ID NO: 67441 - RNA, 23 nt, Artificial Sequence
  RNA Oligomer
gccuugccauuccaaagcuucca

SEQ ID NO: 67442 - RNA, 23 nt, Artificial Sequence
  RNA Oligomer
ccuugccauuccaaagcuuccau

SEQ ID NO: 67443 - RNA, 23 nt, Artificial Sequence
  RNA Oligomer
cuugccauuccaaagcuuccaug

SEQ ID NO: 67444 - RNA, 23 nt, Artificial Sequence
  RNA Oligomer
uugccauuccaaagcuuccaugc

SEQ ID NO: 67445 - RNA, 23 nt, Artificial Sequence
  RNA Oligomer
ucuugaaauuucucauccggagc

SEQ ID NO: 67446 - RNA, 23 nt, Artificial Sequence
  RNA Oligomer
cuugaaauuucucauccggagcc

SEQ ID NO: 67447 - RNA, 23 nt, Artificial Sequence
  RNA Oligomer
ccucaaaauagucacgaacaaca

SEQ ID NO: 67448 - RNA, 23 nt, Artificial Sequence
  RNA Oligomer
cucaaaauagucacgaacaacag

SEQ ID NO: 67449 - RNA, 23 nt, Artificial Sequence
  RNA Oligomer
ucaaaauagucacgaacaacaga

SEQ ID NO: 67450 - RNA, 23 nt, Artificial Sequence
  RNA Oligomer
caaaauagucacgaacaacagag

SEQ ID NO: 67451 - RNA, 23 nt, Artificial Sequence
  RNA Oligomer
aaaauagucacgaacaacagagg

SEQ ID NO: 67452 - RNA, 23 nt, Artificial Sequence
  RNA Oligomer
aaauagucacgaacaacagaggg

SEQ ID NO: 67453 - RNA, 23 nt, Artificial Sequence
  RNA Oligomer
aauagucacgaacaacagaggga

SEQ ID NO: 67454 - RNA, 23 nt, Artificial Sequence
  RNA Oligomer
auagucacgaacaacagagggag

SEQ ID NO: 67455 - RNA, 23 nt, Artificial Sequence
  RNA Oligomer
uagucacgaacaacagagggagc

SEQ ID NO: 67456 - RNA, 23 nt, Artificial Sequence
  RNA Oligomer
ugguauuucggauuucuucaauc

SEQ ID NO: 67457 - RNA, 23 nt, Artificial Sequence
  RNA Oligomer
gguauuucggauuucuucaaucu

SEQ ID NO: 67458 - RNA, 23 nt, Artificial Sequence
  RNA Oligomer
guauuucggauuucuucaaucuc

SEQ ID NO: 67459 - RNA, 23 nt, Artificial Sequence
  RNA Oligomer
uauuucggauuucuucaaucucc

SEQ ID NO: 67460 - RNA, 23 nt, Artificial Sequence
  RNA Oligomer
auuucggauuucuucaaucuccu

SEQ ID NO: 67461 - RNA, 23 nt, Artificial Sequence
  RNA Oligomer
ucccguagccgcacaaauuguuc

SEQ ID NO: 67462 - RNA, 23 nt, Artificial Sequence
  RNA Oligomer
cuggcauuucucauguagacgcc

SEQ ID NO: 67463 - RNA, 23 nt, Artificial Sequence
  RNA Oligomer
uggcauuucucauguagacgcca

SEQ ID NO: 67464 - RNA, 23 nt, Artificial Sequence
  RNA Oligomer
ggcauuucucauguagacgccag

SEQ ID NO: 67465 - RNA, 23 nt, Artificial Sequence
  RNA Oligomer
gcauuucucauguagacgccagg

SEQ ID NO: 67466 - RNA, 23 nt, Artificial Sequence
  RNA Oligomer
cauuucucauguagacgccaggg

SEQ ID NO: 67467 - RNA, 23 nt, Artificial Sequence
  RNA Oligomer
auuucucauguagacgccagggg

SEQ ID NO: 67468 - RNA, 23 nt, Artificial Sequence
  RNA Oligomer
uuucucauguagacgccaggggg

SEQ ID NO: 67469 - RNA, 23 nt, Artificial Sequence
  RNA Oligomer
uucucauguagacgccagggggc

SEQ ID NO: 67470 - RNA, 23 nt, Artificial Sequence
  RNA Oligomer
cacgugauagccaaagaagaccc

SEQ ID NO: 67471 - RNA, 23 nt, Artificial Sequence
  RNA Oligomer
acgugauagccaaagaagacccc

SEQ ID NO: 67472 - RNA, 23 nt, Artificial Sequence
  RNA Oligomer
cgugauagccaaagaagaccccc

SEQ ID NO: 67473 - RNA, 23 nt, Artificial Sequence
  RNA Oligomer
gugauagccaaagaagaccccca

SEQ ID NO: 67474 - RNA, 23 nt, Artificial Sequence
  RNA Oligomer
ugauagccaaagaagacccccaa

SEQ ID NO: 67475 - RNA, 23 nt, Artificial Sequence
  RNA Oligomer
agugauuuauuuggaagggagac

SEQ ID NO: 67476 - RNA, 23 nt, Artificial Sequence
  RNA Oligomer
gugauuuauuuggaagggagacu

SEQ ID NO: 67477 - RNA, 23 nt, Artificial Sequence
  RNA Oligomer
ugauuuauuuggaagggagacua

SEQ ID NO: 67478 - RNA, 23 nt, Artificial Sequence
  RNA Oligomer
gauuuauuuggaagggagacuac

SEQ ID NO: 67479 - RNA, 23 nt, Artificial Sequence
  RNA Oligomer
auuuauuuggaagggagacuacu

SEQ ID NO: 67480 - RNA, 23 nt, Artificial Sequence
  RNA Oligomer
ugaggagcauugcauacauaggu

SEQ ID NO: 67481 - RNA, 23 nt, Artificial Sequence
  RNA Oligomer
gaggagcauugcauacauaggua

SEQ ID NO: 67482 - RNA, 23 nt, Artificial Sequence
  RNA Oligomer
aggagcauugcauacauagguau

SEQ ID NO: 67483 - RNA, 23 nt, Artificial Sequence
  RNA Oligomer
ggagcauugcauacauagguauu

SEQ ID NO: 67484 - RNA, 23 nt, Artificial Sequence
  RNA Oligomer
gagcauugcauacauagguauug

SEQ ID NO: 67485 - RNA, 23 nt, Artificial Sequence
  RNA Oligomer
ucucauaauggugggagaaguga

SEQ ID NO: 67486 - RNA, 23 nt, Artificial Sequence
  RNA Oligomer
cucauaauggugggagaagugag

SEQ ID NO: 67487 - RNA, 23 nt, Artificial Sequence
  RNA Oligomer
ucauaauggugggagaagugagu

SEQ ID NO: 67488 - RNA, 23 nt, Artificial Sequence
  RNA Oligomer
cauaauggugggagaagugaguc

SEQ ID NO: 67489 - RNA, 23 nt, Artificial Sequence
  RNA Oligomer
auaauggugggagaagugagucc

SEQ ID NO: 67490 - RNA, 23 nt, Artificial Sequence
  RNA Oligomer
acccaucaaaucgcugcaccucc

SEQ ID NO: 67491 - RNA, 23 nt, Artificial Sequence
  RNA Oligomer
cccaucaaaucgcugcaccuccc

SEQ ID NO: 67492 - RNA, 23 nt, Artificial Sequence
  RNA Oligomer
ccaucaaaucgcugcaccuccca

SEQ ID NO: 67493 - RNA, 23 nt, Artificial Sequence
  RNA Oligomer
caucaaaucgcugcaccucccac

SEQ ID NO: 67494 - RNA, 23 nt, Artificial Sequence
  RNA Oligomer
aucaaaucgcugcaccucccacg

SEQ ID NO: 67495 - RNA, 23 nt, Artificial Sequence
  RNA Oligomer
gaaguagaucuucuuacagaaca

SEQ ID NO: 67496 - RNA, 23 nt, Artificial Sequence
  RNA Oligomer
aaguagaucuucuuacagaacac

SEQ ID NO: 67497 - RNA, 23 nt, Artificial Sequence
  RNA Oligomer
aguagaucuucuuacagaacacu

SEQ ID NO: 67498 - RNA, 23 nt, Artificial Sequence
  RNA Oligomer
guagaucuucuuacagaacacuu

SEQ ID NO: 67499 - RNA, 23 nt, Artificial Sequence
  RNA Oligomer
uagaucuucuuacagaacacuug

SEQ ID NO: 67500 - RNA, 23 nt, Artificial Sequence
  RNA Oligomer
cccccauagaugauugcugggac

SEQ ID NO: 67501 - RNA, 23 nt, Artificial Sequence
  RNA Oligomer
aagcccaugaugaaaauaauagg

SEQ ID NO: 67502 - RNA, 23 nt, Artificial Sequence
  RNA Oligomer
aagauguaggagaacaugaaaga

SEQ ID NO: 67503 - RNA, 23 nt, Artificial Sequence
  RNA Oligomer
agauguaggagaacaugaaagag

SEQ ID NO: 67504 - RNA, 23 nt, Artificial Sequence
  RNA Oligomer
augaagcgcuugaacuguugcac

SEQ ID NO: 67505 - RNA, 23 nt, Artificial Sequence
  RNA Oligomer
ugaagcgcuugaacuguugcacc

SEQ ID NO: 67506 - RNA, 23 nt, Artificial Sequence
  RNA Oligomer
cagcaagggcuggaaugacguua

SEQ ID NO: 67507 - RNA, 23 nt, Artificial Sequence
  RNA Oligomer
agcaagggcuggaaugacguuac

SEQ ID NO: 67508 - RNA, 23 nt, Artificial Sequence
  RNA Oligomer
gcaagggcuggaaugacguuacc

SEQ ID NO: 67509 - RNA, 23 nt, Artificial Sequence
  RNA Oligomer
caagggcuggaaugacguuaccu

SEQ ID NO: 67510 - RNA, 23 nt, Artificial Sequence
  RNA Oligomer
aagggcuggaaugacguuaccuu

SEQ ID NO: 67511 - RNA, 23 nt, Artificial Sequence
  RNA Oligomer
cuccaaguuaaacagcagcacca

SEQ ID NO: 67512 - RNA, 23 nt, Artificial Sequence
  RNA Oligomer
uccaaguuaaacagcagcaccag

SEQ ID NO: 67513 - RNA, 23 nt, Artificial Sequence
  RNA Oligomer
ccaaguuaaacagcagcaccagg

SEQ ID NO: 67514 - RNA, 23 nt, Artificial Sequence
  RNA Oligomer
cuggagccucuugaaauuucuca

SEQ ID NO: 67515 - RNA, 23 nt, Artificial Sequence
  RNA Oligomer
uggagccucuugaaauuucucau

SEQ ID NO: 67516 - RNA, 23 nt, Artificial Sequence
  RNA Oligomer
ggagccucuugaaauuucucauc

SEQ ID NO: 67517 - RNA, 23 nt, Artificial Sequence
  RNA Oligomer
uuauuuggaagggagacuacugg

SEQ ID NO: 67518 - RNA, 23 nt, Artificial Sequence
  RNA Oligomer
uauuuggaagggagacuacugga

SEQ ID NO: 67519 - RNA, 23 nt, Artificial Sequence
  RNA Oligomer
auuuggaagggagacuacuggag

SEQ ID NO: 67520 - RNA, 23 nt, Artificial Sequence
  RNA Oligomer
uuuggaagggagacuacuggagc

SEQ ID NO: 67521 - RNA, 23 nt, Artificial Sequence
  RNA Oligomer
uuggaagggagacuacuggagca

SEQ ID NO: 67522 - RNA, 23 nt, Artificial Sequence
  RNA Oligomer
aguggguuucuguaaauggcuug

SEQ ID NO: 67523 - RNA, 23 nt, Artificial Sequence
  RNA Oligomer
cugguacacgccaucugcauagc

SEQ ID NO: 67524 - RNA, 23 nt, Artificial Sequence
  RNA Oligomer
ugguacacgccaucugcauagcu

SEQ ID NO: 67525 - RNA, 23 nt, Artificial Sequence
  RNA Oligomer
gguacacgccaucugcauagcug

SEQ ID NO: 67526 - RNA, 23 nt, Artificial Sequence
  RNA Oligomer
guacacgccaucugcauagcugg

SEQ ID NO: 67527 - RNA, 23 nt, Artificial Sequence
  RNA Oligomer
uacacgccaucugcauagcuggc

SEQ ID NO: 67528 - RNA, 23 nt, Artificial Sequence
  RNA Oligomer
uuuguuucugaagucuggaagca

SEQ ID NO: 67529 - RNA, 23 nt, Artificial Sequence
  RNA Oligomer
uuguuucugaagucuggaagcag

SEQ ID NO: 67530 - RNA, 23 nt, Artificial Sequence
  RNA Oligomer
agaucuucuuacagaacacuugg

SEQ ID NO: 67531 - RNA, 23 nt, Artificial Sequence
  RNA Oligomer
ucuuacagaacacuuggcagcug

SEQ ID NO: 67532 - RNA, 23 nt, Artificial Sequence
  RNA Oligomer
ugacuuguacucaaagcccuggg

SEQ ID NO: 67533 - RNA, 23 nt, Artificial Sequence
  RNA Oligomer
gcagaagcccaugaugaaaauaa

SEQ ID NO: 67534 - RNA, 23 nt, Artificial Sequence
  RNA Oligomer
cagaagcccaugaugaaaauaau

SEQ ID NO: 67535 - RNA, 23 nt, Artificial Sequence
  RNA Oligomer
agaagcccaugaugaaaauaaua

SEQ ID NO: 67536 - RNA, 23 nt, Artificial Sequence
  RNA Oligomer
gaagcccaugaugaaaauaauag

SEQ ID NO: 67537 - RNA, 23 nt, Artificial Sequence
  RNA Oligomer
ugggaggcaaagacauacaugau

SEQ ID NO: 67538 - RNA, 23 nt, Artificial Sequence
  RNA Oligomer
gggaggcaaagacauacaugaug

SEQ ID NO: 67539 - RNA, 23 nt, Artificial Sequence
  RNA Oligomer
agggcuggaaugacguuaccuuc

SEQ ID NO: 67540 - RNA, 23 nt, Artificial Sequence
  RNA Oligomer
augacguuaccuucuugccaaac

SEQ ID NO: 67541 - RNA, 23 nt, Artificial Sequence
  RNA Oligomer
ugaggccauucccaucaaagucg

SEQ ID NO: 67542 - RNA, 23 nt, Artificial Sequence
  RNA Oligomer
gaggccauucccaucaaagucgu

SEQ ID NO: 67543 - RNA, 23 nt, Artificial Sequence
  RNA Oligomer
aggccauucccaucaaagucgua

SEQ ID NO: 67544 - RNA, 23 nt, Artificial Sequence
  RNA Oligomer
auaaggcgagacuuuuccucagg

SEQ ID NO: 67545 - RNA, 23 nt, Artificial Sequence
  RNA Oligomer
gccauugccauccuugucagcca

SEQ ID NO: 67546 - RNA, 23 nt, Artificial Sequence
  RNA Oligomer
ccauugccauccuugucagccag

SEQ ID NO: 67547 - RNA, 23 nt, Artificial Sequence
  RNA Oligomer
cauugccauccuugucagccaga

SEQ ID NO: 67548 - RNA, 23 nt, Artificial Sequence
  RNA Oligomer
auugccauccuugucagccagag

SEQ ID NO: 67549 - RNA, 23 nt, Artificial Sequence
  RNA Oligomer
uugccauccuugucagccagaga

SEQ ID NO: 67550 - RNA, 23 nt, Artificial Sequence
  RNA Oligomer
agagaacauggacuccacaaaca

SEQ ID NO: 67551 - RNA, 23 nt, Artificial Sequence
  RNA Oligomer
gagaacauggacuccacaaacau

SEQ ID NO: 67552 - RNA, 23 nt, Artificial Sequence
  RNA Oligomer
agaacauggacuccacaaacaug

SEQ ID NO: 67553 - RNA, 23 nt, Artificial Sequence
  RNA Oligomer
gcucuuccuccaaguuaaacagc

SEQ ID NO: 67554 - RNA, 23 nt, Artificial Sequence
  RNA Oligomer
cucuuccuccaaguuaaacagca

SEQ ID NO: 67555 - RNA, 23 nt, Artificial Sequence
  RNA Oligomer
ucuuccuccaaguuaaacagcag

SEQ ID NO: 67556 - RNA, 23 nt, Artificial Sequence
  RNA Oligomer
cuuccuccaaguuaaacagcagc

SEQ ID NO: 67557 - RNA, 23 nt, Artificial Sequence
  RNA Oligomer
uuccuccaaguuaaacagcagca

SEQ ID NO: 67558 - RNA, 23 nt, Artificial Sequence
  RNA Oligomer
ccacugcccucaaaauagucacg

SEQ ID NO: 67559 - RNA, 23 nt, Artificial Sequence
  RNA Oligomer
cacugcccucaaaauagucacga

SEQ ID NO: 67560 - RNA, 23 nt, Artificial Sequence
  RNA Oligomer
acugcccucaaaauagucacgaa

SEQ ID NO: 67561 - RNA, 23 nt, Artificial Sequence
  RNA Oligomer
cugcccucaaaauagucacgaac

SEQ ID NO: 67562 - RNA, 23 nt, Artificial Sequence
  RNA Oligomer
ugcccucaaaauagucacgaaca

SEQ ID NO: 67563 - RNA, 23 nt, Artificial Sequence
  RNA Oligomer
acaaagacauugggcugcagagc

SEQ ID NO: 67564 - RNA, 23 nt, Artificial Sequence
  RNA Oligomer
gcgggaaaacuucaguggcccag

SEQ ID NO: 67565 - RNA, 23 nt, Artificial Sequence
  RNA Oligomer
cgggaaaacuucaguggcccagg

SEQ ID NO: 67566 - RNA, 23 nt, Artificial Sequence
  RNA Oligomer
gggaaaacuucaguggcccaggc

SEQ ID NO: 67567 - RNA, 23 nt, Artificial Sequence
  RNA Oligomer
ggaaaacuucaguggcccaggcc

SEQ ID NO: 67568 - RNA, 23 nt, Artificial Sequence
  RNA Oligomer
gaaaacuucaguggcccaggcca

SEQ ID NO: 67569 - RNA, 23 nt, Artificial Sequence
  RNA Oligomer
aaaacuucaguggcccaggccag

SEQ ID NO: 67570 - RNA, 23 nt, Artificial Sequence
  RNA Oligomer
gcacgugauagccaaagaagacc

SEQ ID NO: 67571 - RNA, 23 nt, Artificial Sequence
  RNA Oligomer
gccgaguggguuucuguaaaugg

SEQ ID NO: 67572 - RNA, 23 nt, Artificial Sequence
  RNA Oligomer
ccgaguggguuucuguaaauggc

SEQ ID NO: 67573 - RNA, 23 nt, Artificial Sequence
  RNA Oligomer
cgaguggguuucuguaaauggcu

SEQ ID NO: 67574 - RNA, 23 nt, Artificial Sequence
  RNA Oligomer
gaguggguuucuguaaauggcuu

SEQ ID NO: 67575 - RNA, 23 nt, Artificial Sequence
  RNA Oligomer
ccacugcauccuuacacucaccg

SEQ ID NO: 67576 - RNA, 23 nt, Artificial Sequence
  RNA Oligomer
cacugcauccuuacacucaccgc

SEQ ID NO: 67577 - RNA, 23 nt, Artificial Sequence
  RNA Oligomer
acugcauccuuacacucaccgcc

SEQ ID NO: 67578 - RNA, 23 nt, Artificial Sequence
  RNA Oligomer
cugcauccuuacacucaccgccc

SEQ ID NO: 67579 - RNA, 23 nt, Artificial Sequence
  RNA Oligomer
ugcauccuuacacucaccgcccc

SEQ ID NO: 67580 - RNA, 23 nt, Artificial Sequence
  RNA Oligomer
cacauaguacuugucaggucagc

SEQ ID NO: 67581 - RNA, 23 nt, Artificial Sequence
  RNA Oligomer
acauaguacuugucaggucagcu

SEQ ID NO: 67582 - RNA, 23 nt, Artificial Sequence
  RNA Oligomer
cauaguacuugucaggucagcuu

SEQ ID NO: 67583 - RNA, 23 nt, Artificial Sequence
  RNA Oligomer
auaguacuugucaggucagcuug

SEQ ID NO: 67584 - RNA, 23 nt, Artificial Sequence
  RNA Oligomer
uaguacuugucaggucagcuugu

SEQ ID NO: 67585 - RNA, 23 nt, Artificial Sequence
  RNA Oligomer
uaauggugggagaagugaguccg

SEQ ID NO: 67586 - RNA, 23 nt, Artificial Sequence
  RNA Oligomer
aauggugggagaagugaguccgg

SEQ ID NO: 67587 - RNA, 23 nt, Artificial Sequence
  RNA Oligomer
uguuguaccacccaucaaaucgc

SEQ ID NO: 67588 - RNA, 23 nt, Artificial Sequence
  RNA Oligomer
guuguaccacccaucaaaucgcu

SEQ ID NO: 67589 - RNA, 23 nt, Artificial Sequence
  RNA Oligomer
uuguaccacccaucaaaucgcug

SEQ ID NO: 67590 - RNA, 23 nt, Artificial Sequence
  RNA Oligomer
uguaccacccaucaaaucgcugc

SEQ ID NO: 67591 - RNA, 23 nt, Artificial Sequence
  RNA Oligomer
guaccacccaucaaaucgcugca

SEQ ID NO: 67592 - RNA, 23 nt, Artificial Sequence
  RNA Oligomer
aagcuaccauggaugaugagcag

SEQ ID NO: 67593 - RNA, 23 nt, Artificial Sequence
  RNA Oligomer
agcuaccauggaugaugagcagg

SEQ ID NO: 67594 - RNA, 23 nt, Artificial Sequence
  RNA Oligomer
gcuaccauggaugaugagcagga

SEQ ID NO: 67595 - RNA, 23 nt, Artificial Sequence
  RNA Oligomer
cuaccauggaugaugagcaggac

SEQ ID NO: 67596 - RNA, 23 nt, Artificial Sequence
  RNA Oligomer
uaccauggaugaugagcaggaca

SEQ ID NO: 67597 - RNA, 23 nt, Artificial Sequence
  RNA Oligomer
gacauagagcaggauguagaggu

SEQ ID NO: 67598 - RNA, 23 nt, Artificial Sequence
  RNA Oligomer
acauagagcaggauguagaggug

SEQ ID NO: 67599 - RNA, 23 nt, Artificial Sequence
  RNA Oligomer
cauagagcaggauguagaggugg

SEQ ID NO: 67600 - RNA, 23 nt, Artificial Sequence
  RNA Oligomer
auagagcaggauguagagguggu

SEQ ID NO: 67601 - RNA, 23 nt, Artificial Sequence
  RNA Oligomer
uagagcaggauguagagguggug

SEQ ID NO: 67602 - RNA, 23 nt, Artificial Sequence
  RNA Oligomer
uggugagcaagauguaggagaac

SEQ ID NO: 67603 - RNA, 23 nt, Artificial Sequence
  RNA Oligomer
guaguucucaaugaagcgcuuga

SEQ ID NO: 67604 - RNA, 23 nt, Artificial Sequence
  RNA Oligomer
uaguucucaaugaagcgcuugaa

SEQ ID NO: 67605 - RNA, 23 nt, Artificial Sequence
  RNA Oligomer
aguucucaaugaagcgcuugaac

SEQ ID NO: 67606 - RNA, 23 nt, Artificial Sequence
  RNA Oligomer
guucucaaugaagcgcuugaacu

SEQ ID NO: 67607 - RNA, 23 nt, Artificial Sequence
  RNA Oligomer
uucucaaugaagcgcuugaacug

SEQ ID NO: 67608 - RNA, 23 nt, Artificial Sequence
  RNA Oligomer
gaagcgcuugaacuguugcaccg

SEQ ID NO: 67609 - RNA, 23 nt, Artificial Sequence
  RNA Oligomer
gugucaacucagucucaaugucg

SEQ ID NO: 67610 - RNA, 23 nt, Artificial Sequence
  RNA Oligomer
gaagugaaaaucuucccauguca

SEQ ID NO: 67611 - RNA, 23 nt, Artificial Sequence
  RNA Oligomer
aagugaaaaucuucccaugucag

SEQ ID NO: 67612 - RNA, 23 nt, Artificial Sequence
  RNA Oligomer
agugaaaaucuucccaugucagu

SEQ ID NO: 67613 - RNA, 23 nt, Artificial Sequence
  RNA Oligomer
gugaaaaucuucccaugucaguu

SEQ ID NO: 67614 - RNA, 23 nt, Artificial Sequence
  RNA Oligomer
ugaaaaucuucccaugucaguuc

SEQ ID NO: 67615 - RNA, 23 nt, Artificial Sequence
  RNA Oligomer
gaugaacucauccuuggaaauga

SEQ ID NO: 67616 - RNA, 23 nt, Artificial Sequence
  RNA Oligomer
augaacucauccuuggaaaugag

SEQ ID NO: 67617 - RNA, 23 nt, Artificial Sequence
  RNA Oligomer
ugaacucauccuuggaaaugagg

SEQ ID NO: 67618 - RNA, 23 nt, Artificial Sequence
  RNA Oligomer
gaacucauccuuggaaaugaggc

SEQ ID NO: 67619 - RNA, 23 nt, Artificial Sequence
  RNA Oligomer
aacucauccuuggaaaugaggcc

SEQ ID NO: 67620 - RNA, 23 nt, Artificial Sequence
  RNA Oligomer
ggagagccuuucaugaagaccac

SEQ ID NO: 67621 - RNA, 23 nt, Artificial Sequence
  RNA Oligomer
gagagccuuucaugaagaccacc

SEQ ID NO: 67622 - RNA, 23 nt, Artificial Sequence
  RNA Oligomer
agagccuuucaugaagaccacca

SEQ ID NO: 67623 - RNA, 23 nt, Artificial Sequence
  RNA Oligomer
gagccuuucaugaagaccaccag

SEQ ID NO: 67624 - RNA, 23 nt, Artificial Sequence
  RNA Oligomer
agccuuucaugaagaccaccagg

SEQ ID NO: 67625 - RNA, 23 nt, Artificial Sequence
  RNA Oligomer
gccuuucaugaagaccaccagga

SEQ ID NO: 67626 - RNA, 23 nt, Artificial Sequence
  RNA Oligomer
ccuuucaugaagaccaccaggau

SEQ ID NO: 67627 - RNA, 23 nt, Artificial Sequence
  RNA Oligomer
cuuucaugaagaccaccaggaug

SEQ ID NO: 67628 - RNA, 23 nt, Artificial Sequence
  RNA Oligomer
cgcucuuccuccaaguuaaacag

SEQ ID NO: 67629 - RNA, 23 nt, Artificial Sequence
  RNA Oligomer
ugccauuccaaagcuuccaugcc

SEQ ID NO: 67630 - RNA, 23 nt, Artificial Sequence
  RNA Oligomer
auccacugcccucaaaauaguca

SEQ ID NO: 67631 - RNA, 23 nt, Artificial Sequence
  RNA Oligomer
uccacugcccucaaaauagucac

SEQ ID NO: 67632 - RNA, 23 nt, Artificial Sequence
  RNA Oligomer
agaaaucccgcacaucuucaacc

SEQ ID NO: 67633 - RNA, 23 nt, Artificial Sequence
  RNA Oligomer
gaaaucccgcacaucuucaacca

SEQ ID NO: 67634 - RNA, 23 nt, Artificial Sequence
  RNA Oligomer
aaaucccgcacaucuucaaccaa

SEQ ID NO: 67635 - RNA, 23 nt, Artificial Sequence
  RNA Oligomer
aaucccgcacaucuucaaccaac

SEQ ID NO: 67636 - RNA, 23 nt, Artificial Sequence
  RNA Oligomer
aucccgcacaucuucaaccaaca

SEQ ID NO: 67637 - RNA, 23 nt, Artificial Sequence
  RNA Oligomer
agcgauguucugguagguggcga

SEQ ID NO: 67638 - RNA, 23 nt, Artificial Sequence
  RNA Oligomer
gcgauguucugguagguggcgau

SEQ ID NO: 67639 - RNA, 23 nt, Artificial Sequence
  RNA Oligomer
cgauguucugguagguggcgaug

SEQ ID NO: 67640 - RNA, 23 nt, Artificial Sequence
  RNA Oligomer
gauguucugguagguggcgauga

SEQ ID NO: 67641 - RNA, 23 nt, Artificial Sequence
  RNA Oligomer
auguucugguagguggcgaugac

SEQ ID NO: 67642 - RNA, 23 nt, Artificial Sequence
  RNA Oligomer
ccccaacacugugcgguuucuca

SEQ ID NO: 67643 - RNA, 23 nt, Artificial Sequence
  RNA Oligomer
cccaacacugugcgguuucucag

SEQ ID NO: 67644 - RNA, 23 nt, Artificial Sequence
  RNA Oligomer
ccaacacugugcgguuucucagg

SEQ ID NO: 67645 - RNA, 23 nt, Artificial Sequence
  RNA Oligomer
caacacugugcgguuucucaggg

SEQ ID NO: 67646 - RNA, 23 nt, Artificial Sequence
  RNA Oligomer
aacacugugcgguuucucaggga

SEQ ID NO: 67647 - RNA, 23 nt, Artificial Sequence
  RNA Oligomer
ccagaagaggaggagguauggga

SEQ ID NO: 67648 - RNA, 23 nt, Artificial Sequence
  RNA Oligomer
cagaagaggaggagguaugggag

SEQ ID NO: 67649 - RNA, 23 nt, Artificial Sequence
  RNA Oligomer
agaagaggaggagguaugggagu

SEQ ID NO: 67650 - RNA, 23 nt, Artificial Sequence
  RNA Oligomer
gaagaggaggagguaugggagua

SEQ ID NO: 67651 - RNA, 23 nt, Artificial Sequence
  RNA Oligomer
aagaggaggagguaugggaguag

SEQ ID NO: 67652 - RNA, 23 nt, Artificial Sequence
  RNA Oligomer
acacacauacagacaugcacaca

SEQ ID NO: 67653 - RNA, 23 nt, Artificial Sequence
  RNA Oligomer
cacacauacagacaugcacacac

SEQ ID NO: 67654 - RNA, 23 nt, Artificial Sequence
  RNA Oligomer
auggugacugacuauggccaccu

SEQ ID NO: 67655 - RNA, 23 nt, Artificial Sequence
  RNA Oligomer
uggugacugacuauggccaccug

SEQ ID NO: 67656 - RNA, 23 nt, Artificial Sequence
  RNA Oligomer
ggugacugacuauggccaccugg

SEQ ID NO: 67657 - RNA, 23 nt, Artificial Sequence
  RNA Oligomer
gugacugacuauggccaccugga

SEQ ID NO: 67658 - RNA, 23 nt, Artificial Sequence
  RNA Oligomer
ugacugacuauggccaccuggaa

SEQ ID NO: 67659 - RNA, 23 nt, Artificial Sequence
  RNA Oligomer
auggugggagaagugaguccggu

SEQ ID NO: 67660 - RNA, 23 nt, Artificial Sequence
  RNA Oligomer
uuguuguaccacccaucaaaucg

SEQ ID NO: 67661 - RNA, 23 nt, Artificial Sequence
  RNA Oligomer
uaccacccaucaaaucgcugcac

SEQ ID NO: 67662 - RNA, 23 nt, Artificial Sequence
  RNA Oligomer
ggccugugaauagacuccgguuc

SEQ ID NO: 67663 - RNA, 23 nt, Artificial Sequence
  RNA Oligomer
gccugugaauagacuccgguuca

SEQ ID NO: 67664 - RNA, 23 nt, Artificial Sequence
  RNA Oligomer
ccugugaauagacuccgguucag

SEQ ID NO: 67665 - RNA, 23 nt, Artificial Sequence
  RNA Oligomer
cugugaauagacuccgguucaga

SEQ ID NO: 67666 - RNA, 23 nt, Artificial Sequence
  RNA Oligomer
ugugaauagacuccgguucagaa

SEQ ID NO: 67667 - RNA, 23 nt, Artificial Sequence
  RNA Oligomer
uguacagcauagugguccugagg

SEQ ID NO: 67668 - RNA, 23 nt, Artificial Sequence
  RNA Oligomer
guacagcauagugguccugaggu

SEQ ID NO: 67669 - RNA, 23 nt, Artificial Sequence
  RNA Oligomer
ccccaaccagaaguguccaugcu

SEQ ID NO: 67670 - RNA, 23 nt, Artificial Sequence
  RNA Oligomer
cccaaccagaaguguccaugcua

SEQ ID NO: 67671 - RNA, 23 nt, Artificial Sequence
  RNA Oligomer
ccaaccagaaguguccaugcuag

SEQ ID NO: 67672 - RNA, 23 nt, Artificial Sequence
  RNA Oligomer
caaccagaaguguccaugcuaga

SEQ ID NO: 67673 - RNA, 23 nt, Artificial Sequence
  RNA Oligomer
aaccagaaguguccaugcuagag

SEQ ID NO: 67674 - RNA, 23 nt, Artificial Sequence
  RNA Oligomer
ggcaaagcuaccauggaugauga

SEQ ID NO: 67675 - RNA, 23 nt, Artificial Sequence
  RNA Oligomer
gcaaagcuaccauggaugaugag

SEQ ID NO: 67676 - RNA, 23 nt, Artificial Sequence
  RNA Oligomer
caaagcuaccauggaugaugagc

SEQ ID NO: 67677 - RNA, 23 nt, Artificial Sequence
  RNA Oligomer
aaagcuaccauggaugaugagca

SEQ ID NO: 67678 - RNA, 23 nt, Artificial Sequence
  RNA Oligomer
cacuguguaagacugugaggacg

SEQ ID NO: 67679 - RNA, 23 nt, Artificial Sequence
  RNA Oligomer
acuguguaagacugugaggacga

SEQ ID NO: 67680 - RNA, 23 nt, Artificial Sequence
  RNA Oligomer
cuguguaagacugugaggacgau

SEQ ID NO: 67681 - RNA, 23 nt, Artificial Sequence
  RNA Oligomer
uguguaagacugugaggacgaug

SEQ ID NO: 67682 - RNA, 23 nt, Artificial Sequence
  RNA Oligomer
gcuggaaugacguuaccuucuug

SEQ ID NO: 67683 - RNA, 23 nt, Artificial Sequence
  RNA Oligomer
caugaagugaaaaucuucccaug

SEQ ID NO: 67684 - RNA, 23 nt, Artificial Sequence
  RNA Oligomer
augaagugaaaaucuucccaugu

SEQ ID NO: 67685 - RNA, 23 nt, Artificial Sequence
  RNA Oligomer
ugaagugaaaaucuucccauguc

SEQ ID NO: 67686 - RNA, 23 nt, Artificial Sequence
  RNA Oligomer
uucccaucaaagucguacaugcg

SEQ ID NO: 67687 - RNA, 23 nt, Artificial Sequence
  RNA Oligomer
ucccaucaaagucguacaugcgg

SEQ ID NO: 67688 - RNA, 23 nt, Artificial Sequence
  RNA Oligomer
cccaucaaagucguacaugcgga

SEQ ID NO: 67689 - RNA, 23 nt, Artificial Sequence
  RNA Oligomer
ccaucaaagucguacaugcggaa

SEQ ID NO: 67690 - RNA, 23 nt, Artificial Sequence
  RNA Oligomer
caucaaagucguacaugcggaac

SEQ ID NO: 67691 - RNA, 23 nt, Artificial Sequence
  RNA Oligomer
aggagagccuuucaugaagacca

SEQ ID NO: 67692 - RNA, 23 nt, Artificial Sequence
  RNA Oligomer
auccuugucagccagagagaaca

SEQ ID NO: 67693 - RNA, 23 nt, Artificial Sequence
  RNA Oligomer
uccuugucagccagagagaacau

SEQ ID NO: 67694 - RNA, 23 nt, Artificial Sequence
  RNA Oligomer
ccuugucagccagagagaacaug

SEQ ID NO: 67695 - RNA, 23 nt, Artificial Sequence
  RNA Oligomer
cuugucagccagagagaacaugg

SEQ ID NO: 67696 - RNA, 23 nt, Artificial Sequence
  RNA Oligomer
uugucagccagagagaacaugga

SEQ ID NO: 67697 - RNA, 23 nt, Artificial Sequence
  RNA Oligomer
uggacuccacaaacauguccugg

SEQ ID NO: 67698 - RNA, 23 nt, Artificial Sequence
  RNA Oligomer
ggacuccacaaacauguccuggg

SEQ ID NO: 67699 - RNA, 23 nt, Artificial Sequence
  RNA Oligomer
gacuccacaaacauguccugggg

SEQ ID NO: 67700 - RNA, 23 nt, Artificial Sequence
  RNA Oligomer
acuccacaaacauguccuggggc

SEQ ID NO: 67701 - RNA, 23 nt, Artificial Sequence
  RNA Oligomer
cuccacaaacauguccuggggcu

SEQ ID NO: 67702 - RNA, 23 nt, Artificial Sequence
  RNA Oligomer
ccggagauuuuccaccagcgccu

SEQ ID NO: 67703 - RNA, 23 nt, Artificial Sequence
  RNA Oligomer
cggagauuuuccaccagcgccug

SEQ ID NO: 67704 - RNA, 23 nt, Artificial Sequence
  RNA Oligomer
ggagauuuuccaccagcgccugc

SEQ ID NO: 67705 - RNA, 23 nt, Artificial Sequence
  RNA Oligomer
gagauuuuccaccagcgccugcc

SEQ ID NO: 67706 - RNA, 23 nt, Artificial Sequence
  RNA Oligomer
agauuuuccaccagcgccugccg

SEQ ID NO: 67707 - RNA, 23 nt, Artificial Sequence
  RNA Oligomer
uccuccaaguuaaacagcagcac

SEQ ID NO: 67708 - RNA, 23 nt, Artificial Sequence
  RNA Oligomer
ccuccaaguuaaacagcagcacc

SEQ ID NO: 67709 - RNA, 23 nt, Artificial Sequence
  RNA Oligomer
uaaacagcagcaccaggucauac

SEQ ID NO: 67710 - RNA, 23 nt, Artificial Sequence
  RNA Oligomer
acgguugcuggacaggacgaagu

SEQ ID NO: 67711 - RNA, 23 nt, Artificial Sequence
  RNA Oligomer
cgguugcuggacaggacgaaguu

SEQ ID NO: 67712 - RNA, 23 nt, Artificial Sequence
  RNA Oligomer
gguugcuggacaggacgaaguug

SEQ ID NO: 67713 - RNA, 23 nt, Artificial Sequence
  RNA Oligomer
guugcuggacaggacgaaguuga

SEQ ID NO: 67714 - RNA, 23 nt, Artificial Sequence
  RNA Oligomer
uugcuggacaggacgaaguugac

SEQ ID NO: 67715 - RNA, 23 nt, Artificial Sequence
  RNA Oligomer
uugaaauuucucauccggagccg

SEQ ID NO: 67716 - RNA, 23 nt, Artificial Sequence
  RNA Oligomer
agucacgaacaacagagggagca

SEQ ID NO: 67717 - RNA, 23 nt, Artificial Sequence
  RNA Oligomer
gacgauggugcugaacagagguc

SEQ ID NO: 67718 - RNA, 23 nt, Artificial Sequence
  RNA Oligomer
acgauggugcugaacagaggucc

SEQ ID NO: 67719 - RNA, 23 nt, Artificial Sequence
  RNA Oligomer
cgauggugcugaacagaggucca

SEQ ID NO: 67720 - RNA, 23 nt, Artificial Sequence
  RNA Oligomer
gauggugcugaacagagguccag

SEQ ID NO: 67721 - RNA, 23 nt, Artificial Sequence
  RNA Oligomer
auggugcugaacagagguccagg

SEQ ID NO: 67722 - RNA, 23 nt, Artificial Sequence
  RNA Oligomer
ggccuccaguacagugucauugc

SEQ ID NO: 67723 - RNA, 23 nt, Artificial Sequence
  RNA Oligomer
gccuccaguacagugucauugcu

SEQ ID NO: 67724 - RNA, 23 nt, Artificial Sequence
  RNA Oligomer
ccuccaguacagugucauugcuc

SEQ ID NO: 67725 - RNA, 23 nt, Artificial Sequence
  RNA Oligomer
cauccacaucuucagcacuuugu

SEQ ID NO: 67726 - RNA, 23 nt, Artificial Sequence
  RNA Oligomer
auccacaucuucagcacuuugua

SEQ ID NO: 67727 - RNA, 23 nt, Artificial Sequence
  RNA Oligomer
uccacaucuucagcacuuuguag

SEQ ID NO: 67728 - RNA, 23 nt, Artificial Sequence
  RNA Oligomer
augcucccacugcauccuuacac

SEQ ID NO: 67729 - RNA, 23 nt, Artificial Sequence
  RNA Oligomer
ugcucccacugcauccuuacacu

SEQ ID NO: 67730 - RNA, 23 nt, Artificial Sequence
  RNA Oligomer
gcucccacugcauccuuacacuc

SEQ ID NO: 67731 - RNA, 23 nt, Artificial Sequence
  RNA Oligomer
cucccacugcauccuuacacuca

SEQ ID NO: 67732 - RNA, 23 nt, Artificial Sequence
  RNA Oligomer
ucccacugcauccuuacacucac

SEQ ID NO: 67733 - RNA, 23 nt, Artificial Sequence
  RNA Oligomer
cauacagacaugcacacacauag

SEQ ID NO: 67734 - RNA, 23 nt, Artificial Sequence
  RNA Oligomer
auacagacaugcacacacauagu

SEQ ID NO: 67735 - RNA, 23 nt, Artificial Sequence
  RNA Oligomer
acagacaugcacacacauaguac

SEQ ID NO: 67736 - RNA, 23 nt, Artificial Sequence
  RNA Oligomer
cagacaugcacacacauaguacu

SEQ ID NO: 67737 - RNA, 23 nt, Artificial Sequence
  RNA Oligomer
gacaugcacacacauaguacuug

SEQ ID NO: 67738 - RNA, 23 nt, Artificial Sequence
  RNA Oligomer
acaugcacacacauaguacuugu

SEQ ID NO: 67739 - RNA, 23 nt, Artificial Sequence
  RNA Oligomer
caugcacacacauaguacuuguc

SEQ ID NO: 67740 - RNA, 23 nt, Artificial Sequence
  RNA Oligomer
augcacacacauaguacuuguca

SEQ ID NO: 67741 - RNA, 23 nt, Artificial Sequence
  RNA Oligomer
ugcacacacauaguacuugucag

SEQ ID NO: 67742 - RNA, 23 nt, Artificial Sequence
  RNA Oligomer
gcacacacauaguacuugucagg

SEQ ID NO: 67743 - RNA, 23 nt, Artificial Sequence
  RNA Oligomer
cacacacauaguacuugucaggu

SEQ ID NO: 67744 - RNA, 23 nt, Artificial Sequence
  RNA Oligomer
acacacauaguacuugucagguc

SEQ ID NO: 67745 - RNA, 23 nt, Artificial Sequence
  RNA Oligomer
cacacauaguacuugucagguca

SEQ ID NO: 67746 - RNA, 23 nt, Artificial Sequence
  RNA Oligomer
acacauaguacuugucaggucag

SEQ ID NO: 67747 - RNA, 23 nt, Artificial Sequence
  RNA Oligomer
uaggaagaacagaggugaggugu

SEQ ID NO: 67748 - RNA, 23 nt, Artificial Sequence
  RNA Oligomer
aggaagaacagaggugaggugug

SEQ ID NO: 67749 - RNA, 23 nt, Artificial Sequence
  RNA Oligomer
ggaagaacagaggugaggugugg

SEQ ID NO: 67750 - RNA, 23 nt, Artificial Sequence
  RNA Oligomer
gaagaacagaggugagguguggg

SEQ ID NO: 67751 - RNA, 23 nt, Artificial Sequence
  RNA Oligomer
aagaacagaggugaggugugggc

SEQ ID NO: 67752 - RNA, 23 nt, Artificial Sequence
  RNA Oligomer
ggcucaaaccucugcucaacugg

SEQ ID NO: 67753 - RNA, 23 nt, Artificial Sequence
  RNA Oligomer
gcucaaaccucugcucaacuggg

SEQ ID NO: 67754 - RNA, 23 nt, Artificial Sequence
  RNA Oligomer
cucaaaccucugcucaacugggc

SEQ ID NO: 67755 - RNA, 23 nt, Artificial Sequence
  RNA Oligomer
ucaaaccucugcucaacugggca

SEQ ID NO: 67756 - RNA, 23 nt, Artificial Sequence
  RNA Oligomer
caaaccucugcucaacugggcag

SEQ ID NO: 67757 - RNA, 23 nt, Artificial Sequence
  RNA Oligomer
cuccugcagggaguugaagaagg

SEQ ID NO: 67758 - RNA, 23 nt, Artificial Sequence
  RNA Oligomer
uccugcagggaguugaagaaggg

SEQ ID NO: 67759 - RNA, 23 nt, Artificial Sequence
  RNA Oligomer
ccugcagggaguugaagaagggc

SEQ ID NO: 67760 - RNA, 23 nt, Artificial Sequence
  RNA Oligomer
cugcagggaguugaagaagggcu

SEQ ID NO: 67761 - RNA, 23 nt, Artificial Sequence
  RNA Oligomer
ugcagggaguugaagaagggcuc

SEQ ID NO: 67762 - RNA, 23 nt, Artificial Sequence
  RNA Oligomer
agccagcugggugauguagaugu

SEQ ID NO: 67763 - RNA, 23 nt, Artificial Sequence
  RNA Oligomer
gccagcugggugauguagaugug

SEQ ID NO: 67764 - RNA, 23 nt, Artificial Sequence
  RNA Oligomer
ccagcugggugauguagaugugc

SEQ ID NO: 67765 - RNA, 23 nt, Artificial Sequence
  RNA Oligomer
cagcugggugauguagaugugca

SEQ ID NO: 67766 - RNA, 23 nt, Artificial Sequence
  RNA Oligomer
agcugggugauguagaugugcac

SEQ ID NO: 67767 - RNA, 23 nt, Artificial Sequence
  RNA Oligomer
cucccacuaacacugacaccuca

SEQ ID NO: 67768 - RNA, 23 nt, Artificial Sequence
  RNA Oligomer
ucccacuaacacugacaccucaa

SEQ ID NO: 67769 - RNA, 23 nt, Artificial Sequence
  RNA Oligomer
cccacuaacacugacaccucaaa

SEQ ID NO: 67770 - RNA, 23 nt, Artificial Sequence
  RNA Oligomer
ccacuaacacugacaccucaaac

SEQ ID NO: 67771 - RNA, 23 nt, Artificial Sequence
  RNA Oligomer
cacuaacacugacaccucaaacu

SEQ ID NO: 67772 - RNA, 23 nt, Artificial Sequence
  RNA Oligomer
acccacugcccugacuuguacuc

SEQ ID NO: 67773 - RNA, 23 nt, Artificial Sequence
  RNA Oligomer
cccacugcccugacuuguacuca

SEQ ID NO: 67774 - RNA, 23 nt, Artificial Sequence
  RNA Oligomer
ccacugcccugacuuguacucaa

SEQ ID NO: 67775 - RNA, 23 nt, Artificial Sequence
  RNA Oligomer
cacugcccugacuuguacucaaa

SEQ ID NO: 67776 - RNA, 23 nt, Artificial Sequence
  RNA Oligomer
acugcccugacuuguacucaaag

SEQ ID NO: 67777 - RNA, 23 nt, Artificial Sequence
  RNA Oligomer
agacauacaugauggccaggauc

SEQ ID NO: 67778 - RNA, 23 nt, Artificial Sequence
  RNA Oligomer
gacccaucaucauggaagaggcc

SEQ ID NO: 67779 - RNA, 23 nt, Artificial Sequence
  RNA Oligomer
acccaucaucauggaagaggcca

SEQ ID NO: 67780 - RNA, 23 nt, Artificial Sequence
  RNA Oligomer
cccaucaucauggaagaggccag

SEQ ID NO: 67781 - RNA, 23 nt, Artificial Sequence
  RNA Oligomer
ccaucaucauggaagaggccagg

SEQ ID NO: 67782 - RNA, 23 nt, Artificial Sequence
  RNA Oligomer
caucaucauggaagaggccagga

SEQ ID NO: 67783 - RNA, 23 nt, Artificial Sequence
  RNA Oligomer
acagguacacauucaccacaugg

SEQ ID NO: 67784 - RNA, 23 nt, Artificial Sequence
  RNA Oligomer
cagguacacauucaccacauggc

SEQ ID NO: 67785 - RNA, 23 nt, Artificial Sequence
  RNA Oligomer
agguacacauucaccacauggcc

SEQ ID NO: 67786 - RNA, 23 nt, Artificial Sequence
  RNA Oligomer
gguacacauucaccacauggccc

SEQ ID NO: 67787 - RNA, 23 nt, Artificial Sequence
  RNA Oligomer
guacacauucaccacauggccca

SEQ ID NO: 67788 - RNA, 23 nt, Artificial Sequence
  RNA Oligomer
cacacuguguaagacugugagga

SEQ ID NO: 67789 - RNA, 23 nt, Artificial Sequence
  RNA Oligomer
acacuguguaagacugugaggac

SEQ ID NO: 67790 - RNA, 23 nt, Artificial Sequence
  RNA Oligomer
cagcaugaagugaaaaucuuccc

SEQ ID NO: 67791 - RNA, 23 nt, Artificial Sequence
  RNA Oligomer
agcaugaagugaaaaucuuccca

SEQ ID NO: 67792 - RNA, 23 nt, Artificial Sequence
  RNA Oligomer
gcaugaagugaaaaucuucccau

SEQ ID NO: 67793 - RNA, 23 nt, Artificial Sequence
  RNA Oligomer
aaucuucccaugucaguuccucc

SEQ ID NO: 67794 - RNA, 23 nt, Artificial Sequence
  RNA Oligomer
aucuucccaugucaguuccuccu

SEQ ID NO: 67795 - RNA, 23 nt, Artificial Sequence
  RNA Oligomer
ucuucccaugucaguuccuccuu

SEQ ID NO: 67796 - RNA, 23 nt, Artificial Sequence
  RNA Oligomer
cuucccaugucaguuccuccuug

SEQ ID NO: 67797 - RNA, 23 nt, Artificial Sequence
  RNA Oligomer
uucccaugucaguuccuccuugu

SEQ ID NO: 67798 - RNA, 23 nt, Artificial Sequence
  RNA Oligomer
ggacaggcaguuguuggagaucu

SEQ ID NO: 67799 - RNA, 23 nt, Artificial Sequence
  RNA Oligomer
gacaggcaguuguuggagaucuc

SEQ ID NO: 67800 - RNA, 23 nt, Artificial Sequence
  RNA Oligomer
acaggcaguuguuggagaucucg

SEQ ID NO: 67801 - RNA, 23 nt, Artificial Sequence
  RNA Oligomer
caggcaguuguuggagaucucga

SEQ ID NO: 67802 - RNA, 23 nt, Artificial Sequence
  RNA Oligomer
aggcaguuguuggagaucucgau

SEQ ID NO: 67803 - RNA, 23 nt, Artificial Sequence
  RNA Oligomer
ccgcucuuccuccaaguuaaaca

SEQ ID NO: 67804 - RNA, 23 nt, Artificial Sequence
  RNA Oligomer
aaacagcagcaccaggucauacu

SEQ ID NO: 67805 - RNA, 23 nt, Artificial Sequence
  RNA Oligomer
ugcuggacaggacgaaguugacc

SEQ ID NO: 67806 - RNA, 23 nt, Artificial Sequence
  RNA Oligomer
gcuggacaggacgaaguugaccu

SEQ ID NO: 67807 - RNA, 23 nt, Artificial Sequence
  RNA Oligomer
cuggacaggacgaaguugaccuu

SEQ ID NO: 67808 - RNA, 23 nt, Artificial Sequence
  RNA Oligomer
uggccuccaguacagugucauug

SEQ ID NO: 67809 - RNA, 23 nt, Artificial Sequence
  RNA Oligomer
gcccagaagaggaggagguaugg

SEQ ID NO: 67810 - RNA, 23 nt, Artificial Sequence
  RNA Oligomer
cccagaagaggaggagguauggg

SEQ ID NO: 67811 - RNA, 23 nt, Artificial Sequence
  RNA Oligomer
cccacugcauccuuacacucacc

SEQ ID NO: 67812 - RNA, 23 nt, Artificial Sequence
  RNA Oligomer
gcagggaguugaagaagggcuca

SEQ ID NO: 67813 - RNA, 23 nt, Artificial Sequence
  RNA Oligomer
cagggaguugaagaagggcucaa

SEQ ID NO: 67814 - RNA, 23 nt, Artificial Sequence
  RNA Oligomer
agggaguugaagaagggcucaaa

SEQ ID NO: 67815 - RNA, 23 nt, Artificial Sequence
  RNA Oligomer
gccccaaccagaaguguccaugc

SEQ ID NO: 67816 - RNA, 23 nt, Artificial Sequence
  RNA Oligomer
ggacauagagcaggauguagagg

SEQ ID NO: 67817 - RNA, 23 nt, Artificial Sequence
  RNA Oligomer
caggauguagaggugguggguca

SEQ ID NO: 67818 - RNA, 23 nt, Artificial Sequence
  RNA Oligomer
aggauguagagguggugggucag

SEQ ID NO: 67819 - RNA, 23 nt, Artificial Sequence
  RNA Oligomer
ggauguagagguggugggucagc

SEQ ID NO: 67820 - RNA, 23 nt, Artificial Sequence
  RNA Oligomer
gauguagagguggugggucagcc

SEQ ID NO: 67821 - RNA, 23 nt, Artificial Sequence
  RNA Oligomer
auguagagguggugggucagcca

SEQ ID NO: 67822 - RNA, 23 nt, Artificial Sequence
  RNA Oligomer
gacauacaugauggccaggauca

SEQ ID NO: 67823 - RNA, 23 nt, Artificial Sequence
  RNA Oligomer
acauacaugauggccaggaucag

SEQ ID NO: 67824 - RNA, 23 nt, Artificial Sequence
  RNA Oligomer
ucgcaggaaggugaugagguugc

SEQ ID NO: 67825 - RNA, 23 nt, Artificial Sequence
  RNA Oligomer
cgcaggaaggugaugagguugcg

SEQ ID NO: 67826 - RNA, 23 nt, Artificial Sequence
  RNA Oligomer
gcaggaaggugaugagguugcgg

SEQ ID NO: 67827 - RNA, 23 nt, Artificial Sequence
  RNA Oligomer
caggaaggugaugagguugcggc

SEQ ID NO: 67828 - RNA, 23 nt, Artificial Sequence
  RNA Oligomer
aggaaggugaugagguugcggca

SEQ ID NO: 67829 - RNA, 23 nt, Artificial Sequence
  RNA Oligomer
gcggcacauggugagcaagaugu

SEQ ID NO: 67830 - RNA, 23 nt, Artificial Sequence
  RNA Oligomer
cggcacauggugagcaagaugua

SEQ ID NO: 67831 - RNA, 23 nt, Artificial Sequence
  RNA Oligomer
ggcacauggugagcaagauguag

SEQ ID NO: 67832 - RNA, 23 nt, Artificial Sequence
  RNA Oligomer
gacguuaccuucuugccaaaccu

SEQ ID NO: 67833 - RNA, 23 nt, Artificial Sequence
  RNA Oligomer
acguuaccuucuugccaaaccuc

SEQ ID NO: 67834 - RNA, 23 nt, Artificial Sequence
  RNA Oligomer
cguuaccuucuugccaaaccucc

SEQ ID NO: 67835 - RNA, 23 nt, Artificial Sequence
  RNA Oligomer
guuaccuucuugccaaaccuccg

SEQ ID NO: 67836 - RNA, 23 nt, Artificial Sequence
  RNA Oligomer
uuaccuucuugccaaaccuccgc

SEQ ID NO: 67837 - RNA, 23 nt, Artificial Sequence
  RNA Oligomer
cccaugucaguuccuccuugucc

SEQ ID NO: 67838 - RNA, 23 nt, Artificial Sequence
  RNA Oligomer
ccaugucaguuccuccuuguccu

SEQ ID NO: 67839 - RNA, 23 nt, Artificial Sequence
  RNA Oligomer
caugucaguuccuccuuguccug

SEQ ID NO: 67840 - RNA, 23 nt, Artificial Sequence
  RNA Oligomer
augucaguuccuccuuguccugg

SEQ ID NO: 67841 - RNA, 23 nt, Artificial Sequence
  RNA Oligomer
ugucaguuccuccuuguccugga

SEQ ID NO: 67842 - RNA, 23 nt, Artificial Sequence
  RNA Oligomer
gcccuggagccucuugaaauuuc

SEQ ID NO: 67843 - RNA, 23 nt, Artificial Sequence
  RNA Oligomer
cccuggagccucuugaaauuucu

SEQ ID NO: 67844 - RNA, 23 nt, Artificial Sequence
  RNA Oligomer
ccuggagccucuugaaauuucuc

SEQ ID NO: 67845 - RNA, 23 nt, Artificial Sequence
  RNA Oligomer
gucacgaacaacagagggagcac

SEQ ID NO: 67846 - RNA, 23 nt, Artificial Sequence
  RNA Oligomer
ucacgaacaacagagggagcaca

SEQ ID NO: 67847 - RNA, 23 nt, Artificial Sequence
  RNA Oligomer
cacaaauuguucaaggacgaugg

SEQ ID NO: 67848 - RNA, 23 nt, Artificial Sequence
  RNA Oligomer
acaaauuguucaaggacgauggu

SEQ ID NO: 67849 - RNA, 23 nt, Artificial Sequence
  RNA Oligomer
caaauuguucaaggacgauggug

SEQ ID NO: 67850 - RNA, 23 nt, Artificial Sequence
  RNA Oligomer
aaauuguucaaggacgauggugc

SEQ ID NO: 67851 - RNA, 23 nt, Artificial Sequence
  RNA Oligomer
aauuguucaaggacgauggugcu

SEQ ID NO: 67852 - RNA, 23 nt, Artificial Sequence
  RNA Oligomer
ccagaaaucccgcacaucuucaa

SEQ ID NO: 67853 - RNA, 23 nt, Artificial Sequence
  RNA Oligomer
cagaaaucccgcacaucuucaac

SEQ ID NO: 67854 - RNA, 23 nt, Artificial Sequence
  RNA Oligomer
caggucugaaagcacgugauagc

SEQ ID NO: 67855 - RNA, 23 nt, Artificial Sequence
  RNA Oligomer
aggucugaaagcacgugauagcc

SEQ ID NO: 67856 - RNA, 23 nt, Artificial Sequence
  RNA Oligomer
ggucugaaagcacgugauagcca

SEQ ID NO: 67857 - RNA, 23 nt, Artificial Sequence
  RNA Oligomer
gucugaaagcacgugauagccaa

SEQ ID NO: 67858 - RNA, 23 nt, Artificial Sequence
  RNA Oligomer
ucugaaagcacgugauagccaaa

SEQ ID NO: 67859 - RNA, 23 nt, Artificial Sequence
  RNA Oligomer
agcauugcauacauagguauugg

SEQ ID NO: 67860 - RNA, 23 nt, Artificial Sequence
  RNA Oligomer
gcauugcauacauagguauuggg

SEQ ID NO: 67861 - RNA, 23 nt, Artificial Sequence
  RNA Oligomer
cauugcauacauagguauugggc

SEQ ID NO: 67862 - RNA, 23 nt, Artificial Sequence
  RNA Oligomer
auugcauacauagguauugggcc

SEQ ID NO: 67863 - RNA, 23 nt, Artificial Sequence
  RNA Oligomer
uugcauacauagguauugggcca

SEQ ID NO: 67864 - RNA, 23 nt, Artificial Sequence
  RNA Oligomer
gggcucaaaccucugcucaacug

SEQ ID NO: 67865 - RNA, 23 nt, Artificial Sequence
  RNA Oligomer
gcugggugauguagaugugcaca

SEQ ID NO: 67866 - RNA, 23 nt, Artificial Sequence
  RNA Oligomer
cugggugauguagaugugcacag

SEQ ID NO: 67867 - RNA, 23 nt, Artificial Sequence
  RNA Oligomer
cagcugacggaugacuugaagac

SEQ ID NO: 67868 - RNA, 23 nt, Artificial Sequence
  RNA Oligomer
agcugacggaugacuugaagacc

SEQ ID NO: 67869 - RNA, 23 nt, Artificial Sequence
  RNA Oligomer
gcugacggaugacuugaagacca

SEQ ID NO: 67870 - RNA, 23 nt, Artificial Sequence
  RNA Oligomer
cugacggaugacuugaagaccag

SEQ ID NO: 67871 - RNA, 23 nt, Artificial Sequence
  RNA Oligomer
ugacggaugacuugaagaccagg

SEQ ID NO: 67872 - RNA, 23 nt, Artificial Sequence
  RNA Oligomer
gggcaaagcuaccauggaugaug

SEQ ID NO: 67873 - RNA, 23 nt, Artificial Sequence
  RNA Oligomer
gggcugauggagaacagguacac

SEQ ID NO: 67874 - RNA, 23 nt, Artificial Sequence
  RNA Oligomer
ggcugauggagaacagguacaca

SEQ ID NO: 67875 - RNA, 23 nt, Artificial Sequence
  RNA Oligomer
gcugauggagaacagguacacau

SEQ ID NO: 67876 - RNA, 23 nt, Artificial Sequence
  RNA Oligomer
cugauggagaacagguacacauu

SEQ ID NO: 67877 - RNA, 23 nt, Artificial Sequence
  RNA Oligomer
ugauggagaacagguacacauuc

SEQ ID NO: 67878 - RNA, 23 nt, Artificial Sequence
  RNA Oligomer
gauggagaacagguacacauuca

SEQ ID NO: 67879 - RNA, 23 nt, Artificial Sequence
  RNA Oligomer
auggagaacagguacacauucac

SEQ ID NO: 67880 - RNA, 23 nt, Artificial Sequence
  RNA Oligomer
uggagaacagguacacauucacc

SEQ ID NO: 67881 - RNA, 23 nt, Artificial Sequence
  RNA Oligomer
ggagaacagguacacauucacca

SEQ ID NO: 67882 - RNA, 23 nt, Artificial Sequence
  RNA Oligomer
gagaacagguacacauucaccac

SEQ ID NO: 67883 - RNA, 23 nt, Artificial Sequence
  RNA Oligomer
agaacagguacacauucaccaca

SEQ ID NO: 67884 - RNA, 23 nt, Artificial Sequence
  RNA Oligomer
ugacguuaccuucuugccaaacc

SEQ ID NO: 67885 - RNA, 23 nt, Artificial Sequence
  RNA Oligomer
ggugucaacucagucucaauguc

SEQ ID NO: 67886 - RNA, 23 nt, Artificial Sequence
  RNA Oligomer
cgggcaacaauccaggcacugag

SEQ ID NO: 67887 - RNA, 23 nt, Artificial Sequence
  RNA Oligomer
gggcaacaauccaggcacugagc

SEQ ID NO: 67888 - RNA, 23 nt, Artificial Sequence
  RNA Oligomer
ggcaacaauccaggcacugagca

SEQ ID NO: 67889 - RNA, 23 nt, Artificial Sequence
  RNA Oligomer
gcaacaauccaggcacugagcag

SEQ ID NO: 67890 - RNA, 23 nt, Artificial Sequence
  RNA Oligomer
caacaauccaggcacugagcagg

SEQ ID NO: 67891 - RNA, 23 nt, Artificial Sequence
  RNA Oligomer
cacgaacaacagagggagcacac

SEQ ID NO: 67892 - RNA, 23 nt, Artificial Sequence
  RNA Oligomer
acgaacaacagagggagcacacg

SEQ ID NO: 67893 - RNA, 23 nt, Artificial Sequence
  RNA Oligomer
ucccgcacaucuucaaccaacac

SEQ ID NO: 67894 - RNA, 23 nt, Artificial Sequence
  RNA Oligomer
aguguuuucugcaggaagcuggg

SEQ ID NO: 67895 - RNA, 23 nt, Artificial Sequence
  RNA Oligomer
guguuuucugcaggaagcugggc

SEQ ID NO: 67896 - RNA, 23 nt, Artificial Sequence
  RNA Oligomer
uguuuucugcaggaagcugggca

SEQ ID NO: 67897 - RNA, 23 nt, Artificial Sequence
  RNA Oligomer
guuuucugcaggaagcugggcag

SEQ ID NO: 67898 - RNA, 23 nt, Artificial Sequence
  RNA Oligomer
uuuucugcaggaagcugggcagc

SEQ ID NO: 67899 - RNA, 23 nt, Artificial Sequence
  RNA Oligomer
cacgcucaccaggucugaaagca

SEQ ID NO: 67900 - RNA, 23 nt, Artificial Sequence
  RNA Oligomer
acgcucaccaggucugaaagcac

SEQ ID NO: 67901 - RNA, 23 nt, Artificial Sequence
  RNA Oligomer
cgcucaccaggucugaaagcacg

SEQ ID NO: 67902 - RNA, 23 nt, Artificial Sequence
  RNA Oligomer
gcucaccaggucugaaagcacgu

SEQ ID NO: 67903 - RNA, 23 nt, Artificial Sequence
  RNA Oligomer
cucaccaggucugaaagcacgug

SEQ ID NO: 67904 - RNA, 23 nt, Artificial Sequence
  RNA Oligomer
agacaugcacacacauaguacuu

SEQ ID NO: 67905 - RNA, 23 nt, Artificial Sequence
  RNA Oligomer
gaggugggaaaucagagaaggcu

SEQ ID NO: 67906 - RNA, 23 nt, Artificial Sequence
  RNA Oligomer
aggugggaaaucagagaaggcug

SEQ ID NO: 67907 - RNA, 23 nt, Artificial Sequence
  RNA Oligomer
ggugggaaaucagagaaggcuga

SEQ ID NO: 67908 - RNA, 23 nt, Artificial Sequence
  RNA Oligomer
gugggaaaucagagaaggcugag

SEQ ID NO: 67909 - RNA, 23 nt, Artificial Sequence
  RNA Oligomer
ugggaaaucagagaaggcugagg

SEQ ID NO: 67910 - RNA, 23 nt, Artificial Sequence
  RNA Oligomer
accacccaucaaaucgcugcacc

SEQ ID NO: 67911 - RNA, 23 nt, Artificial Sequence
  RNA Oligomer
ccacccaucaaaucgcugcaccu

SEQ ID NO: 67912 - RNA, 23 nt, Artificial Sequence
  RNA Oligomer
cacccaucaaaucgcugcaccuc

SEQ ID NO: 67913 - RNA, 23 nt, Artificial Sequence
  RNA Oligomer
ugggugauguagaugugcacaga

SEQ ID NO: 67914 - RNA, 23 nt, Artificial Sequence
  RNA Oligomer
gacggaugacuugaagaccaggu

SEQ ID NO: 67915 - RNA, 23 nt, Artificial Sequence
  RNA Oligomer
acggaugacuugaagaccagguc

SEQ ID NO: 67916 - RNA, 23 nt, Artificial Sequence
  RNA Oligomer
ucuuugaggauggaggcaaaagg

SEQ ID NO: 67917 - RNA, 23 nt, Artificial Sequence
  RNA Oligomer
cuuugaggauggaggcaaaaggg

SEQ ID NO: 67918 - RNA, 23 nt, Artificial Sequence
  RNA Oligomer
uuugaggauggaggcaaaagggg

SEQ ID NO: 67919 - RNA, 23 nt, Artificial Sequence
  RNA Oligomer
uugaggauggaggcaaaaggggu

SEQ ID NO: 67920 - RNA, 23 nt, Artificial Sequence
  RNA Oligomer
ugaggauggaggcaaaaggggug

SEQ ID NO: 67921 - RNA, 23 nt, Artificial Sequence
  RNA Oligomer
agcuuuggguaucuggcacaucu

SEQ ID NO: 67922 - RNA, 23 nt, Artificial Sequence
  RNA Oligomer
gcuuuggguaucuggcacaucug

SEQ ID NO: 67923 - RNA, 23 nt, Artificial Sequence
  RNA Oligomer
cuuuggguaucuggcacaucugu

SEQ ID NO: 67924 - RNA, 23 nt, Artificial Sequence
  RNA Oligomer
uuuggguaucuggcacaucuguc

SEQ ID NO: 67925 - RNA, 23 nt, Artificial Sequence
  RNA Oligomer
uuggguaucuggcacaucuguca

SEQ ID NO: 67926 - RNA, 23 nt, Artificial Sequence
  RNA Oligomer
auggaugaugagcaggacauaga

SEQ ID NO: 67927 - RNA, 23 nt, Artificial Sequence
  RNA Oligomer
uggaugaugagcaggacauagag

SEQ ID NO: 67928 - RNA, 23 nt, Artificial Sequence
  RNA Oligomer
ggaugaugagcaggacauagagc

SEQ ID NO: 67929 - RNA, 23 nt, Artificial Sequence
  RNA Oligomer
gaugaugagcaggacauagagca

SEQ ID NO: 67930 - RNA, 23 nt, Artificial Sequence
  RNA Oligomer
augaugagcaggacauagagcag

SEQ ID NO: 67931 - RNA, 23 nt, Artificial Sequence
  RNA Oligomer
agagcaggauguagagguggugg

SEQ ID NO: 67932 - RNA, 23 nt, Artificial Sequence
  RNA Oligomer
uaccuucuugccaaaccuccgcc

SEQ ID NO: 67933 - RNA, 23 nt, Artificial Sequence
  RNA Oligomer
accuucuugccaaaccuccgccg

SEQ ID NO: 67934 - RNA, 23 nt, Artificial Sequence
  RNA Oligomer
gaaaaucuucccaugucaguucc

SEQ ID NO: 67935 - RNA, 23 nt, Artificial Sequence
  RNA Oligomer
aaaaucuucccaugucaguuccu

SEQ ID NO: 67936 - RNA, 23 nt, Artificial Sequence
  RNA Oligomer
aaaucuucccaugucaguuccuc

SEQ ID NO: 67937 - RNA, 23 nt, Artificial Sequence
  RNA Oligomer
ucccaugucaguuccuccuuguc

SEQ ID NO: 67938 - RNA, 23 nt, Artificial Sequence
  RNA Oligomer
ugccugaaaaaggucuccaggag

SEQ ID NO: 67939 - RNA, 23 nt, Artificial Sequence
  RNA Oligomer
gccugaaaaaggucuccaggagg

SEQ ID NO: 67940 - RNA, 23 nt, Artificial Sequence
  RNA Oligomer
ccugaaaaaggucuccaggaggu

SEQ ID NO: 67941 - RNA, 23 nt, Artificial Sequence
  RNA Oligomer
cugaaaaaggucuccaggaggug

SEQ ID NO: 67942 - RNA, 23 nt, Artificial Sequence
  RNA Oligomer
ugaaaaaggucuccaggaggugc

SEQ ID NO: 67943 - RNA, 23 nt, Artificial Sequence
  RNA Oligomer
caucuucaaccaacacauggucc

SEQ ID NO: 67944 - RNA, 23 nt, Artificial Sequence
  RNA Oligomer
aucuucaaccaacacaugguccu

SEQ ID NO: 67945 - RNA, 23 nt, Artificial Sequence
  RNA Oligomer
ucuucaaccaacacaugguccuc

SEQ ID NO: 67946 - RNA, 23 nt, Artificial Sequence
  RNA Oligomer
cuucaaccaacacaugguccucu

SEQ ID NO: 67947 - RNA, 23 nt, Artificial Sequence
  RNA Oligomer
uucaaccaacacaugguccucuc

SEQ ID NO: 67948 - RNA, 23 nt, Artificial Sequence
  RNA Oligomer
cggagagcucuggagacacuuga

SEQ ID NO: 67949 - RNA, 23 nt, Artificial Sequence
  RNA Oligomer
ggagagcucuggagacacuugag

SEQ ID NO: 67950 - RNA, 23 nt, Artificial Sequence
  RNA Oligomer
gagagcucuggagacacuugagu

SEQ ID NO: 67951 - RNA, 23 nt, Artificial Sequence
  RNA Oligomer
agagcucuggagacacuugaguu

SEQ ID NO: 67952 - RNA, 23 nt, Artificial Sequence
  RNA Oligomer
gagcucuggagacacuugaguuc

SEQ ID NO: 67953 - RNA, 23 nt, Artificial Sequence
  RNA Oligomer
gccacucauacacagcgauguuc

SEQ ID NO: 67954 - RNA, 23 nt, Artificial Sequence
  RNA Oligomer
ccacucauacacagcgauguucu

SEQ ID NO: 67955 - RNA, 23 nt, Artificial Sequence
  RNA Oligomer
cacucauacacagcgauguucug

SEQ ID NO: 67956 - RNA, 23 nt, Artificial Sequence
  RNA Oligomer
acucauacacagcgauguucugg

SEQ ID NO: 67957 - RNA, 23 nt, Artificial Sequence
  RNA Oligomer
cucauacacagcgauguucuggu

SEQ ID NO: 67958 - RNA, 23 nt, Artificial Sequence
  RNA Oligomer
ccaucugugcuccaugagguugu

SEQ ID NO: 67959 - RNA, 23 nt, Artificial Sequence
  RNA Oligomer
caucugugcuccaugagguuguu

SEQ ID NO: 67960 - RNA, 23 nt, Artificial Sequence
  RNA Oligomer
aucugugcuccaugagguuguug

SEQ ID NO: 67961 - RNA, 23 nt, Artificial Sequence
  RNA Oligomer
ucugugcuccaugagguuguugu

SEQ ID NO: 67962 - RNA, 23 nt, Artificial Sequence
  RNA Oligomer
cugugcuccaugagguuguugua

SEQ ID NO: 67963 - RNA, 23 nt, Artificial Sequence
  RNA Oligomer
agccagaaauaggaagaacagag

SEQ ID NO: 67964 - RNA, 23 nt, Artificial Sequence
  RNA Oligomer
cgccuucaccacgcugaucucca

SEQ ID NO: 67965 - RNA, 23 nt, Artificial Sequence
  RNA Oligomer
gccuucaccacgcugaucuccac

SEQ ID NO: 67966 - RNA, 23 nt, Artificial Sequence
  RNA Oligomer
ccuucaccacgcugaucuccacc

SEQ ID NO: 67967 - RNA, 23 nt, Artificial Sequence
  RNA Oligomer
cuucaccacgcugaucuccaccu

SEQ ID NO: 67968 - RNA, 23 nt, Artificial Sequence
  RNA Oligomer
uucaccacgcugaucuccaccuu

SEQ ID NO: 67969 - RNA, 23 nt, Artificial Sequence
  RNA Oligomer
cgaacaacagagggagcacacgc

SEQ ID NO: 67970 - RNA, 23 nt, Artificial Sequence
  RNA Oligomer
gaacaacagagggagcacacgcu

SEQ ID NO: 67971 - RNA, 23 nt, Artificial Sequence
  RNA Oligomer
aacaacagagggagcacacgcug

SEQ ID NO: 67972 - RNA, 23 nt, Artificial Sequence
  RNA Oligomer
uuucuucaaucuccuucuuggag

SEQ ID NO: 67973 - RNA, 23 nt, Artificial Sequence
  RNA Oligomer
uucuucaaucuccuucuuggaga

SEQ ID NO: 67974 - RNA, 23 nt, Artificial Sequence
  RNA Oligomer
ucuucaaucuccuucuuggagaa

SEQ ID NO: 67975 - RNA, 23 nt, Artificial Sequence
  RNA Oligomer
gggcagccacucauacacagcga

SEQ ID NO: 67976 - RNA, 23 nt, Artificial Sequence
  RNA Oligomer
ggcagccacucauacacagcgau

SEQ ID NO: 67977 - RNA, 23 nt, Artificial Sequence
  RNA Oligomer
gcagccacucauacacagcgaug

SEQ ID NO: 67978 - RNA, 23 nt, Artificial Sequence
  RNA Oligomer
cagccacucauacacagcgaugu

SEQ ID NO: 67979 - RNA, 23 nt, Artificial Sequence
  RNA Oligomer
agccacucauacacagcgauguu

SEQ ID NO: 67980 - RNA, 23 nt, Artificial Sequence
  RNA Oligomer
cuuaaaaccuugggugaaauuag

SEQ ID NO: 67981 - RNA, 23 nt, Artificial Sequence
  RNA Oligomer
uuaaaaccuugggugaaauuagu

SEQ ID NO: 67982 - RNA, 23 nt, Artificial Sequence
  RNA Oligomer
uaaaaccuugggugaaauuaguu

SEQ ID NO: 67983 - RNA, 23 nt, Artificial Sequence
  RNA Oligomer
ccagaugaaguagaucuucuuac

SEQ ID NO: 67984 - RNA, 23 nt, Artificial Sequence
  RNA Oligomer
cagaugaaguagaucuucuuaca

SEQ ID NO: 67985 - RNA, 23 nt, Artificial Sequence
  RNA Oligomer
agaugaaguagaucuucuuacag

SEQ ID NO: 67986 - RNA, 23 nt, Artificial Sequence
  RNA Oligomer
gaugaaguagaucuucuuacaga

SEQ ID NO: 67987 - RNA, 23 nt, Artificial Sequence
  RNA Oligomer
augaaguagaucuucuuacagaa

SEQ ID NO: 67988 - RNA, 23 nt, Artificial Sequence
  RNA Oligomer
cuuacagaacacuuggcagcuga

SEQ ID NO: 67989 - RNA, 23 nt, Artificial Sequence
  RNA Oligomer
uuacagaacacuuggcagcugac

SEQ ID NO: 67990 - RNA, 23 nt, Artificial Sequence
  RNA Oligomer
cacgcugaucuccaccuucuucc

SEQ ID NO: 67991 - RNA, 23 nt, Artificial Sequence
  RNA Oligomer
acgcugaucuccaccuucuuccg

SEQ ID NO: 67992 - RNA, 23 nt, Artificial Sequence
  RNA Oligomer
cgcugaucuccaccuucuuccgg

SEQ ID NO: 67993 - RNA, 23 nt, Artificial Sequence
  RNA Oligomer
gcugaucuccaccuucuuccggc

SEQ ID NO: 67994 - RNA, 23 nt, Artificial Sequence
  RNA Oligomer
cugaucuccaccuucuuccggcu

SEQ ID NO: 67995 - RNA, 23 nt, Artificial Sequence
  RNA Oligomer
ggggaucuugagcagcagagugc

SEQ ID NO: 67996 - RNA, 23 nt, Artificial Sequence
  RNA Oligomer
gggaucuugagcagcagagugcg

SEQ ID NO: 67997 - RNA, 23 nt, Artificial Sequence
  RNA Oligomer
ggaucuugagcagcagagugcgg

SEQ ID NO: 67998 - RNA, 23 nt, Artificial Sequence
  RNA Oligomer
gaucuugagcagcagagugcggc

SEQ ID NO: 67999 - RNA, 23 nt, Artificial Sequence
  RNA Oligomer
aucuugagcagcagagugcggcg

SEQ ID NO: 68000 - RNA, 23 nt, Artificial Sequence
  RNA Oligomer
ggauaaguccugguuguacaggg

SEQ ID NO: 68001 - RNA, 23 nt, Artificial Sequence
  RNA Oligomer
gauaaguccugguuguacagggc

SEQ ID NO: 68002 - RNA, 23 nt, Artificial Sequence
  RNA Oligomer
auaaguccugguuguacagggca

SEQ ID NO: 68003 - RNA, 23 nt, Artificial Sequence
  RNA Oligomer
uaaguccugguuguacagggcag

SEQ ID NO: 68004 - RNA, 23 nt, Artificial Sequence
  RNA Oligomer
aaguccugguuguacagggcagc

SEQ ID NO: 68005 - RNA, 23 nt, Artificial Sequence
  RNA Oligomer
gaguguuuucugcaggaagcugg

SEQ ID NO: 68006 - RNA, 23 nt, Artificial Sequence
  RNA Oligomer
cagggucugaugaaagaacgugc

SEQ ID NO: 68007 - RNA, 23 nt, Artificial Sequence
  RNA Oligomer
agggucugaugaaagaacgugcu

SEQ ID NO: 68008 - RNA, 23 nt, Artificial Sequence
  RNA Oligomer
gggucugaugaaagaacgugcuu

SEQ ID NO: 68009 - RNA, 23 nt, Artificial Sequence
  RNA Oligomer
ggucugaugaaagaacgugcuua

SEQ ID NO: 68010 - RNA, 23 nt, Artificial Sequence
  RNA Oligomer
gucugaugaaagaacgugcuuaa

SEQ ID NO: 68011 - RNA, 23 nt, Artificial Sequence
  RNA Oligomer
gacuuguacucaaagcccugggg

SEQ ID NO: 68012 - RNA, 23 nt, Artificial Sequence
  RNA Oligomer
acuuguacucaaagcccuggggc

SEQ ID NO: 68013 - RNA, 23 nt, Artificial Sequence
  RNA Oligomer
cuuguacucaaagcccuggggcc

SEQ ID NO: 68014 - RNA, 23 nt, Artificial Sequence
  RNA Oligomer
accauggaugaugagcaggacau

SEQ ID NO: 68015 - RNA, 23 nt, Artificial Sequence
  RNA Oligomer
ccauggaugaugagcaggacaua

SEQ ID NO: 68016 - RNA, 23 nt, Artificial Sequence
  RNA Oligomer
cauggaugaugagcaggacauag

SEQ ID NO: 68017 - RNA, 23 nt, Artificial Sequence
  RNA Oligomer
acacauucaccacauggcccaca

SEQ ID NO: 68018 - RNA, 23 nt, Artificial Sequence
  RNA Oligomer
cacauucaccacauggcccacac

SEQ ID NO: 68019 - RNA, 23 nt, Artificial Sequence
  RNA Oligomer
acauucaccacauggcccacacu

SEQ ID NO: 68020 - RNA, 23 nt, Artificial Sequence
  RNA Oligomer
cauucaccacauggcccacacug

SEQ ID NO: 68021 - RNA, 23 nt, Artificial Sequence
  RNA Oligomer
auucaccacauggcccacacugu

SEQ ID NO: 68022 - RNA, 23 nt, Artificial Sequence
  RNA Oligomer
aggcaaugaggcgauggaagucc

SEQ ID NO: 68023 - RNA, 23 nt, Artificial Sequence
  Chemically synthesized
ggcaaugaggcgauggaagucca

SEQ ID NO: 68024 - RNA, 23 nt, Artificial Sequence
  Chemically synthesized
gcaaugaggcgauggaaguccac

SEQ ID NO: 68025 - RNA, 23 nt, Artificial Sequence
  RNA Oligomer
caaugaggcgauggaaguccacg

SEQ ID NO: 68026 - RNA, 23 nt, Artificial Sequence
  Chemically synthesized
aaugaggcgauggaaguccacgg

SEQ ID NO: 68027 - RNA, 23 nt, Artificial Sequence
  Chemically synthesized
ucggaaggacagguagccauugc

SEQ ID NO: 68028 - RNA, 23 nt, Artificial Sequence
  Chemically synthesized
cggaaggacagguagccauugcc

SEQ ID NO: 68029 - RNA, 23 nt, Artificial Sequence
  RNA Oligomer
ggaaggacagguagccauugcca

SEQ ID NO: 68030 - RNA, 23 nt, Artificial Sequence
  RNA Oligomer
gaaggacagguagccauugccau

SEQ ID NO: 68031 - RNA, 23 nt, Artificial Sequence
  RNA Oligomer
aaggacagguagccauugccauc

SEQ ID NO: 68032 - RNA, 23 nt, Artificial Sequence
  RNA Oligomer
ugaaauuucucauccggagccgg

SEQ ID NO: 68033 - RNA, 23 nt, Artificial Sequence
  RNA Oligomer
gaaauuucucauccggagccggg

SEQ ID NO: 68034 - RNA, 23 nt, Artificial Sequence
  RNA Oligomer
aaauuucucauccggagccgggc

SEQ ID NO: 68035 - RNA, 23 nt, Artificial Sequence
  RNA Oligomer
aauuucucauccggagccgggca

SEQ ID NO: 68036 - RNA, 23 nt, Artificial Sequence
  RNA Oligomer
gccgcacaaauuguucaaggacg

SEQ ID NO: 68037 - RNA, 23 nt, Artificial Sequence
  RNA Oligomer
ccgcacaaauuguucaaggacga

SEQ ID NO: 68038 - RNA, 23 nt, Artificial Sequence
  RNA Oligomer
cgcacaaauuguucaaggacgau

SEQ ID NO: 68039 - RNA, 23 nt, Artificial Sequence
  RNA Oligomer
gcacaaauuguucaaggacgaug

SEQ ID NO: 68040 - RNA, 23 nt, Artificial Sequence
  RNA Oligomer
uuucuguaaauggcuugccaugg

SEQ ID NO: 68041 - RNA, 23 nt, Artificial Sequence
  RNA Oligomer
gggaggguucuaagaugccagca

SEQ ID NO: 68042 - RNA, 23 nt, Artificial Sequence
  RNA Oligomer
ggaggguucuaagaugccagcau

SEQ ID NO: 68043 - RNA, 23 nt, Artificial Sequence
  RNA Oligomer
gaggguucuaagaugccagcauc

SEQ ID NO: 68044 - RNA, 23 nt, Artificial Sequence
  RNA Oligomer
aggguucuaagaugccagcaucc

SEQ ID NO: 68045 - RNA, 23 nt, Artificial Sequence
  RNA Oligomer
acuucucacucuagucccuagac

SEQ ID NO: 68046 - RNA, 23 nt, Artificial Sequence
  RNA Oligomer
cuucucacucuagucccuagaca

SEQ ID NO: 68047 - RNA, 23 nt, Artificial Sequence
  RNA Oligomer
uucucacucuagucccuagacac

SEQ ID NO: 68048 - RNA, 23 nt, Artificial Sequence
  RNA Oligomer
gggaaaucagagaaggcugaggc

SEQ ID NO: 68049 - RNA, 23 nt, Artificial Sequence
  RNA Oligomer
ggaaaucagagaaggcugaggca

SEQ ID NO: 68050 - RNA, 23 nt, Artificial Sequence
  RNA Oligomer
gaaaucagagaaggcugaggcag

SEQ ID NO: 68051 - RNA, 23 nt, Artificial Sequence
  RNA Oligomer
aaaucagagaaggcugaggcagc

SEQ ID NO: 68052 - RNA, 23 nt, Artificial Sequence
  RNA Oligomer
aaucagagaaggcugaggcagcc

SEQ ID NO: 68053 - RNA, 23 nt, Artificial Sequence
  RNA Oligomer
ccuguugaugagcugacaggccu

SEQ ID NO: 68054 - RNA, 23 nt, Artificial Sequence
  RNA Oligomer
cuguugaugagcugacaggccuu

SEQ ID NO: 68055 - RNA, 23 nt, Artificial Sequence
  RNA Oligomer
uguugaugagcugacaggccuuu

SEQ ID NO: 68056 - RNA, 23 nt, Artificial Sequence
  RNA Oligomer
guugaugagcugacaggccuuuu

SEQ ID NO: 68057 - RNA, 23 nt, Artificial Sequence
  RNA Oligomer
uugaugagcugacaggccuuuuc

SEQ ID NO: 68058 - RNA, 23 nt, Artificial Sequence
  RNA Oligomer
ggagaucucgaugaaggaucuca

SEQ ID NO: 68059 - RNA, 23 nt, Artificial Sequence
  RNA Oligomer
gagaucucgaugaaggaucucag

SEQ ID NO: 68060 - RNA, 23 nt, Artificial Sequence
  RNA Oligomer
agaucucgaugaaggaucucagc

SEQ ID NO: 68061 - RNA, 23 nt, Artificial Sequence
  RNA Oligomer
gaucucgaugaaggaucucagca

SEQ ID NO: 68062 - RNA, 23 nt, Artificial Sequence
  RNA Oligomer
aucucgaugaaggaucucagcau

SEQ ID NO: 68063 - RNA, 23 nt, Artificial Sequence
  RNA Oligomer
acucauccuuggaaaugaggcca

SEQ ID NO: 68064 - RNA, 23 nt, Artificial Sequence
  RNA Oligomer
cucauccuuggaaaugaggccau

SEQ ID NO: 68065 - RNA, 23 nt, Artificial Sequence
  RNA Oligomer
ucauccuuggaaaugaggccauu

SEQ ID NO: 68066 - RNA, 23 nt, Artificial Sequence
  RNA Oligomer
cauccuuggaaaugaggccauuc

SEQ ID NO: 68067 - RNA, 23 nt, Artificial Sequence
  RNA Oligomer
auccuuggaaaugaggccauucc

SEQ ID NO: 68068 - RNA, 23 nt, Artificial Sequence
  RNA Oligomer
auuguucaaggacgauggugcug

SEQ ID NO: 68069 - RNA, 23 nt, Artificial Sequence
  RNA Oligomer
uuguucaaggacgauggugcuga

SEQ ID NO: 68070 - RNA, 23 nt, Artificial Sequence
  RNA Oligomer
uguucaaggacgauggugcugaa

SEQ ID NO: 68071 - RNA, 23 nt, Artificial Sequence
  RNA Oligomer
gcacaucuucaaccaacacaugg

SEQ ID NO: 68072 - RNA, 23 nt, Artificial Sequence
  RNA Oligomer
cacaucuucaaccaacacauggu

SEQ ID NO: 68073 - RNA, 23 nt, Artificial Sequence
  RNA Oligomer
acaucuucaaccaacacaugguc

SEQ ID NO: 68074 - RNA, 23 nt, Artificial Sequence
  RNA Oligomer
cacuuuguaggcuugggugcuca

SEQ ID NO: 68075 - RNA, 23 nt, Artificial Sequence
  RNA Oligomer
acuuuguaggcuugggugcucac

SEQ ID NO: 68076 - RNA, 23 nt, Artificial Sequence
  RNA Oligomer
cuuuguaggcuugggugcucacg

SEQ ID NO: 68077 - RNA, 23 nt, Artificial Sequence
  RNA Oligomer
uuuguaggcuugggugcucacgg

SEQ ID NO: 68078 - RNA, 23 nt, Artificial Sequence
  RNA Oligomer
uuguaggcuugggugcucacggc

SEQ ID NO: 68079 - RNA, 23 nt, Artificial Sequence
  RNA Oligomer
ugcauacauagguauugggccag

SEQ ID NO: 68080 - RNA, 23 nt, Artificial Sequence
  RNA Oligomer
ucuguaaauggcuugccaugggu

SEQ ID NO: 68081 - RNA, 23 nt, Artificial Sequence
  RNA Oligomer
cuguaaauggcuugccauggguc

SEQ ID NO: 68082 - RNA, 23 nt, Artificial Sequence
  RNA Oligomer
uguaaauggcuugccaugggucc

SEQ ID NO: 68083 - RNA, 23 nt, Artificial Sequence
  RNA Oligomer
guaaauggcuugccaugggucca

SEQ ID NO: 68084 - RNA, 23 nt, Artificial Sequence
  RNA Oligomer
uaaauggcuugccauggguccag

SEQ ID NO: 68085 - RNA, 23 nt, Artificial Sequence
  RNA Oligomer
gcugguacacgccaucugcauag

SEQ ID NO: 68086 - RNA, 23 nt, Artificial Sequence
  RNA Oligomer
uucuaagaugccagcauccaugc

SEQ ID NO: 68087 - RNA, 23 nt, Artificial Sequence
  RNA Oligomer
ucuaagaugccagcauccaugcu

SEQ ID NO: 68088 - RNA, 23 nt, Artificial Sequence
  RNA Oligomer
cuaagaugccagcauccaugcuc

SEQ ID NO: 68089 - RNA, 23 nt, Artificial Sequence
  RNA Oligomer
uaagaugccagcauccaugcucc

SEQ ID NO: 68090 - RNA, 23 nt, Artificial Sequence
  RNA Oligomer
aagaugccagcauccaugcuccc

SEQ ID NO: 68091 - RNA, 23 nt, Artificial Sequence
  RNA Oligomer
cuccaugagguuguuguaccacc

SEQ ID NO: 68092 - RNA, 23 nt, Artificial Sequence
  RNA Oligomer
uccaugagguuguuguaccaccc

SEQ ID NO: 68093 - RNA, 23 nt, Artificial Sequence
  RNA Oligomer
ccaugagguuguuguaccaccca

SEQ ID NO: 68094 - RNA, 23 nt, Artificial Sequence
  RNA Oligomer
caugagguuguuguaccacccau

SEQ ID NO: 68095 - RNA, 23 nt, Artificial Sequence
  RNA Oligomer
augagguuguuguaccacccauc

SEQ ID NO: 68096 - RNA, 23 nt, Artificial Sequence
  RNA Oligomer
aaguucucauaauggugggagaa

SEQ ID NO: 68097 - RNA, 23 nt, Artificial Sequence
  RNA Oligomer
acuaacacugacaccucaaacuu

SEQ ID NO: 68098 - RNA, 23 nt, Artificial Sequence
  RNA Oligomer
cuaacacugacaccucaaacuua

SEQ ID NO: 68099 - RNA, 23 nt, Artificial Sequence
  RNA Oligomer
uaacacugacaccucaaacuuau

SEQ ID NO: 68100 - RNA, 23 nt, Artificial Sequence
  RNA Oligomer
aacacugacaccucaaacuuaug

SEQ ID NO: 68101 - RNA, 23 nt, Artificial Sequence
  RNA Oligomer
ggcccucuccaaaugguccauca

SEQ ID NO: 68102 - RNA, 23 nt, Artificial Sequence
  RNA Oligomer
gcccucuccaaaugguccaucaa

SEQ ID NO: 68103 - RNA, 23 nt, Artificial Sequence
  RNA Oligomer
cccucuccaaaugguccaucaag

SEQ ID NO: 68104 - RNA, 23 nt, Artificial Sequence
  RNA Oligomer
ccucuccaaaugguccaucaagg

SEQ ID NO: 68105 - RNA, 23 nt, Artificial Sequence
  RNA Oligomer
cucuccaaaugguccaucaaggu

SEQ ID NO: 68106 - RNA, 23 nt, Artificial Sequence
  RNA Oligomer
gaaagagaugcuggcugcugugc

SEQ ID NO: 68107 - RNA, 23 nt, Artificial Sequence
  RNA Oligomer
aaagagaugcuggcugcugugcc

SEQ ID NO: 68108 - RNA, 23 nt, Artificial Sequence
  RNA Oligomer
aagagaugcuggcugcugugccc

SEQ ID NO: 68109 - RNA, 23 nt, Artificial Sequence
  RNA Oligomer
gcaguuguuggagaucucgauga

SEQ ID NO: 68110 - RNA, 23 nt, Artificial Sequence
  RNA Oligomer
caguuguuggagaucucgaugaa

SEQ ID NO: 68111 - RNA, 23 nt, Artificial Sequence
  RNA Oligomer
aguuguuggagaucucgaugaag

SEQ ID NO: 68112 - RNA, 23 nt, Artificial Sequence
  RNA Oligomer
uuucaugaagaccaccaggaugu

SEQ ID NO: 68113 - RNA, 23 nt, Artificial Sequence
  RNA Oligomer
gacgaaguugaccuucuguggag

SEQ ID NO: 68114 - RNA, 23 nt, Artificial Sequence
  RNA Oligomer
acgaaguugaccuucuguggagg

SEQ ID NO: 68115 - RNA, 23 nt, Artificial Sequence
  RNA Oligomer
cgaaguugaccuucuguggaggc

SEQ ID NO: 68116 - RNA, 23 nt, Artificial Sequence
  RNA Oligomer
gaaguugaccuucuguggaggcu

SEQ ID NO: 68117 - RNA, 23 nt, Artificial Sequence
  RNA Oligomer
aaguugaccuucuguggaggcug

SEQ ID NO: 68118 - RNA, 23 nt, Artificial Sequence
  RNA Oligomer
cuccuuguggccuugccauucca

SEQ ID NO: 68119 - RNA, 23 nt, Artificial Sequence
  RNA Oligomer
uccuuguggccuugccauuccaa

SEQ ID NO: 68120 - RNA, 23 nt, Artificial Sequence
  RNA Oligomer
ccuuguggccuugccauuccaaa

SEQ ID NO: 68121 - RNA, 23 nt, Artificial Sequence
  RNA Oligomer
cuuguggccuugccauuccaaag

SEQ ID NO: 68122 - RNA, 23 nt, Artificial Sequence
  RNA Oligomer
uuguggccuugccauuccaaagc

SEQ ID NO: 68123 - RNA, 23 nt, Artificial Sequence
  RNA Oligomer
ggucaauguugauaacagcgacc

SEQ ID NO: 68124 - RNA, 23 nt, Artificial Sequence
  RNA Oligomer
gucaauguugauaacagcgacca

SEQ ID NO: 68125 - RNA, 23 nt, Artificial Sequence
  RNA Oligomer
ucaauguugauaacagcgaccag

SEQ ID NO: 68126 - RNA, 23 nt, Artificial Sequence
  RNA Oligomer
caauguugauaacagcgaccagc

SEQ ID NO: 68127 - RNA, 23 nt, Artificial Sequence
  RNA Oligomer
aauguugauaacagcgaccagca

SEQ ID NO: 68128 - RNA, 23 nt, Artificial Sequence
  RNA Oligomer
uuucggauuucuucaaucuccuu

SEQ ID NO: 68129 - RNA, 23 nt, Artificial Sequence
  RNA Oligomer
uucggauuucuucaaucuccuuc

SEQ ID NO: 68130 - RNA, 23 nt, Artificial Sequence
  RNA Oligomer
guucaaggacgauggugcugaac

SEQ ID NO: 68131 - RNA, 23 nt, Artificial Sequence
  RNA Oligomer
uucaaggacgauggugcugaaca

SEQ ID NO: 68132 - RNA, 23 nt, Artificial Sequence
  RNA Oligomer
ucaaggacgauggugcugaacag

SEQ ID NO: 68133 - RNA, 23 nt, Artificial Sequence
  RNA Oligomer
ucaaccaacacaugguccucucg

SEQ ID NO: 68134 - RNA, 23 nt, Artificial Sequence
  RNA Oligomer
cacgaacucugaggagaugcugg

SEQ ID NO: 68135 - RNA, 23 nt, Artificial Sequence
  RNA Oligomer
acgaacucugaggagaugcuggg

SEQ ID NO: 68136 - RNA, 23 nt, Artificial Sequence
  RNA Oligomer
cgaacucugaggagaugcugggg

SEQ ID NO: 68137 - RNA, 23 nt, Artificial Sequence
  RNA Oligomer
gaacucugaggagaugcuggggu

SEQ ID NO: 68138 - RNA, 23 nt, Artificial Sequence
  RNA Oligomer
aacucugaggagaugcugggguc

SEQ ID NO: 68139 - RNA, 23 nt, Artificial Sequence
  RNA Oligomer
gcauacauagguauugggccagg

SEQ ID NO: 68140 - RNA, 23 nt, Artificial Sequence
  RNA Oligomer
cauacauagguauugggccaggg

SEQ ID NO: 68141 - RNA, 23 nt, Artificial Sequence
  RNA Oligomer
auacauagguauugggccagggu

SEQ ID NO: 68142 - RNA, 23 nt, Artificial Sequence
  RNA Oligomer
uacauagguauugggccaggguc

SEQ ID NO: 68143 - RNA, 23 nt, Artificial Sequence
  RNA Oligomer
cuugagaugguguugcuaagguc

SEQ ID NO: 68144 - RNA, 23 nt, Artificial Sequence
  RNA Oligomer
uugagaugguguugcuaaggucu

SEQ ID NO: 68145 - RNA, 23 nt, Artificial Sequence
  RNA Oligomer
ugagaugguguugcuaaggucuc

SEQ ID NO: 68146 - RNA, 23 nt, Artificial Sequence
  RNA Oligomer
uucuguaaauggcuugccauggg

SEQ ID NO: 68147 - RNA, 23 nt, Artificial Sequence
  RNA Oligomer
acacauacagacaugcacacaca

SEQ ID NO: 68148 - RNA, 23 nt, Artificial Sequence
  RNA Oligomer
cacauacagacaugcacacacau

SEQ ID NO: 68149 - RNA, 23 nt, Artificial Sequence
  RNA Oligomer
cucacagauguacagcauagugg

SEQ ID NO: 68150 - RNA, 23 nt, Artificial Sequence
  RNA Oligomer
ucacagauguacagcauaguggu

SEQ ID NO: 68151 - RNA, 23 nt, Artificial Sequence
  RNA Oligomer
cacagauguacagcauagugguc

SEQ ID NO: 68152 - RNA, 23 nt, Artificial Sequence
  RNA Oligomer
caggaagaagauguggaaacggg

SEQ ID NO: 68153 - RNA, 23 nt, Artificial Sequence
  RNA Oligomer
aggaagaagauguggaaacgggg

SEQ ID NO: 68154 - RNA, 23 nt, Artificial Sequence
  RNA Oligomer
ggaagaagauguggaaacggggc

SEQ ID NO: 68155 - RNA, 23 nt, Artificial Sequence
  RNA Oligomer
gaagaagauguggaaacggggca

SEQ ID NO: 68156 - RNA, 23 nt, Artificial Sequence
  RNA Oligomer
aagaagauguggaaacggggcag

SEQ ID NO: 68157 - RNA, 23 nt, Artificial Sequence
  RNA Oligomer
agcgguugaggaagguuucucgc

SEQ ID NO: 68158 - RNA, 23 nt, Artificial Sequence
  RNA Oligomer
gcgguugaggaagguuucucgca

SEQ ID NO: 68159 - RNA, 23 nt, Artificial Sequence
  RNA Oligomer
cgguugaggaagguuucucgcag

SEQ ID NO: 68160 - RNA, 23 nt, Artificial Sequence
  RNA Oligomer
gguugaggaagguuucucgcagg

SEQ ID NO: 68161 - RNA, 23 nt, Artificial Sequence
  RNA Oligomer
guugaggaagguuucucgcagga

SEQ ID NO: 68162 - RNA, 23 nt, Artificial Sequence
  RNA Oligomer
gcagcaugaagugaaaaucuucc

SEQ ID NO: 68163 - RNA, 23 nt, Artificial Sequence
  RNA Oligomer
ggccuuggacaggcaguuguugg

SEQ ID NO: 68164 - RNA, 23 nt, Artificial Sequence
  RNA Oligomer
gccuuggacaggcaguuguugga

SEQ ID NO: 68165 - RNA, 23 nt, Artificial Sequence
  RNA Oligomer
ccuuggacaggcaguuguuggag

SEQ ID NO: 68166 - RNA, 23 nt, Artificial Sequence
  RNA Oligomer
cuuggacaggcaguuguuggaga

SEQ ID NO: 68167 - RNA, 23 nt, Artificial Sequence
  RNA Oligomer
uuggacaggcaguuguuggagau

SEQ ID NO: 68168 - RNA, 23 nt, Artificial Sequence
  RNA Oligomer
cauccugaugaacucauccuugg

SEQ ID NO: 68169 - RNA, 23 nt, Artificial Sequence
  RNA Oligomer
auccugaugaacucauccuugga

SEQ ID NO: 68170 - RNA, 23 nt, Artificial Sequence
  RNA Oligomer
uccugaugaacucauccuuggaa

SEQ ID NO: 68171 - RNA, 23 nt, Artificial Sequence
  RNA Oligomer
ccugaugaacucauccuuggaaa

SEQ ID NO: 68172 - RNA, 23 nt, Artificial Sequence
  RNA Oligomer
cugaugaacucauccuuggaaau

SEQ ID NO: 68173 - RNA, 23 nt, Artificial Sequence
  RNA Oligomer
guugauaacagcgaccagcacgu

SEQ ID NO: 68174 - RNA, 23 nt, Artificial Sequence
  RNA Oligomer
uugauaacagcgaccagcacguc

SEQ ID NO: 68175 - RNA, 23 nt, Artificial Sequence
  RNA Oligomer
ugauaacagcgaccagcacgucc

SEQ ID NO: 68176 - RNA, 23 nt, Artificial Sequence
  RNA Oligomer
gauaacagcgaccagcacguccu

SEQ ID NO: 68177 - RNA, 23 nt, Artificial Sequence
  RNA Oligomer
auaacagcgaccagcacguccug

SEQ ID NO: 68178 - RNA, 23 nt, Artificial Sequence
  RNA Oligomer
ccccuugagaugguguugcuaag

SEQ ID NO: 68179 - RNA, 23 nt, Artificial Sequence
  RNA Oligomer
cccuugagaugguguugcuaagg

SEQ ID NO: 68180 - RNA, 23 nt, Artificial Sequence
  RNA Oligomer
ccuugagaugguguugcuaaggu

SEQ ID NO: 68181 - RNA, 23 nt, Artificial Sequence
  RNA Oligomer
acauacagacaugcacacacaua

SEQ ID NO: 68182 - RNA, 23 nt, Artificial Sequence
  RNA Oligomer
ugaaguagaucuucuuacagaac

SEQ ID NO: 68183 - RNA, 23 nt, Artificial Sequence
  RNA Oligomer
caaacuuaugccacuccuggugg

SEQ ID NO: 68184 - RNA, 23 nt, Artificial Sequence
  RNA Oligomer
aaacuuaugccacuccugguggc

SEQ ID NO: 68185 - RNA, 23 nt, Artificial Sequence
  RNA Oligomer
ugaucuccaccuucuuccggcuc

SEQ ID NO: 68186 - RNA, 23 nt, Artificial Sequence
  RNA Oligomer
uagaaugucccaaaauggagacc

SEQ ID NO: 68187 - RNA, 23 nt, Artificial Sequence
  RNA Oligomer
agaaugucccaaaauggagaccc

SEQ ID NO: 68188 - RNA, 23 nt, Artificial Sequence
  RNA Oligomer
gaaugucccaaaauggagacccu

SEQ ID NO: 68189 - RNA, 23 nt, Artificial Sequence
  RNA Oligomer
aaugucccaaaauggagacccuu

SEQ ID NO: 68190 - RNA, 23 nt, Artificial Sequence
  RNA Oligomer
gagggacagaucauauccuggcu

SEQ ID NO: 68191 - RNA, 23 nt, Artificial Sequence
  RNA Oligomer
agggacagaucauauccuggcug

SEQ ID NO: 68192 - RNA, 23 nt, Artificial Sequence
  RNA Oligomer
gggacagaucauauccuggcuga

SEQ ID NO: 68193 - RNA, 23 nt, Artificial Sequence
  RNA Oligomer
ggacagaucauauccuggcugau

SEQ ID NO: 68194 - RNA, 23 nt, Artificial Sequence
  RNA Oligomer
cucgaugaaggaucucagcaucc

SEQ ID NO: 68195 - RNA, 23 nt, Artificial Sequence
  RNA Oligomer
ucgaugaaggaucucagcauccu

SEQ ID NO: 68196 - RNA, 23 nt, Artificial Sequence
  RNA Oligomer
cgaugaaggaucucagcauccug

SEQ ID NO: 68197 - RNA, 23 nt, Artificial Sequence
  RNA Oligomer
gaugaaggaucucagcauccuga

SEQ ID NO: 68198 - RNA, 23 nt, Artificial Sequence
  RNA Oligomer
augaaggaucucagcauccugau

SEQ ID NO: 68199 - RNA, 23 nt, Artificial Sequence
  RNA Oligomer
uccuuggaaaugaggccauuccc

SEQ ID NO: 68200 - RNA, 23 nt, Artificial Sequence
  RNA Oligomer
ccuuggaaaugaggccauuccca

SEQ ID NO: 68201 - RNA, 23 nt, Artificial Sequence
  RNA Oligomer
cuuggaaaugaggccauucccau

SEQ ID NO: 68202 - RNA, 23 nt, Artificial Sequence
  RNA Oligomer
uuggaaaugaggccauucccauc

SEQ ID NO: 68203 - RNA, 23 nt, Artificial Sequence
  RNA Oligomer
gcucuagccaggauaaguccugg

SEQ ID NO: 68204 - RNA, 23 nt, Artificial Sequence
  RNA Oligomer
cucuagccaggauaaguccuggu

SEQ ID NO: 68205 - RNA, 23 nt, Artificial Sequence
  RNA Oligomer
ucuagccaggauaaguccugguu

SEQ ID NO: 68206 - RNA, 23 nt, Artificial Sequence
  RNA Oligomer
cuagccaggauaaguccugguug

SEQ ID NO: 68207 - RNA, 23 nt, Artificial Sequence
  RNA Oligomer
uagccaggauaaguccugguugu

SEQ ID NO: 68208 - RNA, 23 nt, Artificial Sequence
  RNA Oligomer
agcucuggagacacuugaguucc

SEQ ID NO: 68209 - RNA, 23 nt, Artificial Sequence
  RNA Oligomer
gcucuggagacacuugaguuccg

SEQ ID NO: 68210 - RNA, 23 nt, Artificial Sequence
  RNA Oligomer
cucuggagacacuugaguuccga

SEQ ID NO: 68211 - RNA, 23 nt, Artificial Sequence
  RNA Oligomer
ucuggagacacuugaguuccgau

SEQ ID NO: 68212 - RNA, 23 nt, Artificial Sequence
  RNA Oligomer
ggagacacuugaguuccgauuga

SEQ ID NO: 68213 - RNA, 23 nt, Artificial Sequence
  RNA Oligomer
gagacacuugaguuccgauugau

SEQ ID NO: 68214 - RNA, 23 nt, Artificial Sequence
  RNA Oligomer
agacacuugaguuccgauugaug

SEQ ID NO: 68215 - RNA, 23 nt, Artificial Sequence
  RNA Oligomer
gacacuugaguuccgauugauga

SEQ ID NO: 68216 - RNA, 23 nt, Artificial Sequence
  RNA Oligomer
uuuauuuggaagggagacuacug

SEQ ID NO: 68217 - RNA, 23 nt, Artificial Sequence
  RNA Oligomer
ucugaugaaagaacgugcuuaaa

SEQ ID NO: 68218 - RNA, 23 nt, Artificial Sequence
  RNA Oligomer
guucuaagaugccagcauccaug

SEQ ID NO: 68219 - RNA, 23 nt, Artificial Sequence
  RNA Oligomer
ugugcuccaugagguuguuguac

SEQ ID NO: 68220 - RNA, 23 nt, Artificial Sequence
  RNA Oligomer
gugcuccaugagguuguuguacc

SEQ ID NO: 68221 - RNA, 23 nt, Artificial Sequence
  RNA Oligomer
ugcuccaugagguuguuguacca

SEQ ID NO: 68222 - RNA, 23 nt, Artificial Sequence
  RNA Oligomer
ugucuucugagauuuguuucuga

SEQ ID NO: 68223 - RNA, 23 nt, Artificial Sequence
  RNA Oligomer
gucuucugagauuuguuucugaa

SEQ ID NO: 68224 - RNA, 23 nt, Artificial Sequence
  RNA Oligomer
ucuucugagauuuguuucugaag

SEQ ID NO: 68225 - RNA, 23 nt, Artificial Sequence
  RNA Oligomer
cuucugagauuuguuucugaagu

SEQ ID NO: 68226 - RNA, 23 nt, Artificial Sequence
  RNA Oligomer
uucugagauuuguuucugaaguc

SEQ ID NO: 68227 - RNA, 23 nt, Artificial Sequence
  RNA Oligomer
ugagguuguuguaccacccauca

SEQ ID NO: 68228 - RNA, 23 nt, Artificial Sequence
  RNA Oligomer
cuggaagugccgcucacagaugu

SEQ ID NO: 68229 - RNA, 23 nt, Artificial Sequence
  RNA Oligomer
uggaagugccgcucacagaugua

SEQ ID NO: 68230 - RNA, 23 nt, Artificial Sequence
  RNA Oligomer
ggaagugccgcucacagauguac

SEQ ID NO: 68231 - RNA, 23 nt, Artificial Sequence
  RNA Oligomer
gaagugccgcucacagauguaca

SEQ ID NO: 68232 - RNA, 23 nt, Artificial Sequence
  RNA Oligomer
aagugccgcucacagauguacag

SEQ ID NO: 68233 - RNA, 23 nt, Artificial Sequence
  RNA Oligomer
uugaggaagguuucucgcaggaa

SEQ ID NO: 68234 - RNA, 23 nt, Artificial Sequence
  RNA Oligomer
gguuucucgcaggaaggugauga

SEQ ID NO: 68235 - RNA, 23 nt, Artificial Sequence
  RNA Oligomer
guuucucgcaggaaggugaugag

SEQ ID NO: 68236 - RNA, 23 nt, Artificial Sequence
  RNA Oligomer
uuucucgcaggaaggugaugagg

SEQ ID NO: 68237 - RNA, 23 nt, Artificial Sequence
  RNA Oligomer
uucucgcaggaaggugaugaggu

SEQ ID NO: 68238 - RNA, 23 nt, Artificial Sequence
  RNA Oligomer
ucucgcaggaaggugaugagguu

SEQ ID NO: 68239 - RNA, 23 nt, Artificial Sequence
  RNA Oligomer
gagcaagauguaggagaacauga

SEQ ID NO: 68240 - RNA, 23 nt, Artificial Sequence
  RNA Oligomer
agcaagauguaggagaacaugaa

SEQ ID NO: 68241 - RNA, 23 nt, Artificial Sequence
  RNA Oligomer
gcaagauguaggagaacaugaaa

SEQ ID NO: 68242 - RNA, 23 nt, Artificial Sequence
  RNA Oligomer
caagauguaggagaacaugaaag

SEQ ID NO: 68243 - RNA, 23 nt, Artificial Sequence
  RNA Oligomer
augucccaaaauggagacccuuc

SEQ ID NO: 68244 - RNA, 23 nt, Artificial Sequence
  RNA Oligomer
ccgguaguucucaaugaagcgcu

SEQ ID NO: 68245 - RNA, 23 nt, Artificial Sequence
  RNA Oligomer
cgguaguucucaaugaagcgcuu

SEQ ID NO: 68246 - RNA, 23 nt, Artificial Sequence
  RNA Oligomer
gguaguucucaaugaagcgcuug

SEQ ID NO: 68247 - RNA, 23 nt, Artificial Sequence
  RNA Oligomer
gcagcaccaggucauacuccuug

SEQ ID NO: 68248 - RNA, 23 nt, Artificial Sequence
  RNA Oligomer
cagcaccaggucauacuccuugg

SEQ ID NO: 68249 - RNA, 23 nt, Artificial Sequence
  RNA Oligomer
agcaccaggucauacuccuuggg

SEQ ID NO: 68250 - RNA, 23 nt, Artificial Sequence
  RNA Oligomer
gcaccaggucauacuccuugggg

SEQ ID NO: 68251 - RNA, 23 nt, Artificial Sequence
  RNA Oligomer
caccaggucauacuccuugggga

SEQ ID NO: 68252 - RNA, 23 nt, Artificial Sequence
  RNA Oligomer
caggacgaaguugaccuucugug

SEQ ID NO: 68253 - RNA, 23 nt, Artificial Sequence
  RNA Oligomer
aggacgaaguugaccuucugugg

SEQ ID NO: 68254 - RNA, 23 nt, Artificial Sequence
  RNA Oligomer
ggacgaaguugaccuucugugga

SEQ ID NO: 68255 - RNA, 23 nt, Artificial Sequence
  RNA Oligomer
gccauuccaaagcuuccaugccu

SEQ ID NO: 68256 - RNA, 23 nt, Artificial Sequence
  RNA Oligomer
ccauuccaaagcuuccaugccuc

SEQ ID NO: 68257 - RNA, 23 nt, Artificial Sequence
  RNA Oligomer
cauuccaaagcuuccaugccucc

SEQ ID NO: 68258 - RNA, 23 nt, Artificial Sequence
  RNA Oligomer
auuccaaagcuuccaugccuccc

SEQ ID NO: 68259 - RNA, 23 nt, Artificial Sequence
  RNA Oligomer
uuccaaagcuuccaugccuccca

SEQ ID NO: 68260 - RNA, 23 nt, Artificial Sequence
  RNA Oligomer
cccauuccugguguucucaaacc

SEQ ID NO: 68261 - RNA, 23 nt, Artificial Sequence
  RNA Oligomer
ccauuccugguguucucaaacca

SEQ ID NO: 68262 - RNA, 23 nt, Artificial Sequence
  RNA Oligomer
cauuccugguguucucaaaccag

SEQ ID NO: 68263 - RNA, 23 nt, Artificial Sequence
  RNA Oligomer
auuccugguguucucaaaccagu

SEQ ID NO: 68264 - RNA, 23 nt, Artificial Sequence
  RNA Oligomer
uuccugguguucucaaaccagua

SEQ ID NO: 68265 - RNA, 23 nt, Artificial Sequence
  RNA Oligomer
uguucucaaaccaguagcgguca

SEQ ID NO: 68266 - RNA, 23 nt, Artificial Sequence
  RNA Oligomer
aggauaaguccugguuguacagg

SEQ ID NO: 68267 - RNA, 23 nt, Artificial Sequence
  RNA Oligomer
cggguaaugggagacaagcccag

SEQ ID NO: 68268 - RNA, 23 nt, Artificial Sequence
  RNA Oligomer
ggguaaugggagacaagcccagu

SEQ ID NO: 68269 - RNA, 23 nt, Artificial Sequence
  RNA Oligomer
gguaaugggagacaagcccagug

SEQ ID NO: 68270 - RNA, 23 nt, Artificial Sequence
  RNA Oligomer
guaaugggagacaagcccagugc

SEQ ID NO: 68271 - RNA, 23 nt, Artificial Sequence
  RNA Oligomer
uaaugggagacaagcccagugcu

SEQ ID NO: 68272 - RNA, 23 nt, Artificial Sequence
  RNA Oligomer
caaccaacacaugguccucucgc

SEQ ID NO: 68273 - RNA, 23 nt, Artificial Sequence
  RNA Oligomer
gcagugcauccacaucuucagca

SEQ ID NO: 68274 - RNA, 23 nt, Artificial Sequence
  RNA Oligomer
cagugcauccacaucuucagcac

SEQ ID NO: 68275 - RNA, 23 nt, Artificial Sequence
  RNA Oligomer
agugcauccacaucuucagcacu

SEQ ID NO: 68276 - RNA, 23 nt, Artificial Sequence
  RNA Oligomer
gugcauccacaucuucagcacuu

SEQ ID NO: 68277 - RNA, 23 nt, Artificial Sequence
  RNA Oligomer
ugcauccacaucuucagcacuuu

SEQ ID NO: 68278 - RNA, 23 nt, Artificial Sequence
  RNA Oligomer
uguauacuccgggaguguuuucu

SEQ ID NO: 68279 - RNA, 23 nt, Artificial Sequence
  RNA Oligomer
guauacuccgggaguguuuucug

SEQ ID NO: 68280 - RNA, 23 nt, Artificial Sequence
  RNA Oligomer
uauacuccgggaguguuuucugc

SEQ ID NO: 68281 - RNA, 23 nt, Artificial Sequence
  RNA Oligomer
auacuccgggaguguuuucugca

SEQ ID NO: 68282 - RNA, 23 nt, Artificial Sequence
  RNA Oligomer
uacuccgggaguguuuucugcag

SEQ ID NO: 68283 - RNA, 23 nt, Artificial Sequence
  RNA Oligomer
acauagguauugggccagggucu

SEQ ID NO: 68284 - RNA, 23 nt, Artificial Sequence
  RNA Oligomer
ucugagauuuguuucugaagucu

SEQ ID NO: 68285 - RNA, 23 nt, Artificial Sequence
  RNA Oligomer
cugagauuuguuucugaagucug

SEQ ID NO: 68286 - RNA, 23 nt, Artificial Sequence
  RNA Oligomer
ccacacauggugacugacuaugg

SEQ ID NO: 68287 - RNA, 23 nt, Artificial Sequence
  RNA Oligomer
cacacauggugacugacuauggc

SEQ ID NO: 68288 - RNA, 23 nt, Artificial Sequence
  RNA Oligomer
acacauggugacugacuauggcc

SEQ ID NO: 68289 - RNA, 23 nt, Artificial Sequence
  RNA Oligomer
cacauggugacugacuauggcca

SEQ ID NO: 68290 - RNA, 23 nt, Artificial Sequence
  RNA Oligomer
acauggugacugacuauggccac

SEQ ID NO: 68291 - RNA, 23 nt, Artificial Sequence
  RNA Oligomer
cauggugacugacuauggccacc

SEQ ID NO: 68292 - RNA, 23 nt, Artificial Sequence
  RNA Oligomer
gaguugaagaagggcucaaaggg

SEQ ID NO: 68293 - RNA, 23 nt, Artificial Sequence
  RNA Oligomer
aguugaagaagggcucaaagggg

SEQ ID NO: 68294 - RNA, 23 nt, Artificial Sequence
  RNA Oligomer
guugaagaagggcucaaaggggg

SEQ ID NO: 68295 - RNA, 23 nt, Artificial Sequence
  RNA Oligomer
uugaagaagggcucaaagggggg

SEQ ID NO: 68296 - RNA, 23 nt, Artificial Sequence
  RNA Oligomer
ugaagaagggcucaaagggggga

SEQ ID NO: 68297 - RNA, 23 nt, Artificial Sequence
  RNA Oligomer
ccgcucacagauguacagcauag

SEQ ID NO: 68298 - RNA, 23 nt, Artificial Sequence
  RNA Oligomer
cgcucacagauguacagcauagu

SEQ ID NO: 68299 - RNA, 23 nt, Artificial Sequence
  RNA Oligomer
gcucacagauguacagcauagug

SEQ ID NO: 68300 - RNA, 23 nt, Artificial Sequence
  RNA Oligomer
guggucauucuccuccaccucuc

SEQ ID NO: 68301 - RNA, 23 nt, Artificial Sequence
  RNA Oligomer
uggucauucuccuccaccucucg

SEQ ID NO: 68302 - RNA, 23 nt, Artificial Sequence
  RNA Oligomer
ggucauucuccuccaccucucgg

SEQ ID NO: 68303 - RNA, 23 nt, Artificial Sequence
  RNA Oligomer
gucauucuccuccaccucucgga

SEQ ID NO: 68304 - RNA, 23 nt, Artificial Sequence
  RNA Oligomer
ucauucuccuccaccucucggau

SEQ ID NO: 68305 - RNA, 23 nt, Artificial Sequence
  RNA Oligomer
uacagaacacuuggcagcugacg

SEQ ID NO: 68306 - RNA, 23 nt, Artificial Sequence
  RNA Oligomer
accaccaguaauacuucuggggg

SEQ ID NO: 68307 - RNA, 23 nt, Artificial Sequence
  RNA Oligomer
ccaccaguaauacuucuggggga

SEQ ID NO: 68308 - RNA, 23 nt, Artificial Sequence
  RNA Oligomer
caccaguaauacuucugggggag

SEQ ID NO: 68309 - RNA, 23 nt, Artificial Sequence
  RNA Oligomer
ggggcucagggauuagaaugucc

SEQ ID NO: 68310 - RNA, 23 nt, Artificial Sequence
  RNA Oligomer
gggcucagggauuagaauguccc

SEQ ID NO: 68311 - RNA, 23 nt, Artificial Sequence
  RNA Oligomer
ggcucagggauuagaauguccca

SEQ ID NO: 68312 - RNA, 23 nt, Artificial Sequence
  RNA Oligomer
gcucagggauuagaaugucccaa

SEQ ID NO: 68313 - RNA, 23 nt, Artificial Sequence
  RNA Oligomer
cucagggauuagaaugucccaaa

SEQ ID NO: 68314 - RNA, 23 nt, Artificial Sequence
  RNA Oligomer
uacacauucaccacauggcccac

SEQ ID NO: 68315 - RNA, 23 nt, Artificial Sequence
  RNA Oligomer
gcggcaaaggcguaguaguaggc

SEQ ID NO: 68316 - RNA, 23 nt, Artificial Sequence
  RNA Oligomer
cggcaaaggcguaguaguaggcc

SEQ ID NO: 68317 - RNA, 23 nt, Artificial Sequence
  RNA Oligomer
ggcaaaggcguaguaguaggccc

SEQ ID NO: 68318 - RNA, 23 nt, Artificial Sequence
  RNA Oligomer
gcaaaggcguaguaguaggcccu

SEQ ID NO: 68319 - RNA, 23 nt, Artificial Sequence
  RNA Oligomer
caaaggcguaguaguaggcccuc

SEQ ID NO: 68320 - RNA, 23 nt, Artificial Sequence
  RNA Oligomer
aaaggcguaguaguaggcccucu

SEQ ID NO: 68321 - RNA, 23 nt, Artificial Sequence
  RNA Oligomer
gacagaucauauccuggcugaug

SEQ ID NO: 68322 - RNA, 23 nt, Artificial Sequence
  RNA Oligomer
gagguccuugaugacuucaggca

SEQ ID NO: 68323 - RNA, 23 nt, Artificial Sequence
  RNA Oligomer
agguccuugaugacuucaggcac

SEQ ID NO: 68324 - RNA, 23 nt, Artificial Sequence
  RNA Oligomer
gguccuugaugacuucaggcacc

SEQ ID NO: 68325 - RNA, 23 nt, Artificial Sequence
  RNA Oligomer
guccuugaugacuucaggcaccu

SEQ ID NO: 68326 - RNA, 23 nt, Artificial Sequence
  RNA Oligomer
uccuugaugacuucaggcaccuc

SEQ ID NO: 68327 - RNA, 23 nt, Artificial Sequence
  RNA Oligomer
acaugcggaacauaaggcgagac

SEQ ID NO: 68328 - RNA, 23 nt, Artificial Sequence
  RNA Oligomer
uaaggcgagacuuuuccucagga

SEQ ID NO: 68329 - RNA, 23 nt, Artificial Sequence
  RNA Oligomer
accaggucauacuccuuggggau

SEQ ID NO: 68330 - RNA, 23 nt, Artificial Sequence
  RNA Oligomer
aguugaccuucuguggaggcugc

SEQ ID NO: 68331 - RNA, 23 nt, Artificial Sequence
  RNA Oligomer
guugaccuucuguggaggcugca

SEQ ID NO: 68332 - RNA, 23 nt, Artificial Sequence
  RNA Oligomer
uugaccuucuguggaggcugcag

SEQ ID NO: 68333 - RNA, 23 nt, Artificial Sequence
  RNA Oligomer
aacaauccaggcacugagcaggc

SEQ ID NO: 68334 - RNA, 23 nt, Artificial Sequence
  RNA Oligomer
gggucaauguugauaacagcgac

SEQ ID NO: 68335 - RNA, 23 nt, Artificial Sequence
  RNA Oligomer
gcacuuuguaggcuugggugcuc

SEQ ID NO: 68336 - RNA, 23 nt, Artificial Sequence
  RNA Oligomer
cuggagacacuugaguuccgauu

SEQ ID NO: 68337 - RNA, 23 nt, Artificial Sequence
  RNA Oligomer
uggagacacuugaguuccgauug

SEQ ID NO: 68338 - RNA, 23 nt, Artificial Sequence
  RNA Oligomer
ucauacacagcgauguucuggua

SEQ ID NO: 68339 - RNA, 23 nt, Artificial Sequence
  RNA Oligomer
cauacacagcgauguucugguag

SEQ ID NO: 68340 - RNA, 23 nt, Artificial Sequence
  RNA Oligomer
auacacagcgauguucugguagg

SEQ ID NO: 68341 - RNA, 23 nt, Artificial Sequence
  RNA Oligomer
uacacagcgauguucugguaggu

SEQ ID NO: 68342 - RNA, 23 nt, Artificial Sequence
  RNA Oligomer
ggccagggucugaugaaagaacg

SEQ ID NO: 68343 - RNA, 23 nt, Artificial Sequence
  RNA Oligomer
gccagggucugaugaaagaacgu

SEQ ID NO: 68344 - RNA, 23 nt, Artificial Sequence
  RNA Oligomer
ccagggucugaugaaagaacgug

SEQ ID NO: 68345 - RNA, 23 nt, Artificial Sequence
  RNA Oligomer
ggaguagggaggguucuaagaug

SEQ ID NO: 68346 - RNA, 23 nt, Artificial Sequence
  RNA Oligomer
cuugucuucugagauuuguuucu

SEQ ID NO: 68347 - RNA, 23 nt, Artificial Sequence
  RNA Oligomer
uugucuucugagauuuguuucug

SEQ ID NO: 68348 - RNA, 23 nt, Artificial Sequence
  RNA Oligomer
aggcugagacacauccugguccu

SEQ ID NO: 68349 - RNA, 23 nt, Artificial Sequence
  RNA Oligomer
ggcugagacacauccugguccug

SEQ ID NO: 68350 - RNA, 23 nt, Artificial Sequence
  RNA Oligomer
gcugagacacauccugguccugg

SEQ ID NO: 68351 - RNA, 23 nt, Artificial Sequence
  RNA Oligomer
cugagacacauccugguccuggg

SEQ ID NO: 68352 - RNA, 23 nt, Artificial Sequence
  RNA Oligomer
ugagacacauccugguccugggg

SEQ ID NO: 68353 - RNA, 23 nt, Artificial Sequence
  RNA Oligomer
ggcugaggcagccagaaauagga

SEQ ID NO: 68354 - RNA, 23 nt, Artificial Sequence
  RNA Oligomer
gcugaggcagccagaaauaggaa

SEQ ID NO: 68355 - RNA, 23 nt, Artificial Sequence
  RNA Oligomer
cugaggcagccagaaauaggaag

SEQ ID NO: 68356 - RNA, 23 nt, Artificial Sequence
  RNA Oligomer
ugaggcagccagaaauaggaaga

SEQ ID NO: 68357 - RNA, 23 nt, Artificial Sequence
  RNA Oligomer
gaggcagccagaaauaggaagaa

SEQ ID NO: 68358 - RNA, 23 nt, Artificial Sequence
  RNA Oligomer
cugccuguugaugagcugacagg

SEQ ID NO: 68359 - RNA, 23 nt, Artificial Sequence
  RNA Oligomer
ugccuguugaugagcugacaggc

SEQ ID NO: 68360 - RNA, 23 nt, Artificial Sequence
  RNA Oligomer
gccuguugaugagcugacaggcc

SEQ ID NO: 68361 - RNA, 23 nt, Artificial Sequence
  RNA Oligomer
ggccuuuuccacauucuugguca

SEQ ID NO: 68362 - RNA, 23 nt, Artificial Sequence
  RNA Oligomer
gccuuuuccacauucuuggucau

SEQ ID NO: 68363 - RNA, 23 nt, Artificial Sequence
  RNA Oligomer
ccuuuuccacauucuuggucaug

SEQ ID NO: 68364 - RNA, 23 nt, Artificial Sequence
  RNA Oligomer
cuuuuccacauucuuggucaugc

SEQ ID NO: 68365 - RNA, 23 nt, Artificial Sequence
  RNA Oligomer
uuuuccacauucuuggucaugcc

SEQ ID NO: 68366 - RNA, 23 nt, Artificial Sequence
  RNA Oligomer
ugacuugaagaccaggucuuuga

SEQ ID NO: 68367 - RNA, 23 nt, Artificial Sequence
  RNA Oligomer
gacuugaagaccaggucuuugag

SEQ ID NO: 68368 - RNA, 23 nt, Artificial Sequence
  RNA Oligomer
acuugaagaccaggucuuugagg

SEQ ID NO: 68369 - RNA, 23 nt, Artificial Sequence
  RNA Oligomer
cuugaagaccaggucuuugagga

SEQ ID NO: 68370 - RNA, 23 nt, Artificial Sequence
  RNA Oligomer
uugaagaccaggucuuugaggau

SEQ ID NO: 68371 - RNA, 23 nt, Artificial Sequence
  RNA Oligomer
accagaaguguccaugcuagagc

SEQ ID NO: 68372 - RNA, 23 nt, Artificial Sequence
  RNA Oligomer
ccagaaguguccaugcuagagcc

SEQ ID NO: 68373 - RNA, 23 nt, Artificial Sequence
  RNA Oligomer
cagaaguguccaugcuagagcca

SEQ ID NO: 68374 - RNA, 23 nt, Artificial Sequence
  RNA Oligomer
agaaguguccaugcuagagccag

SEQ ID NO: 68375 - RNA, 23 nt, Artificial Sequence
  RNA Oligomer
gaaguguccaugcuagagccagg

SEQ ID NO: 68376 - RNA, 23 nt, Artificial Sequence
  RNA Oligomer
aaguguccaugcuagagccaggc

SEQ ID NO: 68377 - RNA, 23 nt, Artificial Sequence
  RNA Oligomer
aaugguccaucaagguacagcuu

SEQ ID NO: 68378 - RNA, 23 nt, Artificial Sequence
  RNA Oligomer
augguccaucaagguacagcuuu

SEQ ID NO: 68379 - RNA, 23 nt, Artificial Sequence
  RNA Oligomer
ugguccaucaagguacagcuuug

SEQ ID NO: 68380 - RNA, 23 nt, Artificial Sequence
  RNA Oligomer
gguccaucaagguacagcuuugg

SEQ ID NO: 68381 - RNA, 23 nt, Artificial Sequence
  RNA Oligomer
guccaucaagguacagcuuuggg

SEQ ID NO: 68382 - RNA, 23 nt, Artificial Sequence
  RNA Oligomer
uccaucaagguacagcuuugggu

SEQ ID NO: 68383 - RNA, 23 nt, Artificial Sequence
  RNA Oligomer
ccaucaagguacagcuuugggua

SEQ ID NO: 68384 - RNA, 23 nt, Artificial Sequence
  RNA Oligomer
caucaagguacagcuuuggguau

SEQ ID NO: 68385 - RNA, 23 nt, Artificial Sequence
  RNA Oligomer
ucagggauuagaaugucccaaaa

SEQ ID NO: 68386 - RNA, 23 nt, Artificial Sequence
  RNA Oligomer
gccgguaguucucaaugaagcgc

SEQ ID NO: 68387 - RNA, 23 nt, Artificial Sequence
  RNA Oligomer
ugucccaaaauggagacccuuca

SEQ ID NO: 68388 - RNA, 23 nt, Artificial Sequence
  RNA Oligomer
aagcgcuugaacuguugcaccgu

SEQ ID NO: 68389 - RNA, 23 nt, Artificial Sequence
  RNA Oligomer
acagaucauauccuggcugaugu

SEQ ID NO: 68390 - RNA, 23 nt, Artificial Sequence
  RNA Oligomer
cagaucauauccuggcugaugua

SEQ ID NO: 68391 - RNA, 23 nt, Artificial Sequence
  RNA Oligomer
agaucauauccuggcugauguag

SEQ ID NO: 68392 - RNA, 23 nt, Artificial Sequence
  RNA Oligomer
gaucauauccuggcugauguagg

SEQ ID NO: 68393 - RNA, 23 nt, Artificial Sequence
  RNA Oligomer
aucauauccuggcugauguagga

SEQ ID NO: 68394 - RNA, 23 nt, Artificial Sequence
  RNA Oligomer
cgugaagcggagcucgcuauugu

SEQ ID NO: 68395 - RNA, 23 nt, Artificial Sequence
  RNA Oligomer
gugaagcggagcucgcuauugug

SEQ ID NO: 68396 - RNA, 23 nt, Artificial Sequence
  RNA Oligomer
ugaagcggagcucgcuauugugg

SEQ ID NO: 68397 - RNA, 23 nt, Artificial Sequence
  RNA Oligomer
gaagcggagcucgcuauuguggu

SEQ ID NO: 68398 - RNA, 23 nt, Artificial Sequence
  RNA Oligomer
aagcggagcucgcuauugugguc

SEQ ID NO: 68399 - RNA, 23 nt, Artificial Sequence
  RNA Oligomer
aucaaagucguacaugcggaaca

SEQ ID NO: 68400 - RNA, 23 nt, Artificial Sequence
  RNA Oligomer
acuuuuccucaggagagccuuuc

SEQ ID NO: 68401 - RNA, 23 nt, Artificial Sequence
  RNA Oligomer
cuuuuccucaggagagccuuuca

SEQ ID NO: 68402 - RNA, 23 nt, Artificial Sequence
  RNA Oligomer
uuuuccucaggagagccuuucau

SEQ ID NO: 68403 - RNA, 23 nt, Artificial Sequence
  RNA Oligomer
uuuccucaggagagccuuucaug

SEQ ID NO: 68404 - RNA, 23 nt, Artificial Sequence
  RNA Oligomer
uuccucaggagagccuuucauga

SEQ ID NO: 68405 - RNA, 23 nt, Artificial Sequence
  RNA Oligomer
cuucuuggagaacagcccauucc

SEQ ID NO: 68406 - RNA, 23 nt, Artificial Sequence
  RNA Oligomer
uucuuggagaacagcccauuccu

SEQ ID NO: 68407 - RNA, 23 nt, Artificial Sequence
  RNA Oligomer
ucuuggagaacagcccauuccug

SEQ ID NO: 68408 - RNA, 23 nt, Artificial Sequence
  RNA Oligomer
cuuggagaacagcccauuccugg

SEQ ID NO: 68409 - RNA, 23 nt, Artificial Sequence
  RNA Oligomer
uuggagaacagcccauuccuggu

SEQ ID NO: 68410 - RNA, 23 nt, Artificial Sequence
  RNA Oligomer
cgccacgaacucugaggagaugc

SEQ ID NO: 68411 - RNA, 23 nt, Artificial Sequence
  RNA Oligomer
gccacgaacucugaggagaugcu

SEQ ID NO: 68412 - RNA, 23 nt, Artificial Sequence
  RNA Oligomer
ccacgaacucugaggagaugcug

SEQ ID NO: 68413 - RNA, 23 nt, Artificial Sequence
  RNA Oligomer
auggccgguauccuguauacucc

SEQ ID NO: 68414 - RNA, 23 nt, Artificial Sequence
  RNA Oligomer
uggccgguauccuguauacuccg

SEQ ID NO: 68415 - RNA, 23 nt, Artificial Sequence
  RNA Oligomer
ggccgguauccuguauacuccgg

SEQ ID NO: 68416 - RNA, 23 nt, Artificial Sequence
  RNA Oligomer
gccgguauccuguauacuccggg

SEQ ID NO: 68417 - RNA, 23 nt, Artificial Sequence
  RNA Oligomer
ccgguauccuguauacuccggga

SEQ ID NO: 68418 - RNA, 23 nt, Artificial Sequence
  RNA Oligomer
cgguauccuguauacuccgggag

SEQ ID NO: 68419 - RNA, 23 nt, Artificial Sequence
  RNA Oligomer
gguauccuguauacuccgggagu

SEQ ID NO: 68420 - RNA, 23 nt, Artificial Sequence
  RNA Oligomer
guauccuguauacuccgggagug

SEQ ID NO: 68421 - RNA, 23 nt, Artificial Sequence
  RNA Oligomer
ugcgaggaaccauagauggcgcu

SEQ ID NO: 68422 - RNA, 23 nt, Artificial Sequence
  RNA Oligomer
ugcgaauguugaggaacucggcg

SEQ ID NO: 68423 - RNA, 23 nt, Artificial Sequence
  RNA Oligomer
gcgaauguugaggaacucggcgg

SEQ ID NO: 68424 - RNA, 23 nt, Artificial Sequence
  RNA Oligomer
cgaauguugaggaacucggcggg

SEQ ID NO: 68425 - RNA, 23 nt, Artificial Sequence
  RNA Oligomer
gaauguugaggaacucggcgggg

SEQ ID NO: 68426 - RNA, 23 nt, Artificial Sequence
  RNA Oligomer
aauguugaggaacucggcggggc

SEQ ID NO: 68427 - RNA, 23 nt, Artificial Sequence
  RNA Oligomer
cgugcuuaaaaccuugggugaaa

SEQ ID NO: 68428 - RNA, 23 nt, Artificial Sequence
  RNA Oligomer
gugcuuaaaaccuugggugaaau

SEQ ID NO: 68429 - RNA, 23 nt, Artificial Sequence
  RNA Oligomer
ucugaagucuggaagcagagguu

SEQ ID NO: 68430 - RNA, 23 nt, Artificial Sequence
  RNA Oligomer
cugaagucuggaagcagagguuu

SEQ ID NO: 68431 - RNA, 23 nt, Artificial Sequence
  RNA Oligomer
ugaagucuggaagcagagguuuc

SEQ ID NO: 68432 - RNA, 23 nt, Artificial Sequence
  RNA Oligomer
gaagucuggaagcagagguuuca

SEQ ID NO: 68433 - RNA, 23 nt, Artificial Sequence
  RNA Oligomer
aagucuggaagcagagguuucac

SEQ ID NO: 68434 - RNA, 23 nt, Artificial Sequence
  RNA Oligomer
ggccaccuggaacaagguuggga

SEQ ID NO: 68435 - RNA, 23 nt, Artificial Sequence
  RNA Oligomer
gccaccuggaacaagguugggag

SEQ ID NO: 68436 - RNA, 23 nt, Artificial Sequence
  RNA Oligomer
ccaccuggaacaagguugggagg

SEQ ID NO: 68437 - RNA, 23 nt, Artificial Sequence
  RNA Oligomer
caccuggaacaagguugggaggu

SEQ ID NO: 68438 - RNA, 23 nt, Artificial Sequence
  RNA Oligomer
accuggaacaagguugggaggug

SEQ ID NO: 68439 - RNA, 23 nt, Artificial Sequence
  RNA Oligomer
guucagaaccuucuggaagugcc

SEQ ID NO: 68440 - RNA, 23 nt, Artificial Sequence
  RNA Oligomer
uucagaaccuucuggaagugccg

SEQ ID NO: 68441 - RNA, 23 nt, Artificial Sequence
  RNA Oligomer
ucagaaccuucuggaagugccgc

SEQ ID NO: 68442 - RNA, 23 nt, Artificial Sequence
  RNA Oligomer
cagaaccuucuggaagugccgcu

SEQ ID NO: 68443 - RNA, 23 nt, Artificial Sequence
  RNA Oligomer
agaaccuucuggaagugccgcuc

SEQ ID NO: 68444 - RNA, 23 nt, Artificial Sequence
  RNA Oligomer
gauguagaugugcacagacacca

SEQ ID NO: 68445 - RNA, 23 nt, Artificial Sequence
  RNA Oligomer
auguagaugugcacagacaccag

SEQ ID NO: 68446 - RNA, 23 nt, Artificial Sequence
  RNA Oligomer
uguagaugugcacagacaccagg

SEQ ID NO: 68447 - RNA, 23 nt, Artificial Sequence
  RNA Oligomer
guagaugugcacagacaccaggu

SEQ ID NO: 68448 - RNA, 23 nt, Artificial Sequence
  RNA Oligomer
uagaugugcacagacaccagguc

SEQ ID NO: 68449 - RNA, 23 nt, Artificial Sequence
  RNA Oligomer
aacuuaugccacuccugguggcc

SEQ ID NO: 68450 - RNA, 23 nt, Artificial Sequence
  RNA Oligomer
acuuaugccacuccugguggccc

SEQ ID NO: 68451 - RNA, 23 nt, Artificial Sequence
  RNA Oligomer
aucaagguacagcuuuggguauc

SEQ ID NO: 68452 - RNA, 23 nt, Artificial Sequence
  RNA Oligomer
ccggaugugcaggcuaagcgugu

SEQ ID NO: 68453 - RNA, 23 nt, Artificial Sequence
  RNA Oligomer
cggaugugcaggcuaagcguguc

SEQ ID NO: 68454 - RNA, 23 nt, Artificial Sequence
  RNA Oligomer
ggaugugcaggcuaagcgugucc

SEQ ID NO: 68455 - RNA, 23 nt, Artificial Sequence
  RNA Oligomer
gaugugcaggcuaagcguguccu

SEQ ID NO: 68456 - RNA, 23 nt, Artificial Sequence
  RNA Oligomer
augugcaggcuaagcguguccuc

SEQ ID NO: 68457 - RNA, 23 nt, Artificial Sequence
  RNA Oligomer
cuggaucagggcaaagcuaccau

SEQ ID NO: 68458 - RNA, 23 nt, Artificial Sequence
  RNA Oligomer
uggaucagggcaaagcuaccaug

SEQ ID NO: 68459 - RNA, 23 nt, Artificial Sequence
  RNA Oligomer
ggaucagggcaaagcuaccaugg

SEQ ID NO: 68460 - RNA, 23 nt, Artificial Sequence
  RNA Oligomer
gaucagggcaaagcuaccaugga

SEQ ID NO: 68461 - RNA, 23 nt, Artificial Sequence
  RNA Oligomer
aucagggcaaagcuaccauggau

SEQ ID NO: 68462 - RNA, 23 nt, Artificial Sequence
  RNA Oligomer
augaggcgauggaaguccacggc

SEQ ID NO: 68463 - RNA, 23 nt, Artificial Sequence
  RNA Oligomer
ugaacuguugcaccgucuggugg

SEQ ID NO: 68464 - RNA, 23 nt, Artificial Sequence
  RNA Oligomer
gaacuguugcaccgucuggugga

SEQ ID NO: 68465 - RNA, 23 nt, Artificial Sequence
  RNA Oligomer
aacuguugcaccgucugguggag

SEQ ID NO: 68466 - RNA, 23 nt, Artificial Sequence
  RNA Oligomer
ugaaggaucucagcauccugaug

SEQ ID NO: 68467 - RNA, 23 nt, Artificial Sequence
  RNA Oligomer
gaaggaucucagcauccugauga

SEQ ID NO: 68468 - RNA, 23 nt, Artificial Sequence
  RNA Oligomer
aaggaucucagcauccugaugaa

SEQ ID NO: 68469 - RNA, 23 nt, Artificial Sequence
  RNA Oligomer
aaaggugccugaaaaaggucucc

SEQ ID NO: 68470 - RNA, 23 nt, Artificial Sequence
  RNA Oligomer
aaggugccugaaaaaggucucca

SEQ ID NO: 68471 - RNA, 23 nt, Artificial Sequence
  RNA Oligomer
aggugccugaaaaaggucuccag

SEQ ID NO: 68472 - RNA, 23 nt, Artificial Sequence
  RNA Oligomer
ggugccugaaaaaggucuccagg

SEQ ID NO: 68473 - RNA, 23 nt, Artificial Sequence
  RNA Oligomer
gugccugaaaaaggucuccagga

SEQ ID NO: 68474 - RNA, 23 nt, Artificial Sequence
  RNA Oligomer
uccaaagcuuccaugccucccac

SEQ ID NO: 68475 - RNA, 23 nt, Artificial Sequence
  RNA Oligomer
ccaaagcuuccaugccucccacg

SEQ ID NO: 68476 - RNA, 23 nt, Artificial Sequence
  RNA Oligomer
caaagcuuccaugccucccacga

SEQ ID NO: 68477 - RNA, 23 nt, Artificial Sequence
  RNA Oligomer
aaagcuuccaugccucccacgag

SEQ ID NO: 68478 - RNA, 23 nt, Artificial Sequence
  RNA Oligomer
auguugauaacagcgaccagcac

SEQ ID NO: 68479 - RNA, 23 nt, Artificial Sequence
  RNA Oligomer
guucucaaaccaguagcggucac

SEQ ID NO: 68480 - RNA, 23 nt, Artificial Sequence
  RNA Oligomer
caggauaaguccugguuguacag

SEQ ID NO: 68481 - RNA, 23 nt, Artificial Sequence
  RNA Oligomer
ccagcagcagugcauccacaucu

SEQ ID NO: 68482 - RNA, 23 nt, Artificial Sequence
  RNA Oligomer
cagcagcagugcauccacaucuu

SEQ ID NO: 68483 - RNA, 23 nt, Artificial Sequence
  RNA Oligomer
agcagcagugcauccacaucuuc

SEQ ID NO: 68484 - RNA, 23 nt, Artificial Sequence
  RNA Oligomer
gcagcagugcauccacaucuuca

SEQ ID NO: 68485 - RNA, 23 nt, Artificial Sequence
  RNA Oligomer
cagcagugcauccacaucuucag

SEQ ID NO: 68486 - RNA, 23 nt, Artificial Sequence
  RNA Oligomer
cuucagcacuuuguaggcuuggg

SEQ ID NO: 68487 - RNA, 23 nt, Artificial Sequence
  RNA Oligomer
uucagcacuuuguaggcuugggu

SEQ ID NO: 68488 - RNA, 23 nt, Artificial Sequence
  RNA Oligomer
ucagcacuuuguaggcuugggug

SEQ ID NO: 68489 - RNA, 23 nt, Artificial Sequence
  RNA Oligomer
cagcacuuuguaggcuugggugc

SEQ ID NO: 68490 - RNA, 23 nt, Artificial Sequence
  RNA Oligomer
agcacuuuguaggcuugggugcu

SEQ ID NO: 68491 - RNA, 23 nt, Artificial Sequence
  RNA Oligomer
gaugcgaauguugaggaacucgg

SEQ ID NO: 68492 - RNA, 23 nt, Artificial Sequence
  RNA Oligomer
augcgaauguugaggaacucggc

SEQ ID NO: 68493 - RNA, 23 nt, Artificial Sequence
  RNA Oligomer
caggucauacuccuuggggaucu

SEQ ID NO: 68494 - RNA, 23 nt, Artificial Sequence
  RNA Oligomer
aggucauacuccuuggggaucuu

SEQ ID NO: 68495 - RNA, 23 nt, Artificial Sequence
  RNA Oligomer
ggucauacuccuuggggaucuug

SEQ ID NO: 68496 - RNA, 23 nt, Artificial Sequence
  RNA Oligomer
gucauacuccuuggggaucuuga

SEQ ID NO: 68497 - RNA, 23 nt, Artificial Sequence
  RNA Oligomer
ucauacuccuuggggaucuugag

SEQ ID NO: 68498 - RNA, 23 nt, Artificial Sequence
  RNA Oligomer
caggucuuugaggauggaggcaa

SEQ ID NO: 68499 - RNA, 23 nt, Artificial Sequence
  RNA Oligomer
aggucuuugaggauggaggcaaa

SEQ ID NO: 68500 - RNA, 23 nt, Artificial Sequence
  RNA Oligomer
ggucuuugaggauggaggcaaaa

SEQ ID NO: 68501 - RNA, 23 nt, Artificial Sequence
  RNA Oligomer
gucuuugaggauggaggcaaaag

SEQ ID NO: 68502 - RNA, 23 nt, Artificial Sequence
  RNA Oligomer
ucuuugaggauggaggcaaaagg

SEQ ID NO: 68503 - RNA, 23 nt, Artificial Sequence
  RNA Oligomer
gcugcguuggaacuucucucggu

SEQ ID NO: 68504 - RNA, 23 nt, Artificial Sequence
  RNA Oligomer
cugcguuggaacuucucucggug

SEQ ID NO: 68505 - RNA, 23 nt, Artificial Sequence
  RNA Oligomer
ugcguuggaacuucucucggugc

SEQ ID NO: 68506 - RNA, 23 nt, Artificial Sequence
  RNA Oligomer
gcguuggaacuucucucggugcg

SEQ ID NO: 68507 - RNA, 23 nt, Artificial Sequence
  RNA Oligomer
cguuggaacuucucucggugcgc

SEQ ID NO: 68508 - RNA, 23 nt, Artificial Sequence
  RNA Oligomer
agggugguauuucggauuucuuc

SEQ ID NO: 68509 - RNA, 23 nt, Artificial Sequence
  RNA Oligomer
ugcagggugguauuucggauuuc

SEQ ID NO: 68510 - RNA, 23 nt, Artificial Sequence
  RNA Oligomer
auggcccacacuguguaagacug

SEQ ID NO: 68511 - RNA, 23 nt, Artificial Sequence
  RNA Oligomer
cugaggagcauugcauacauagg

SEQ ID NO: 68512 - RNA, 23 nt, Artificial Sequence
  RNA Oligomer
aacagcagcaccaggucauacuc

SEQ ID NO: 68513 - RNA, 23 nt, Artificial Sequence
  RNA Oligomer
aauccacugcccucaaaauaguc

SEQ ID NO: 68514 - RNA, 23 nt, Artificial Sequence
  RNA Oligomer
augucagccagccacucaaacug

SEQ ID NO: 68515 - RNA, 23 nt, Artificial Sequence
  RNA Oligomer
uuggcagcugacggaugacuuga

SEQ ID NO: 68516 - RNA, 23 nt, Artificial Sequence
  RNA Oligomer
aaggcgagacuuuuccucaggag

SEQ ID NO: 68517 - RNA, 23 nt, Artificial Sequence
  RNA Oligomer
augugcggcaaaggcguaguagu

SEQ ID NO: 68518 - RNA, 23 nt, Artificial Sequence
  RNA Oligomer
ucaugaagaccaccaggaugucc

SEQ ID NO: 68519 - RNA, 23 nt, Artificial Sequence
  RNA Oligomer
agccgcacaaauuguucaaggac

SEQ ID NO: 68520 - RNA, 23 nt, Artificial Sequence
  RNA Oligomer
ucagacccaucaucauggaagag

SEQ ID NO: 68521 - RNA, 23 nt, Artificial Sequence
  RNA Oligomer
cagacccaucaucauggaagagg

SEQ ID NO: 68522 - RNA, 23 nt, Artificial Sequence
  RNA Oligomer
uagugguccugaggucgaacuuc

SEQ ID NO: 68523 - RNA, 23 nt, Artificial Sequence
  RNA Oligomer
aaggcugaggcagccagaaauag

SEQ ID NO: 68524 - RNA, 23 nt, Artificial Sequence
  RNA Oligomer
cugacaggccuuuuccacauucu

SEQ ID NO: 68525 - RNA, 23 nt, Artificial Sequence
  RNA Oligomer
gacagcugcguuggaacuucucu

SEQ ID NO: 68526 - RNA, 23 nt, Artificial Sequence
  RNA Oligomer
aaucuccuucuuggagaacagcc

SEQ ID NO: 68527 - RNA, 23 nt, Artificial Sequence
  RNA Oligomer
uuucugaagucuggaagcagagg

SEQ ID NO: 68528 - RNA, 23 nt, Artificial Sequence
  RNA Oligomer
agacagcugcguuggaacuucuc

SEQ ID NO: 68529 - RNA, 23 nt, Artificial Sequence
  RNA Oligomer
uccugguguucucaaaccaguag

SEQ ID NO: 68530 - RNA, 23 nt, Artificial Sequence
  RNA Oligomer
uauggccaccuggaacaagguug

SEQ ID NO: 68531 - RNA, 23 nt, Artificial Sequence
  RNA Oligomer
auagacuccgguucagaaccuuc

SEQ ID NO: 68532 - RNA, 23 nt, Artificial Sequence
  RNA Oligomer
aggaagguuucucgcaggaaggu

SEQ ID NO: 68533 - RNA, 23 nt, Artificial Sequence
  RNA Oligomer
aacagcaagggcuggaaugacgu

SEQ ID NO: 68534 - RNA, 23 nt, Artificial Sequence
  RNA Oligomer
uauccuggcugauguaggaggcu

SEQ ID NO: 68535 - RNA, 23 nt, Artificial Sequence
  RNA Oligomer
aaagucguacaugcggaacauaa

SEQ ID NO: 68536 - RNA, 23 nt, Artificial Sequence
  RNA Oligomer
uucaugaagaccaccaggauguc

SEQ ID NO: 68537 - RNA, 23 nt, Artificial Sequence
  RNA Oligomer
auauccuggcugauguaggaggc

SEQ ID NO: 68538 - RNA, 23 nt, Artificial Sequence
  RNA Oligomer
uucucaaaccaguagcggucacc

SEQ ID NO: 68539 - RNA, 23 nt, Artificial Sequence
  RNA Oligomer
ggaugcgaauguugaggaacucg

SEQ ID NO: 68540 - RNA, 23 nt, Artificial Sequence
  RNA Oligomer
gaagcagagguuucacuuugccc

SEQ ID NO: 68541 - RNA, 23 nt, Artificial Sequence
  RNA Oligomer
aagguugggaggugggaaaucag

SEQ ID NO: 68542 - RNA, 23 nt, Artificial Sequence
  RNA Oligomer
aaggacgauggugcugaacagag

SEQ ID NO: 68543 - RNA, 23 nt, Artificial Sequence
  RNA Oligomer
ucuaccuccugcaaggcauuugc

SEQ ID NO: 68544 - RNA, 23 nt, Artificial Sequence
  RNA Oligomer
uaccuccugcaaggcauuugcca

SEQ ID NO: 68545 - RNA, 23 nt, Artificial Sequence
  RNA Oligomer
uuucuccaggcugagacacaucc

SEQ ID NO: 68546 - RNA, 23 nt, Artificial Sequence
  RNA Oligomer
augagcugacaggccuuuuccac

SEQ ID NO: 68547 - RNA, 23 nt, Artificial Sequence
  RNA Oligomer
cauauccuggcugauguaggagg

SEQ ID NO: 68548 - RNA, 23 nt, Artificial Sequence
  RNA Oligomer
uugaugacuucaggcaccuccac

SEQ ID NO: 68549 - RNA, 23 nt, Artificial Sequence
  RNA Oligomer
agccagagagaacauggacucca

SEQ ID NO: 68550 - RNA, 23 nt, Artificial Sequence
  RNA Oligomer
gaaaaggugccugaaaaaggucu

SEQ ID NO: 68551 - RNA, 23 nt, Artificial Sequence
  RNA Oligomer
aaagacauugggcugcagagcac

SEQ ID NO: 68552 - RNA, 23 nt, Artificial Sequence
  RNA Oligomer
aaagcacgugauagccaaagaag

SEQ ID NO: 68553 - RNA, 23 nt, Artificial Sequence
  RNA Oligomer
aagcacgugauagccaaagaaga

SEQ ID NO: 68554 - RNA, 23 nt, Artificial Sequence
  RNA Oligomer
uagacuccgguucagaaccuucu

SEQ ID NO: 68555 - RNA, 23 nt, Artificial Sequence
  RNA Oligomer
ucucugaggugucaacucagucu

SEQ ID NO: 68556 - RNA, 23 nt, Artificial Sequence
  RNA Oligomer
aagguacagcuuuggguaucugg

SEQ ID NO: 68557 - RNA, 23 nt, Artificial Sequence
  RNA Oligomer
uagaugauugcugggaccaggaa

SEQ ID NO: 68558 - RNA, 23 nt, Artificial Sequence
  RNA Oligomer
aucaucauggaagaggccaggaa

SEQ ID NO: 68559 - RNA, 23 nt, Artificial Sequence
  RNA Oligomer
aacagguacacauucaccacaug

SEQ ID NO: 68560 - RNA, 23 nt, Artificial Sequence
  RNA Oligomer
agagguccuugaugacuucaggc

SEQ ID NO: 68561 - RNA, 23 nt, Artificial Sequence
  RNA Oligomer
aaaugaggccauucccaucaaag

SEQ ID NO: 68562 - RNA, 23 nt, Artificial Sequence
  RNA Oligomer
aaugaggccauucccaucaaagu

SEQ ID NO: 68563 - RNA, 23 nt, Artificial Sequence
  RNA Oligomer
ucugugcgggaaaacuucagugg

SEQ ID NO: 68564 - RNA, 23 nt, Artificial Sequence
  RNA Oligomer
uauccuguauacuccgggagugu

SEQ ID NO: 68565 - RNA, 23 nt, Artificial Sequence
  RNA Oligomer
ugaugagcugacaggccuuuucc

SEQ ID NO: 68566 - RNA, 23 nt, Artificial Sequence
  RNA Oligomer
uggccuugccauuccaaagcuuc

SEQ ID NO: 68567 - RNA, 23 nt, Artificial Sequence
  RNA Oligomer
aucuccuucuuggagaacagccc

SEQ ID NO: 68568 - RNA, 23 nt, Artificial Sequence
  RNA Oligomer
gucugugcgggaaaacuucagug

SEQ ID NO: 68569 - RNA, 23 nt, Artificial Sequence
  RNA Oligomer
cagcuggcauuucucauguagac

SEQ ID NO: 68570 - RNA, 23 nt, Artificial Sequence
  RNA Oligomer
gaaauggccgguauccuguauac

SEQ ID NO: 68571 - RNA, 23 nt, Artificial Sequence
  RNA Oligomer
aauggccgguauccuguauacuc

SEQ ID NO: 68572 - RNA, 23 nt, Artificial Sequence
  RNA Oligomer
ucagcuugucuucugagauuugu

SEQ ID NO: 68573 - RNA, 23 nt, Artificial Sequence
  RNA Oligomer
ugguccugaggucgaacuucuca

SEQ ID NO: 68574 - RNA, 23 nt, Artificial Sequence
  RNA Oligomer
ugauguagaugugcacagacacc

SEQ ID NO: 68575 - RNA, 23 nt, Artificial Sequence
  RNA Oligomer
auacaugauggccaggaucagga

SEQ ID NO: 68576 - RNA, 23 nt, Artificial Sequence
  RNA Oligomer
uacaugauggccaggaucaggag

SEQ ID NO: 68577 - RNA, 23 nt, Artificial Sequence
  RNA Oligomer
acauggcccacacuguguaagac

SEQ ID NO: 68578 - RNA, 23 nt, Artificial Sequence
  RNA Oligomer
ucugaggugucaacucagucuca

SEQ ID NO: 68579 - RNA, 23 nt, Artificial Sequence
  RNA Oligomer
aucucagcauccugaugaacuca

SEQ ID NO: 68580 - RNA, 23 nt, Artificial Sequence
  RNA Oligomer
caggagagccuuucaugaagacc

SEQ ID NO: 68581 - RNA, 23 nt, Artificial Sequence
  RNA Oligomer
uggacaggacgaaguugaccuuc

SEQ ID NO: 68582 - RNA, 23 nt, Artificial Sequence
  RNA Oligomer
acaggacgaaguugaccuucugu

SEQ ID NO: 68583 - RNA, 23 nt, Artificial Sequence
  RNA Oligomer
cagcucuagccaggauaaguccu

SEQ ID NO: 68584 - RNA, 23 nt, Artificial Sequence
  RNA Oligomer
auagguauugggccagggucuga

SEQ ID NO: 68585 - RNA, 23 nt, Artificial Sequence
  RNA Oligomer
gucagcuugucuucugagauuug

SEQ ID NO: 68586 - RNA, 23 nt, Artificial Sequence
  RNA Oligomer
gaugagcugacaggccuuuucca

SEQ ID NO: 68587 - RNA, 23 nt, Artificial Sequence
  RNA Oligomer
gagcaggacauagagcaggaugu

SEQ ID NO: 68588 - RNA, 23 nt, Artificial Sequence
  RNA Oligomer
aguuccuccuuguccuggaaucc

SEQ ID NO: 68589 - RNA, 23 nt, Artificial Sequence
  RNA Oligomer
acgagcuucucagacacgaugcu

SEQ ID NO: 68590 - RNA, 23 nt, Artificial Sequence
  RNA Oligomer
agaacagcccauuccugguguuc

SEQ ID NO: 68591 - RNA, 23 nt, Artificial Sequence
  RNA Oligomer
ucuucagcacuuuguaggcuugg

SEQ ID NO: 68592 - RNA, 23 nt, Artificial Sequence
  RNA Oligomer
augacuugaagaccaggucuuug

SEQ ID NO: 68593 - RNA, 23 nt, Artificial Sequence
  RNA Oligomer
agguacagcuuuggguaucuggc

SEQ ID NO: 68594 - RNA, 23 nt, Artificial Sequence
  RNA Oligomer
cugcccugacuuguacucaaagc

SEQ ID NO: 68595 - RNA, 23 nt, Artificial Sequence
  RNA Oligomer
uacggucuggaagaaccaccagu

SEQ ID NO: 68596 - RNA, 23 nt, Artificial Sequence
  RNA Oligomer
ucaggagagccuuucaugaagac

SEQ ID NO: 68597 - RNA, 23 nt, Artificial Sequence
  RNA Oligomer
ucaccaaagggaagcaacagagg

SEQ ID NO: 68598 - RNA, 23 nt, Artificial Sequence
  RNA Oligomer
gaacagcccauuccugguguucu

SEQ ID NO: 68599 - RNA, 23 nt, Artificial Sequence
  RNA Oligomer
accauuucuccaggcugagacac

SEQ ID NO: 68600 - RNA, 23 nt, Artificial Sequence
  RNA Oligomer
aaauggccgguauccuguauacu

SEQ ID NO: 68601 - RNA, 23 nt, Artificial Sequence
  RNA Oligomer
ggaagcagagguuucacuuugcc

SEQ ID NO: 68602 - RNA, 23 nt, Artificial Sequence
  RNA Oligomer
uuccacauucuuggucaugccag

SEQ ID NO: 68603 - RNA, 23 nt, Artificial Sequence
  RNA Oligomer
augaggccauucccaucaaaguc

SEQ ID NO: 68604 - RNA, 23 nt, Artificial Sequence
  RNA Oligomer
agaaaaggugccugaaaaagguc

SEQ ID NO: 68605 - RNA, 23 nt, Artificial Sequence
  RNA Oligomer
gcuggcauuucucauguagacgc

SEQ ID NO: 68606 - RNA, 23 nt, Artificial Sequence
  RNA Oligomer
uuuccacauucuuggucaugcca

SEQ ID NO: 68607 - RNA, 23 nt, Artificial Sequence
  RNA Oligomer
uuugacacagagcugcgugaagc

SEQ ID NO: 68608 - RNA, 23 nt, Artificial Sequence
  RNA Oligomer
ucagcauccugaugaacucaucc

SEQ ID NO: 68609 - RNA, 23 nt, Artificial Sequence
  RNA Oligomer
cagcauccugaugaacucauccu

SEQ ID NO: 68610 - RNA, 23 nt, Artificial Sequence
  RNA Oligomer
augaagaccaccaggauguccag

SEQ ID NO: 68611 - RNA, 23 nt, Artificial Sequence
  RNA Oligomer
aaaaggugccugaaaaaggucuc

SEQ ID NO: 68612 - RNA, 23 nt, Artificial Sequence
  RNA Oligomer
aacacuuggcagcugacggauga

SEQ ID NO: 68613 - RNA, 23 nt, Artificial Sequence
  RNA Oligomer
aaaaaggucuccaggaggugccu

SEQ ID NO: 68614 - RNA, 23 nt, Artificial Sequence
  RNA Oligomer
caaucuccuucuuggagaacagc

SEQ ID NO: 68615 - RNA, 23 nt, Artificial Sequence
  RNA Oligomer
acacagcgauguucugguaggug

SEQ ID NO: 68616 - RNA, 23 nt, Artificial Sequence
  RNA Oligomer
cuugucaggucagcuugucuucu

SEQ ID NO: 68617 - RNA, 23 nt, Artificial Sequence
  RNA Oligomer
ucacucuagucccuagacacugc

SEQ ID NO: 68618 - RNA, 23 nt, Artificial Sequence
  RNA Oligomer
uagccauugccauccuugucagc

SEQ ID NO: 68619 - RNA, 23 nt, Artificial Sequence
  RNA Oligomer
uucaaucuccuucuuggagaaca

SEQ ID NO: 68620 - RNA, 23 nt, Artificial Sequence
  RNA Oligomer
gguucagaaccuucuggaagugc

SEQ ID NO: 68621 - RNA, 23 nt, Artificial Sequence
  RNA Oligomer
agaccaggucuuugaggauggag

SEQ ID NO: 68622 - RNA, 23 nt, Artificial Sequence
  RNA Oligomer
uaucuggcacaucugucacccgu

SEQ ID NO: 68623 - RNA, 23 nt, Artificial Sequence
  RNA Oligomer
ugaugagcaggacauagagcagg

SEQ ID NO: 68624 - RNA, 23 nt, Artificial Sequence
  RNA Oligomer
auguccaggaacucucggaagga

SEQ ID NO: 68625 - RNA, 23 nt, Artificial Sequence
  RNA Oligomer
acagguagccauugccauccuug

SEQ ID NO: 68626 - RNA, 23 nt, Artificial Sequence
  RNA Oligomer
uugucaggucagcuugucuucug

SEQ ID NO: 68627 - RNA, 23 nt, Artificial Sequence
  RNA Oligomer
ucacccagaugaaguagaucuuc

SEQ ID NO: 68628 - RNA, 23 nt, Artificial Sequence
  RNA Oligomer
cagguagccauugccauccuugu

SEQ ID NO: 68629 - RNA, 23 nt, Artificial Sequence
  RNA Oligomer
uucuccaggcugagacacauccu

SEQ ID NO: 68630 - RNA, 23 nt, Artificial Sequence
  RNA Oligomer
cacccagaugaaguagaucuucu

SEQ ID NO: 68631 - RNA, 23 nt, Artificial Sequence
  RNA Oligomer
aagaccaggucuuugaggaugga

SEQ ID NO: 68632 - RNA, 23 nt, Artificial Sequence
  RNA Oligomer
uugcugggaccaggaagaagaug

SEQ ID NO: 68633 - RNA, 23 nt, Artificial Sequence
  RNA Oligomer
uggagaucucgaugaaggaucuc

SEQ ID NO: 68634 - RNA, 23 nt, Artificial Sequence
  RNA Oligomer
uacuugucaggucagcuugucuu

SEQ ID NO: 68635 - RNA, 23 nt, Artificial Sequence
  RNA Oligomer
augagcaggacauagagcaggau

SEQ ID NO: 68636 - RNA, 23 nt, Artificial Sequence
  RNA Oligomer
uggaagcagagguuucacuuugc

SEQ ID NO: 68637 - RNA, 23 nt, Artificial Sequence
  RNA Oligomer
gaagaccaggucuuugaggaugg

SEQ ID NO: 68638 - RNA, 23 nt, Artificial Sequence
  RNA Oligomer
gaaguggcagcuggcauuucuca

SEQ ID NO: 68639 - RNA, 23 nt, Artificial Sequence
  RNA Oligomer
gacaggccuuuuccacauucuug

SEQ ID NO: 68640 - RNA, 23 nt, Artificial Sequence
  RNA Oligomer
auucuccuccaccucucggauga

SEQ ID NO: 68641 - RNA, 23 nt, Artificial Sequence
  RNA Oligomer
ccaggaagaagauguggaaacgg

SEQ ID NO: 68642 - RNA, 23 nt, Artificial Sequence
  RNA Oligomer
gucaggucagcuugucuucugag

SEQ ID NO: 68643 - RNA, 23 nt, Artificial Sequence
  RNA Oligomer
ugggaccaggaagaagaugugga

SEQ ID NO: 68644 - RNA, 23 nt, Artificial Sequence
  RNA Oligomer
ugcagucucugaggugucaacuc

SEQ ID NO: 68645 - RNA, 23 nt, Artificial Sequence
  RNA Oligomer
aggccuuuuccacauucuugguc

SEQ ID NO: 68646 - RNA, 23 nt, Artificial Sequence
  RNA Oligomer
acaggccuuuuccacauucuugg

SEQ ID NO: 68647 - RNA, 19 nt, Artificial Sequence
  RNA Oligomer
ccaacuacuaauagaauaa

SEQ ID NO: 68648 - RNA, 19 nt, Artificial Sequence
  RNA Oligomer
uuauucuauuaguaguugg

SEQ ID NO: 68649 - RNA, 19 nt, Artificial Sequence
  RNA Oligomer
ccuuuuucauuuaucuaua

SEQ ID NO: 68650 - RNA, 19 nt, Artificial Sequence
  RNA Oligomer
uauagauaaaugaaaaagg

SEQ ID NO: 68651 - RNA, 19 nt, Artificial Sequence
  RNA Oligomer
caacuacuaauagaauaaa

SEQ ID NO: 68652 - RNA, 19 nt, Artificial Sequence
  RNA Oligomer
uuuauucuauuaguaguug

SEQ ID NO: 68653 - RNA, 19 nt, Artificial Sequence
  RNA Oligomer
guguauugguuuuuuaaaa

SEQ ID NO: 68654 - RNA, 19 nt, Artificial Sequence
  RNA Oligomer
uuuuaaaaaaccaauacac

SEQ ID NO: 68655 - RNA, 19 nt, Artificial Sequence
  Oligomer
ccaucauacccauccaagu

SEQ ID NO: 68656 - RNA, 19 nt, Artificial Sequence
  Oligomer
gguugucagugaacaauaa

SEQ ID NO: 68657 - RNA, 19 nt, Artificial Sequence
  Oligomer
gaauuaaaccaagacaaag

SEQ ID NO: 68658 - RNA, 19 nt, Artificial Sequence
  Oligomer
ggauccaaguuuaaaaaga

SEQ ID NO: 68659 - RNA, 19 nt, Artificial Sequence
  Oligomer
ggacauuuagcgugaugaa

SEQ ID NO: 68660 - RNA, 19 nt, Artificial Sequence
  Oligomer
ccaugggaacuaaaccaaa

SEQ ID NO: 68661 - RNA, 19 nt, Artificial Sequence
  Oligomer
cagggaagacgaagaugaa

SEQ ID NO: 68662 - RNA, 19 nt, Artificial Sequence
  Oligomer
cauugugaguggaccaaga

SEQ ID NO: 68663 - RNA, 19 nt, Artificial Sequence
  Oligomer
acuuccacccuucagaaaa

SEQ ID NO: 68664 - RNA, 19 nt, Artificial Sequence
  Oligomer
caugggaacuaaaccaaaa

SEQ ID NO: 68665 - RNA, 19 nt, Artificial Sequence
  Oligomer
acuuguggaggaaauugaa

SEQ ID NO: 68666 - RNA, 19 nt, Artificial Sequence
  Oligomer
caacgauuuggaagucaga

SEQ ID NO: 68667 - RNA, 19 nt, Artificial Sequence
  Oligomer
gagacuaagcaaugggaaa

SEQ ID NO: 68668 - RNA, 19 nt, Artificial Sequence
  Oligomer
uuacuuccacccuucagaa

SEQ ID NO: 68669 - RNA, 19 nt, Artificial Sequence
  Oligomer
cgagcgucgaagagacaaa

SEQ ID NO: 68670 - RNA, 19 nt, Artificial Sequence
  Oligomer
ccuggugaauaucgaagaa

SEQ ID NO: 68671 - RNA, 19 nt, Artificial Sequence
  Oligomer
gcuugaaagcgaugaagaa

SEQ ID NO: 68672 - RNA, 19 nt, Artificial Sequence
  Oligomer
ugaugagcugcccaugaaa

SEQ ID NO: 68673 - RNA, 19 nt, Artificial Sequence
  Oligomer
ccuacaaaaccaaaacaga

SEQ ID NO: 68674 - RNA, 19 nt, Artificial Sequence
  Oligomer
gguacaguuugguguaaau

SEQ ID NO: 68675 - RNA, 19 nt, Artificial Sequence
  Oligomer
ggaucaaguugaugaugga

SEQ ID NO: 68676 - RNA, 19 nt, Artificial Sequence
  Oligomer
acccaagaauuaaaccaag

SEQ ID NO: 68677 - RNA, 19 nt, Artificial Sequence
  Oligomer
agaucauagcugacuuuaa

SEQ ID NO: 68678 - RNA, 19 nt, Artificial Sequence
  Oligomer
aaaggacaaacuugcguaa

SEQ ID NO: 68679 - RNA, 19 nt, Artificial Sequence
  Oligomer
caaacuaaaggcucuaaaa

SEQ ID NO: 68680 - RNA, 19 nt, Artificial Sequence
  Oligomer
ggcagcuagagaugcucaa

SEQ ID NO: 68681 - RNA, 19 nt, Artificial Sequence
  Oligomer
guauauugucagugaagaa

SEQ ID NO: 68682 - RNA, 19 nt, Artificial Sequence
  Oligomer
ccguguagcacucagauaa

SEQ ID NO: 68683 - RNA, 19 nt, Artificial Sequence
  Oligomer
ccagaauaacccagaagaa

SEQ ID NO: 68684 - RNA, 19 nt, Artificial Sequence
  Oligomer
ugcucagguugcaaauaaa

SEQ ID NO: 68685 - RNA, 19 nt, Artificial Sequence
  Oligomer
ccaagaucucaggauccaa

SEQ ID NO: 68686 - RNA, 19 nt, Artificial Sequence
  Oligomer
cauugugcugccucaugua

SEQ ID NO: 68687 - RNA, 19 nt, Artificial Sequence
  Oligomer
uacuuccacccuucagaaa

SEQ ID NO: 68688 - RNA, 19 nt, Artificial Sequence
  Oligomer
guuccuggugaauaucgaa

SEQ ID NO: 68689 - RNA, 19 nt, Artificial Sequence
  Oligomer
caauguagcuugaaagcga

SEQ ID NO: 68690 - RNA, 19 nt, Artificial Sequence
  Oligomer
ucauacccauccaagucag

SEQ ID NO: 68691 - RNA, 19 nt, Artificial Sequence
  Oligomer
cuuccacccuucagaaaac

SEQ ID NO: 68692 - RNA, 19 nt, Artificial Sequence
  Oligomer
gcugcuaucucccagcaua

SEQ ID NO: 68693 - RNA, 19 nt, Artificial Sequence
  Oligomer
ggaugcucagguugcaaau

SEQ ID NO: 68694 - RNA, 19 nt, Artificial Sequence
  Oligomer
aaaggagaacgguguuaau

SEQ ID NO: 68695 - RNA, 19 nt, Artificial Sequence
  Oligomer
gaguuuuuguagcaucuua

SEQ ID NO: 68696 - RNA, 19 nt, Artificial Sequence
  Oligomer
gaaugucucuagaagagaa

SEQ ID NO: 68697 - RNA, 19 nt, Artificial Sequence
  Oligomer
gggacuguacccaagaauu

SEQ ID NO: 68698 - RNA, 19 nt, Artificial Sequence
  Oligomer
gagacugcaugacaaucau

SEQ ID NO: 68699 - RNA, 19 nt, Artificial Sequence
  Oligomer
ugcgcuuugggauuaugaa

SEQ ID NO: 68700 - RNA, 19 nt, Artificial Sequence
  Oligomer
cuuacuuccacccuucaga

SEQ ID NO: 68701 - RNA, 19 nt, Artificial Sequence
  Oligomer
cguccuggcugugucaaaa

SEQ ID NO: 68702 - RNA, 19 nt, Artificial Sequence
  Oligomer
guuuguaggcugaauuuua

SEQ ID NO: 68703 - RNA, 19 nt, Artificial Sequence
  Oligomer
gggcgcgccuuaaugauaa

SEQ ID NO: 68704 - RNA, 19 nt, Artificial Sequence
  Oligomer
ggucucucugguuccugaa

SEQ ID NO: 68705 - RNA, 19 nt, Artificial Sequence
  Oligomer
gccacucagcccaacuaaa

SEQ ID NO: 68706 - RNA, 19 nt, Artificial Sequence
  Oligomer
ccagguucuaagcaagaaa

SEQ ID NO: 68707 - RNA, 19 nt, Artificial Sequence
  Oligomer
gcugcaguaggucccuaua

SEQ ID NO: 68708 - RNA, 19 nt, Artificial Sequence
  Oligomer
agagcagaaugccaagcua

SEQ ID NO: 68709 - RNA, 19 nt, Artificial Sequence
  Oligomer
aaggccacguggaacagaa

SEQ ID NO: 68710 - RNA, 19 nt, Artificial Sequence
  Oligomer
agaucagcgacaacagcaa

SEQ ID NO: 68711 - RNA, 19 nt, Artificial Sequence
  Oligomer
caugcagacugcugcagau

SEQ ID NO: 68712 - RNA, 19 nt, Artificial Sequence
  Oligomer
acuuaaaggccacguggaa

SEQ ID NO: 68713 - RNA, 19 nt, Artificial Sequence
  Oligomer
aaaagugagagcacuuaaa

SEQ ID NO: 68714 - RNA, 19 nt, Artificial Sequence
  Oligomer
ggcaguccagaaccugaaa

SEQ ID NO: 68715 - RNA, 19 nt, Artificial Sequence
  Oligomer
agaagaaggcagcucuaca

SEQ ID NO: 68716 - RNA, 19 nt, Artificial Sequence
  Oligomer
aggagcugcagcuaagaaa

SEQ ID NO: 68717 - RNA, 19 nt, Artificial Sequence
  Oligomer
gguucggguccaagaugau

SEQ ID NO: 68718 - RNA, 19 nt, Artificial Sequence
  Oligomer
cgauguuucuuaccgugua

SEQ ID NO: 68719 - RNA, 19 nt, Artificial Sequence
  Oligomer
cauccacagggaagacgaa

SEQ ID NO: 68720 - RNA, 19 nt, Artificial Sequence
  Oligomer
ggacauugugaguggacca

SEQ ID NO: 68721 - RNA, 19 nt, Artificial Sequence
  Oligomer
gcaucacggcucuucacaa

SEQ ID NO: 68722 - RNA, 19 nt, Artificial Sequence
  Oligomer
cucucugccuccugguaaa

SEQ ID NO: 68723 - RNA, 19 nt, Artificial Sequence
  Oligomer
gugacugccagcucagaaa

SEQ ID NO: 68724 - RNA, 19 nt, Artificial Sequence
  Oligomer
gggaugcucagguugcaaa

SEQ ID NO: 68725 - RNA, 19 nt, Artificial Sequence
  Oligomer
gcucuacagcaaaaagaaa

SEQ ID NO: 68726 - RNA, 19 nt, Artificial Sequence
  Oligomer
aggcagcucuacagcaaaa

SEQ ID NO: 68727 - RNA, 19 nt, Artificial Sequence
  Oligomer
aacagaagagacuaagcaa

SEQ ID NO: 68728 - RNA, 19 nt, Artificial Sequence
  Oligomer
gcuacagacuuacccguaa

SEQ ID NO: 68729 - RNA, 19 nt, Artificial Sequence
  Oligomer
gaaggauugaagaauucac

SEQ ID NO: 68730 - RNA, 19 nt, Artificial Sequence
  Oligomer
cuguguuugccaugaccua

SEQ ID NO: 68731 - RNA, 19 nt, Artificial Sequence
  Oligomer
cuucuuccuucgucaugaa

SEQ ID NO: 68732 - RNA, 19 nt, Artificial Sequence
  Oligomer
ccuccugguaaaaggacaa

SEQ ID NO: 68733 - RNA, 19 nt, Artificial Sequence
  Oligomer
aguucucagcaguugucaa

SEQ ID NO: 68734 - RNA, 19 nt, Artificial Sequence
  Oligomer
aaaaguuccuggugaauau

SEQ ID NO: 68735 - RNA, 19 nt, Artificial Sequence
  Oligomer
cagaagaaccaaauccaga

SEQ ID NO: 68736 - RNA, 19 nt, Artificial Sequence
  Oligomer
gauuuggaagucagaggaa

SEQ ID NO: 68737 - RNA, 19 nt, Artificial Sequence
  Oligomer
aaggcagcucuacagcaaa

SEQ ID NO: 68738 - RNA, 19 nt, Artificial Sequence
  Oligomer
caacagagggaguguuuga

SEQ ID NO: 68739 - RNA, 19 nt, Artificial Sequence
  Oligomer
caggauccaaguuuaaaaa

SEQ ID NO: 68740 - RNA, 19 nt, Artificial Sequence
  Oligomer
cuuuggagggagaauuuga

SEQ ID NO: 68741 - RNA, 19 nt, Artificial Sequence
  Oligomer
guucuucaacgauuuggaa

SEQ ID NO: 68742 - RNA, 19 nt, Artificial Sequence
  Oligomer
gguccuaaugggccaaaua

SEQ ID NO: 68743 - RNA, 19 nt, Artificial Sequence
  Oligomer
aauccuuaccgaaaccaga

SEQ ID NO: 68744 - RNA, 19 nt, Artificial Sequence
  Oligomer
ccuguuccuacaaaaccaa

SEQ ID NO: 68745 - RNA, 19 nt, Artificial Sequence
  Oligomer
caaugagcagcacuucaca

SEQ ID NO: 68746 - RNA, 19 nt, Artificial Sequence
  Oligomer
aguuccuggugaauaucga

SEQ ID NO: 68747 - RNA, 19 nt, Artificial Sequence
  Oligomer
guagcuugaaagcgaugaa

SEQ ID NO: 68748 - RNA, 19 nt, Artificial Sequence
  Oligomer
aauugaaucaagagcagaa

SEQ ID NO: 68749 - RNA, 19 nt, Artificial Sequence
  Oligomer
ccaugacaaucagucugca

SEQ ID NO: 68750 - RNA, 19 nt, Artificial Sequence
  Oligomer
gaggaaauugaacagauga

SEQ ID NO: 68751 - RNA, 19 nt, Artificial Sequence
  Oligomer
caaguugcugagcaggaga

SEQ ID NO: 68752 - RNA, 19 nt, Artificial Sequence
  Oligomer
gauugaagcccagcaacaa

SEQ ID NO: 68753 - RNA, 19 nt, Artificial Sequence
  Oligomer
ccugaaacuuccacacaga

SEQ ID NO: 68754 - RNA, 19 nt, Artificial Sequence
  Oligomer
agagaacagugacaugcca

SEQ ID NO: 68755 - RNA, 19 nt, Artificial Sequence
  Oligomer
cauacccauccaagucagc

SEQ ID NO: 68756 - RNA, 19 nt, Artificial Sequence
  Oligomer
ccauguauacgcaacagca

SEQ ID NO: 68757 - RNA, 19 nt, Artificial Sequence
  Oligomer
ucugcuucuguaccucaaa

SEQ ID NO: 68758 - RNA, 19 nt, Artificial Sequence
  Oligomer
agaucuuuucccaagccaa

SEQ ID NO: 68759 - RNA, 19 nt, Artificial Sequence
  Oligomer
agcucuacagcaaaaagaa

SEQ ID NO: 68760 - RNA, 19 nt, Artificial Sequence
  Oligomer
cugagaaucaggaagcuaa

SEQ ID NO: 68761 - RNA, 19 nt, Artificial Sequence
  Oligomer
cagggacauugugagugga

SEQ ID NO: 68762 - RNA, 19 nt, Artificial Sequence
  Oligomer
gagcguaucgcucauggaa

SEQ ID NO: 68763 - RNA, 19 nt, Artificial Sequence
  Oligomer
gacaaacuugcguaaaacu

SEQ ID NO: 68764 - RNA, 19 nt, Artificial Sequence
  Oligomer
ggaagucagaggaacgaag

SEQ ID NO: 68765 - RNA, 19 nt, Artificial Sequence
  Oligomer
guuugauguucuucaacga

SEQ ID NO: 68766 - RNA, 19 nt, Artificial Sequence
  Oligomer
cagaagcuuuuauaucaga

SEQ ID NO: 68767 - RNA, 19 nt, Artificial Sequence
  Oligomer
ggaaguucucagcaguugu

SEQ ID NO: 68768 - RNA, 19 nt, Artificial Sequence
  Oligomer
guccguucucaauguuuga

SEQ ID NO: 68769 - RNA, 19 nt, Artificial Sequence
  Oligomer
cagaaguggcagucaugga

SEQ ID NO: 68770 - RNA, 19 nt, Artificial Sequence
  Oligomer
ugaacuucaggaaauggca

SEQ ID NO: 68771 - RNA, 19 nt, Artificial Sequence
  Oligomer
guugguugucagugaacaa

SEQ ID NO: 68772 - RNA, 19 nt, Artificial Sequence
  Oligomer
aagaauccugucuaguaaa

SEQ ID NO: 68773 - RNA, 19 nt, Artificial Sequence
  Oligomer
agaugaugccgauguuucu

SEQ ID NO: 68774 - RNA, 19 nt, Artificial Sequence
  Oligomer
accguggcagcaaguucaa

SEQ ID NO: 68775 - RNA, 19 nt, Artificial Sequence
  Oligomer
gcagaaugccaagcuacaa

SEQ ID NO: 68776 - RNA, 19 nt, Artificial Sequence
  Oligomer
aguugcugagcaggagaaa

SEQ ID NO: 68777 - RNA, 19 nt, Artificial Sequence
  Oligomer
caccauuagaggacauuua

SEQ ID NO: 68778 - RNA, 19 nt, Artificial Sequence
  Oligomer
ugaaggauugaagaauuca

SEQ ID NO: 68779 - RNA, 19 nt, Artificial Sequence
  Oligomer
uggcaaaaauuucacaaga

SEQ ID NO: 68780 - RNA, 19 nt, Artificial Sequence
  Oligomer
gacgaagaugaaaucgaau

SEQ ID NO: 68781 - RNA, 19 nt, Artificial Sequence
  Oligomer
agggaagacgaagaugaaa

SEQ ID NO: 68782 - RNA, 19 nt, Artificial Sequence
  Oligomer
gccuccugguaaaaggaca

SEQ ID NO: 68783 - RNA, 19 nt, Artificial Sequence
  Oligomer
aucauacccauccaaguca

SEQ ID NO: 68784 - RNA, 19 nt, Artificial Sequence
  Oligomer
aguucaggagaaccaugaa

SEQ ID NO: 68785 - RNA, 19 nt, Artificial Sequence
  Oligomer
cgacagccaccaugacaau

SEQ ID NO: 68786 - RNA, 19 nt, Artificial Sequence
  Oligomer
agcuagagaugcucaagaa

SEQ ID NO: 68787 - RNA, 19 nt, Artificial Sequence
  Oligomer
gggaaacuuguggaggaaa

SEQ ID NO: 68788 - RNA, 19 nt, Artificial Sequence
  Oligomer
aaaaagugagagcacuuaa

SEQ ID NO: 68789 - RNA, 19 nt, Artificial Sequence
  Oligomer
aucaggaagcuaagcuaaa

SEQ ID NO: 68790 - RNA, 19 nt, Artificial Sequence
  Oligomer
cugggacuguacccaagaa

SEQ ID NO: 68791 - RNA, 19 nt, Artificial Sequence
  Oligomer
gagggauauguuccacgua

SEQ ID NO: 68792 - RNA, 19 nt, Artificial Sequence
  Oligomer
gcuucuuccuucgucauga

SEQ ID NO: 68793 - RNA, 19 nt, Artificial Sequence
  Oligomer
ugauuaugagccugaggga

SEQ ID NO: 68794 - RNA, 19 nt, Artificial Sequence
  Oligomer
uagaaauccagaauccaua

SEQ ID NO: 68795 - RNA, 19 nt, Artificial Sequence
  Oligomer
accuagaagccuuacgaaa

SEQ ID NO: 68796 - RNA, 19 nt, Artificial Sequence
  Oligomer
gaccuagaagccuuacgaa

SEQ ID NO: 68797 - RNA, 19 nt, Artificial Sequence
  Oligomer
accuuacuuccacccuuca

SEQ ID NO: 68798 - RNA, 19 nt, Artificial Sequence
  Oligomer
cuguuccuacaaaaccaaa

SEQ ID NO: 68799 - RNA, 19 nt, Artificial Sequence
  Oligomer
ccugauuggaguccuucaa

SEQ ID NO: 68800 - RNA, 19 nt, Artificial Sequence
  Oligomer
cccuauauccagucgucua

SEQ ID NO: 68801 - RNA, 19 nt, Artificial Sequence
  Oligomer
gagcuugaucgccucuaua

SEQ ID NO: 68802 - RNA, 19 nt, Artificial Sequence
  Oligomer
ugagaaucaggaagcuaag

SEQ ID NO: 68803 - RNA, 19 nt, Artificial Sequence
  Oligomer
cagcaacaauugcuggcaa

SEQ ID NO: 68804 - RNA, 19 nt, Artificial Sequence
  Oligomer
agauugaagcccagcaaca

SEQ ID NO: 68805 - RNA, 19 nt, Artificial Sequence
  Oligomer
uaagcuacgguaccaguaa

SEQ ID NO: 68806 - RNA, 19 nt, Artificial Sequence
  Oligomer
gcgccuuaaugauaaggag

SEQ ID NO: 68807 - RNA, 19 nt, Artificial Sequence
  Oligomer
uacccauccaagucagcuu

SEQ ID NO: 68808 - RNA, 19 nt, Artificial Sequence
  Oligomer
gaaucaacagcagcaccca

SEQ ID NO: 68809 - RNA, 19 nt, Artificial Sequence
  Oligomer
ugaccaagacucauaccag

SEQ ID NO: 68810 - RNA, 19 nt, Artificial Sequence
  Oligomer
aaagugcguccguucucaa

SEQ ID NO: 68811 - RNA, 19 nt, Artificial Sequence
  Oligomer
ggucauucaggcuucagag

SEQ ID NO: 68812 - RNA, 19 nt, Artificial Sequence
  Oligomer
ccaguuucaucugauggaa

SEQ ID NO: 68813 - RNA, 19 nt, Artificial Sequence
  Oligomer
uggcugugucaaaaguaga

SEQ ID NO: 68814 - RNA, 19 nt, Artificial Sequence
  Oligomer
cgaugaagaaugucucuag

SEQ ID NO: 68815 - RNA, 19 nt, Artificial Sequence
  Oligomer
gcaaaaauuucacaagacu

SEQ ID NO: 68816 - RNA, 19 nt, Artificial Sequence
  Oligomer
agggauauguuccacguaa

SEQ ID NO: 68817 - RNA, 19 nt, Artificial Sequence
  Oligomer
ggagggauauguuccacgu

SEQ ID NO: 68818 - RNA, 19 nt, Artificial Sequence
  Oligomer
agaaggagacugcaugaca

SEQ ID NO: 68819 - RNA, 19 nt, Artificial Sequence
  Oligomer
ggauggacuccauuacauu

SEQ ID NO: 68820 - RNA, 19 nt, Artificial Sequence
  Oligomer
cagagggccacacuuuuca

SEQ ID NO: 68821 - RNA, 19 nt, Artificial Sequence
  Oligomer
agaccagacccuuucucca

SEQ ID NO: 68822 - RNA, 19 nt, Artificial Sequence
  Oligomer
cauaccuucgguuggccaa

SEQ ID NO: 68823 - RNA, 19 nt, Artificial Sequence
  Oligomer
cugggaaugcucuggauca

SEQ ID NO: 68824 - RNA, 19 nt, Artificial Sequence
  Oligomer
aaugcagaucuuuucccaa

SEQ ID NO: 68825 - RNA, 19 nt, Artificial Sequence
  Oligomer
ggcagucauggauaagcgu

SEQ ID NO: 68826 - RNA, 19 nt, Artificial Sequence
  Oligomer
gccucuauaaggagcugca

SEQ ID NO: 68827 - RNA, 19 nt, Artificial Sequence
  Oligomer
aaucaggaagcuaagcuaa

SEQ ID NO: 68828 - RNA, 19 nt, Artificial Sequence
  Oligomer
aacaauugcuggcaacuaa

SEQ ID NO: 68829 - RNA, 19 nt, Artificial Sequence
  Oligomer
ugguugucagugaacaaua

SEQ ID NO: 68830 - RNA, 19 nt, Artificial Sequence
  Oligomer
ggcaguugggaaaucagcu

SEQ ID NO: 68831 - RNA, 19 nt, Artificial Sequence
  Oligomer
aaagaaggagacugcauga

SEQ ID NO: 68832 - RNA, 19 nt, Artificial Sequence
  Oligomer
ugagcugcccaugaaagaa

SEQ ID NO: 68833 - RNA, 19 nt, Artificial Sequence
  Oligomer
cauuuaugcgcuuugggau

SEQ ID NO: 68834 - RNA, 19 nt, Artificial Sequence
  Oligomer
ccauggagaccaucucugu

SEQ ID NO: 68835 - RNA, 19 nt, Artificial Sequence
  Oligomer
acgcaccaaggccucuaaa

SEQ ID NO: 68836 - RNA, 19 nt, Artificial Sequence
  Oligomer
ugcugaccuagaagccuua

SEQ ID NO: 68837 - RNA, 19 nt, Artificial Sequence
  Oligomer
uuaucuaauccuuaccgaa

SEQ ID NO: 68838 - RNA, 19 nt, Artificial Sequence
  Oligomer
accuccuguuccuacaaaa

SEQ ID NO: 68839 - RNA, 19 nt, Artificial Sequence
  Oligomer
cccugauuggaguccuuca

SEQ ID NO: 68840 - RNA, 19 nt, Artificial Sequence
  Oligomer
acaaacuaaaggcucuaaa

SEQ ID NO: 68841 - RNA, 19 nt, Artificial Sequence
  Oligomer
acuuguauauugucaguga

SEQ ID NO: 68842 - RNA, 19 nt, Artificial Sequence
  Oligomer
ucuagaagagaaugaagga

SEQ ID NO: 68843 - RNA, 19 nt, Artificial Sequence
  Oligomer
ugauggauggacuccauua

SEQ ID NO: 68844 - RNA, 19 nt, Artificial Sequence
  Oligomer
gagaagacucggugagcau

SEQ ID NO: 68845 - RNA, 19 nt, Artificial Sequence
  Oligomer
acaacagcccaaaucucca

SEQ ID NO: 68846 - RNA, 19 nt, Artificial Sequence
  Oligomer
ccuuccuuugguacucuga

SEQ ID NO: 68847 - RNA, 19 nt, Artificial Sequence
  Oligomer
gaaugccaagcuacaacaa

SEQ ID NO: 68848 - RNA, 19 nt, Artificial Sequence
  Oligomer
ucgacagccaccaugacaa

SEQ ID NO: 68849 - RNA, 19 nt, Artificial Sequence
  Oligomer
ugaagaauucaccauuaga

SEQ ID NO: 68850 - RNA, 19 nt, Artificial Sequence
  Oligomer
aucucaggauccaaguuua

SEQ ID NO: 68851 - RNA, 19 nt, Artificial Sequence
  Oligomer
gggauuaugaaccucagaa

SEQ ID NO: 68852 - RNA, 19 nt, Artificial Sequence
  Oligomer
uggaagucagaggaacgaa

SEQ ID NO: 68853 - RNA, 19 nt, Artificial Sequence
  Oligomer
uggucucucugguuccuga

SEQ ID NO: 68854 - RNA, 19 nt, Artificial Sequence
  Oligomer
ggguccuaaugggccaaau

SEQ ID NO: 68855 - RNA, 19 nt, Artificial Sequence
  Oligomer
agagugaugcugaccuaga

SEQ ID NO: 68856 - RNA, 19 nt, Artificial Sequence
  Oligomer
cagacacugcccaacauga

SEQ ID NO: 68857 - RNA, 19 nt, Artificial Sequence
  Oligomer
aaauacagacacugcccaa

SEQ ID NO: 68858 - RNA, 19 nt, Artificial Sequence
  Oligomer
cagcucuacagcaaaaaga

SEQ ID NO: 68859 - RNA, 19 nt, Artificial Sequence
  Oligomer
gcacuucacagaaguucca

SEQ ID NO: 68860 - RNA, 19 nt, Artificial Sequence
  Oligomer
cagccaccaugacaaucag

SEQ ID NO: 68861 - RNA, 19 nt, Artificial Sequence
  Oligomer
ggcuaaaagaaauagcuga

SEQ ID NO: 68862 - RNA, 19 nt, Artificial Sequence
  Oligomer
ggugaauaucgaagaaagg

SEQ ID NO: 68863 - RNA, 19 nt, Artificial Sequence
  Oligomer
cugaaacuuccacacagaa

SEQ ID NO: 68864 - RNA, 19 nt, Artificial Sequence
  Oligomer
gaugaugagcugcccauga

SEQ ID NO: 68865 - RNA, 19 nt, Artificial Sequence
  Oligomer
cuacacucagugcucccaa

SEQ ID NO: 68866 - RNA, 19 nt, Artificial Sequence
  Oligomer
agaaauccagaauccauau

SEQ ID NO: 68867 - RNA, 19 nt, Artificial Sequence
  Oligomer
ugauguucuucaacgauuu

SEQ ID NO: 68868 - RNA, 19 nt, Artificial Sequence
  Oligomer
aguugcggauaaugagcga

SEQ ID NO: 68869 - RNA, 19 nt, Artificial Sequence
  Oligomer
caggcgccaggaaaaaacu

SEQ ID NO: 68870 - RNA, 19 nt, Artificial Sequence
  Oligomer
agcagaaugccaagcuaca

SEQ ID NO: 68871 - RNA, 19 nt, Artificial Sequence
  Oligomer
ggagcugcagcuaagaaac

SEQ ID NO: 68872 - RNA, 19 nt, Artificial Sequence
  Oligomer
cagugcucccaauuucuuu

SEQ ID NO: 68873 - RNA, 19 nt, Artificial Sequence
  Oligomer
aaaugcugcugauagugau

SEQ ID NO: 68874 - RNA, 19 nt, Artificial Sequence
  Oligomer
auuugaccuuguacagaga

SEQ ID NO: 68875 - RNA, 19 nt, Artificial Sequence
  Oligomer
cucagagcguaucgcucau

SEQ ID NO: 68876 - RNA, 19 nt, Artificial Sequence
  Oligomer
aaggacaaacuugcguaaa

SEQ ID NO: 68877 - RNA, 19 nt, Artificial Sequence
  Oligomer
ucuccagaauaacccagaa

SEQ ID NO: 68878 - RNA, 19 nt, Artificial Sequence
  Oligomer
uuacauguggagcccgaaa

SEQ ID NO: 68879 - RNA, 19 nt, Artificial Sequence
  Oligomer
auaucagaggaccaccaua

SEQ ID NO: 68880 - RNA, 19 nt, Artificial Sequence
  Oligomer
uggcaguccagaaccugaa

SEQ ID NO: 68881 - RNA, 19 nt, Artificial Sequence
  Oligomer
cagccaccuucagacauua

SEQ ID NO: 68882 - RNA, 19 nt, Artificial Sequence
  Oligomer
cuuggucauucaggcuuca

SEQ ID NO: 68883 - RNA, 19 nt, Artificial Sequence
  Oligomer
ugaccaggcagcuagagau

SEQ ID NO: 68884 - RNA, 19 nt, Artificial Sequence
  Oligomer
gcaaugggaaacuugugga

SEQ ID NO: 68885 - RNA, 19 nt, Artificial Sequence
  Oligomer
uacgguaccaguaauuaga

SEQ ID NO: 68886 - RNA, 19 nt, Artificial Sequence
  Oligomer
aauguagcuugaaagcgau

SEQ ID NO: 68887 - RNA, 19 nt, Artificial Sequence
  Oligomer
gacaaucauccacagggaa

SEQ ID NO: 68888 - RNA, 19 nt, Artificial Sequence
  Oligomer
cuuuauggaguucaggaga

SEQ ID NO: 68889 - RNA, 19 nt, Artificial Sequence
  Oligomer
ccugguacaguuuggugua

SEQ ID NO: 68890 - RNA, 19 nt, Artificial Sequence
  Oligomer
caaacuugcguaaaacugg

SEQ ID NO: 68891 - RNA, 19 nt, Artificial Sequence
  Oligomer
aguacagagaacagugaca

SEQ ID NO: 68892 - RNA, 19 nt, Artificial Sequence
  Oligomer
gcccaguagaaauccagaa

SEQ ID NO: 68893 - RNA, 19 nt, Artificial Sequence
  Oligomer
gcucagaaagcccaguaga

SEQ ID NO: 68894 - RNA, 19 nt, Artificial Sequence
  Oligomer
cauccaagucagcuucugu

SEQ ID NO: 68895 - RNA, 19 nt, Artificial Sequence
  Oligomer
caucauacccauccaaguc

SEQ ID NO: 68896 - RNA, 19 nt, Artificial Sequence
  Oligomer
caguccagaaccugaaaca

SEQ ID NO: 68897 - RNA, 19 nt, Artificial Sequence
  Oligomer
ccuuacuuccacccuucag

SEQ ID NO: 68898 - RNA, 19 nt, Artificial Sequence
  Oligomer
cauuaagccagacggaagu

SEQ ID NO: 68899 - RNA, 19 nt, Artificial Sequence
  Oligomer
aacuaaucagccaccuuca

SEQ ID NO: 68900 - RNA, 19 nt, Artificial Sequence
  Oligomer
caauaugcagagacguggu

SEQ ID NO: 68901 - RNA, 19 nt, Artificial Sequence
  Oligomer
cuaaaggcucuaaaaucca

SEQ ID NO: 68902 - RNA, 19 nt, Artificial Sequence
  Oligomer
guuacuccagaaacaauau

SEQ ID NO: 68903 - RNA, 19 nt, Artificial Sequence
  Oligomer
caguaggucccuauaucca

SEQ ID NO: 68904 - RNA, 19 nt, Artificial Sequence
  Oligomer
accggcuguggaagaagaa

SEQ ID NO: 68905 - RNA, 19 nt, Artificial Sequence
  Oligomer
aguuccaguuacuccagaa

SEQ ID NO: 68906 - RNA, 19 nt, Artificial Sequence
  Oligomer
cagucauggauaagcgugu

SEQ ID NO: 68907 - RNA, 19 nt, Artificial Sequence
  Oligomer
aacugaccaggcagcuaga

SEQ ID NO: 68908 - RNA, 19 nt, Artificial Sequence
  Oligomer
augggaaacuuguggagga

SEQ ID NO: 68909 - RNA, 19 nt, Artificial Sequence
  Oligomer
aauagcugagaaucaggaa

SEQ ID NO: 68910 - RNA, 19 nt, Artificial Sequence
  Oligomer
cagcgacaacagcaacaag

SEQ ID NO: 68911 - RNA, 19 nt, Artificial Sequence
  Oligomer
cuugcugaacuucaggaaa

SEQ ID NO: 68912 - RNA, 19 nt, Artificial Sequence
  Oligomer
cagacuuacccguaauauu

SEQ ID NO: 68913 - RNA, 19 nt, Artificial Sequence
  Oligomer
auuagaaacuugcuacaga

SEQ ID NO: 68914 - RNA, 19 nt, Artificial Sequence
  Oligomer
aaggcacugcacacuugua

SEQ ID NO: 68915 - RNA, 19 nt, Artificial Sequence
  Oligomer
gaaggcacugcacacuugu

SEQ ID NO: 68916 - RNA, 19 nt, Artificial Sequence
  Oligomer
gaagagaaugaaggauuga

SEQ ID NO: 68917 - RNA, 19 nt, Artificial Sequence
  Oligomer
uaaugauaaggagggauau

SEQ ID NO: 68918 - RNA, 19 nt, Artificial Sequence
  Oligomer
augaugagcugcccaugaa

SEQ ID NO: 68919 - RNA, 19 nt, Artificial Sequence
  Oligomer
auaagugcgaggaaaugga

SEQ ID NO: 68920 - RNA, 19 nt, Artificial Sequence
  Oligomer
ugugcugccucauguaaca

SEQ ID NO: 68921 - RNA, 19 nt, Artificial Sequence
  Oligomer
agugauggauggacuccau

SEQ ID NO: 68922 - RNA, 19 nt, Artificial Sequence
  Oligomer
ugguacaguuugguguaaa

SEQ ID NO: 68923 - RNA, 19 nt, Artificial Sequence
  Oligomer
ugugcaggccacacagaaa

SEQ ID NO: 68924 - RNA, 19 nt, Artificial Sequence
  Oligomer
auucgucuuuggagggaga

SEQ ID NO: 68925 - RNA, 19 nt, Artificial Sequence
  Oligomer
cccagacaacagcccaaau

SEQ ID NO: 68926 - RNA, 19 nt, Artificial Sequence
  Oligomer
ugugacugccagcucagaa

SEQ ID NO: 68927 - RNA, 19 nt, Artificial Sequence
  Oligomer
cuaaugggccaaauauuca

SEQ ID NO: 68928 - RNA, 19 nt, Artificial Sequence
  Oligomer
uacugccuuucuuaucuaa

SEQ ID NO: 68929 - RNA, 19 nt, Artificial Sequence
  Oligomer
uccguccaugggaacuaaa

SEQ ID NO: 68930 - RNA, 19 nt, Artificial Sequence
  Oligomer
guuguuccguccaugggaa

SEQ ID NO: 68931 - RNA, 19 nt, Artificial Sequence
  Oligomer
ccaccuccuguuccuacaa

SEQ ID NO: 68932 - RNA, 19 nt, Artificial Sequence
  Oligomer
gcugagggagaaagagaag

SEQ ID NO: 68933 - RNA, 19 nt, Artificial Sequence
  Oligomer
gacacugcccaacaugaga

SEQ ID NO: 68934 - RNA, 19 nt, Artificial Sequence
  Oligomer
ucaagaacggcaggaucga

SEQ ID NO: 68935 - RNA, 19 nt, Artificial Sequence
  Oligomer
gauggaucugacucuugcu

SEQ ID NO: 68936 - RNA, 19 nt, Artificial Sequence
  Oligomer
gucacaucgcugucucuga

SEQ ID NO: 68937 - RNA, 19 nt, Artificial Sequence
  Oligomer
ugacaaucauccacaggga

SEQ ID NO: 68938 - RNA, 19 nt, Artificial Sequence
  Oligomer
gcaugacaaucauccacag

SEQ ID NO: 68939 - RNA, 19 nt, Artificial Sequence
  Oligomer
ugcccaugaaagaaggaga

SEQ ID NO: 68940 - RNA, 19 nt, Artificial Sequence
  Oligomer
gaaauggaggaaggcuaca

SEQ ID NO: 68941 - RNA, 19 nt, Artificial Sequence
  Oligomer
ugcagauaagugcgaggaa

SEQ ID NO: 68942 - RNA, 19 nt, Artificial Sequence
  Oligomer
gcuugauguguaccuggag

SEQ ID NO: 68943 - RNA, 19 nt, Artificial Sequence
  Oligomer
aaaucuccagaauaaccca

SEQ ID NO: 68944 - RNA, 19 nt, Artificial Sequence
  Oligomer
cuuuuauaucagaggacca

SEQ ID NO: 68945 - RNA, 19 nt, Artificial Sequence
  Oligomer
cgaaagaauuccucggcca

SEQ ID NO: 68946 - RNA, 19 nt, Artificial Sequence
  Oligomer
auuccaauagccagggcaa

SEQ ID NO: 68947 - RNA, 19 nt, Artificial Sequence
  Oligomer
aauugcugcugcccagaau

SEQ ID NO: 68948 - RNA, 19 nt, Artificial Sequence
  Oligomer
caggaaaaaacuuccagca

SEQ ID NO: 68949 - RNA, 19 nt, Artificial Sequence
  Oligomer
cuccagguucuaagcaaga

SEQ ID NO: 68950 - RNA, 19 nt, Artificial Sequence
  Oligomer
aacagagggaguguuugaa

SEQ ID NO: 68951 - RNA, 19 nt, Artificial Sequence
  Oligomer
ugagcuugaucgccucuau

SEQ ID NO: 68952 - RNA, 19 nt, Artificial Sequence
  Oligomer
aagagacuaagcaauggga

SEQ ID NO: 68953 - RNA, 19 nt, Artificial Sequence
  Oligomer
ugcuggcaacuaaggaaca

SEQ ID NO: 68954 - RNA, 19 nt, Artificial Sequence
  Oligomer
uguauauugucagugaaga

SEQ ID NO: 68955 - RNA, 19 nt, Artificial Sequence
  Oligomer
aaaggugucccguguagca

SEQ ID NO: 68956 - RNA, 19 nt, Artificial Sequence
  Oligomer
ccuuaaugauaaggaggga

SEQ ID NO: 68957 - RNA, 19 nt, Artificial Sequence
  Oligomer
ucauuuaugcgcuuuggga

SEQ ID NO: 68958 - RNA, 19 nt, Artificial Sequence
  Oligomer
gaauuugaccuuguacaga

SEQ ID NO: 68959 - RNA, 19 nt, Artificial Sequence
  Oligomer
aaaaggacaaacuugcgua

SEQ ID NO: 68960 - RNA, 19 nt, Artificial Sequence
  Oligomer
acauguggagcccgaaaag

SEQ ID NO: 68961 - RNA, 19 nt, Artificial Sequence
  Oligomer
gccuguuucuucaguucag

SEQ ID NO: 68962 - RNA, 19 nt, Artificial Sequence
  Oligomer
gccacacuuuucaagugua

SEQ ID NO: 68963 - RNA, 19 nt, Artificial Sequence
  Oligomer
gcaagaaaguccaccugcu

SEQ ID NO: 68964 - RNA, 19 nt, Artificial Sequence
  Oligomer
aagugcguccguucucaau

SEQ ID NO: 68965 - RNA, 19 nt, Artificial Sequence
  Oligomer
aaaugcagaucuuuuccca

SEQ ID NO: 68966 - RNA, 19 nt, Artificial Sequence
  Oligomer
acuccagaaacaauaugca

SEQ ID NO: 68967 - RNA, 19 nt, Artificial Sequence
  Oligomer
aagaaauagcugagaauca

SEQ ID NO: 68968 - RNA, 19 nt, Artificial Sequence
  Oligomer
ugucagugaagaacuguua

SEQ ID NO: 68969 - RNA, 19 nt, Artificial Sequence
  Oligomer
gacaauccuguuuucuaca

SEQ ID NO: 68970 - RNA, 19 nt, Artificial Sequence
  Oligomer
cccguguagcacucagaua

SEQ ID NO: 68971 - RNA, 19 nt, Artificial Sequence
  Oligomer
gucucuagaagagaaugaa

SEQ ID NO: 68972 - RNA, 19 nt, Artificial Sequence
  Oligomer
ucucaggauccaaguuuaa

SEQ ID NO: 68973 - RNA, 19 nt, Artificial Sequence
  Oligomer
ugggacuguacccaagaau

SEQ ID NO: 68974 - RNA, 19 nt, Artificial Sequence
  Oligomer
ugggcgcgccuuaaugaua

SEQ ID NO: 68975 - RNA, 19 nt, Artificial Sequence
  Oligomer
cauguaacaacguccaagu

SEQ ID NO: 68976 - RNA, 19 nt, Artificial Sequence
  Oligomer
gaagucagaggaacgaagu

SEQ ID NO: 68977 - RNA, 19 nt, Artificial Sequence
  Oligomer
auguguaccuggaggagua

SEQ ID NO: 68978 - RNA, 19 nt, Artificial Sequence
  Oligomer
gaauaacccagaagaacca

SEQ ID NO: 68979 - RNA, 19 nt, Artificial Sequence
  Oligomer
cucugguuccugaaucauu

SEQ ID NO: 68980 - RNA, 19 nt, Artificial Sequence
  Oligomer
uuuacauguggagcccgaa

SEQ ID NO: 68981 - RNA, 19 nt, Artificial Sequence
  Oligomer
agcccaguagaaauccaga

SEQ ID NO: 68982 - RNA, 19 nt, Artificial Sequence
  Oligomer
agagccagaggguccuaau

SEQ ID NO: 68983 - RNA, 19 nt, Artificial Sequence
  Oligomer
ccacacuuuucaaguguau

SEQ ID NO: 68984 - RNA, 19 nt, Artificial Sequence
  Oligomer
ccauuuggcugaagugugg

SEQ ID NO: 68985 - RNA, 19 nt, Artificial Sequence
  Oligomer
gacauuaagccagacggaa

SEQ ID NO: 68986 - RNA, 19 nt, Artificial Sequence
  Oligomer
aaauguggcuaaaguacca

SEQ ID NO: 68987 - RNA, 19 nt, Artificial Sequence
  Oligomer
gaaagagaagaaagugcgu

SEQ ID NO: 68988 - RNA, 19 nt, Artificial Sequence
  Oligomer
gcucugcuucuguaccuca

SEQ ID NO: 68989 - RNA, 19 nt, Artificial Sequence
  Oligomer
aguuggcccugauuggagu

SEQ ID NO: 68990 - RNA, 19 nt, Artificial Sequence
  Oligomer
gcucuaaaauccauccagu

SEQ ID NO: 68991 - RNA, 19 nt, Artificial Sequence
  Oligomer
cacuuaaaggccacgugga

SEQ ID NO: 68992 - RNA, 19 nt, Artificial Sequence
  Oligomer
cagaaauuagaaacuugcu

SEQ ID NO: 68993 - RNA, 19 nt, Artificial Sequence
  Oligomer
cuacgguaccaguaauuag

SEQ ID NO: 68994 - RNA, 19 nt, Artificial Sequence
  Oligomer
ugggcaguugggaaaucag

SEQ ID NO: 68995 - RNA, 19 nt, Artificial Sequence
  Oligomer
gaugaaaucgaaugguggu

SEQ ID NO: 68996 - RNA, 19 nt, Artificial Sequence
  Oligomer
caaucauccacagggaaga

SEQ ID NO: 68997 - RNA, 19 nt, Artificial Sequence
  Oligomer
cagacugcugcagauaagu

SEQ ID NO: 68998 - RNA, 19 nt, Artificial Sequence
  Oligomer
ugcugcugauagugaugga

SEQ ID NO: 68999 - RNA, 19 nt, Artificial Sequence
  Oligomer
auggaaugagggugaaauu

SEQ ID NO: 69000 - RNA, 19 nt, Artificial Sequence
  Oligomer
aaaacuggcucagagcgua

SEQ ID NO: 69001 - RNA, 19 nt, Artificial Sequence
  Oligomer
aaauccagaggcuccacau

SEQ ID NO: 69002 - RNA, 19 nt, Artificial Sequence
  Oligomer
uccagaauccauauuuaca

SEQ ID NO: 69003 - RNA, 19 nt, Artificial Sequence
  Oligomer
guccuaaugggccaaauau

SEQ ID NO: 69004 - RNA, 19 nt, Artificial Sequence
  Oligomer
aggccucuaaagaaacgua

SEQ ID NO: 69005 - RNA, 19 nt, Artificial Sequence
  Oligomer
aaagaaacugucuaacgca

SEQ ID NO: 69006 - RNA, 19 nt, Artificial Sequence
  Oligomer
cuuaucuaauccuuaccga

SEQ ID NO: 69007 - RNA, 19 nt, Artificial Sequence
  Oligomer
gaacguccaguugcggaua

SEQ ID NO: 69008 - RNA, 19 nt, Artificial Sequence
  Oligomer
uuccguccaugggaacuaa

SEQ ID NO: 69009 - RNA, 19 nt, Artificial Sequence
  Oligomer
agacauuaagccagacgga

SEQ ID NO: 69010 - RNA, 19 nt, Artificial Sequence
  Oligomer
cuucagacauuaagccaga

SEQ ID NO: 69011 - RNA, 19 nt, Artificial Sequence
  Oligomer
caaacuaaucagccaccuu

SEQ ID NO: 69012 - RNA, 19 nt, Artificial Sequence
  Oligomer
gagagugauugccauuugg

SEQ ID NO: 69013 - RNA, 19 nt, Artificial Sequence
  Oligomer
accaccuccuguuccuaca

SEQ ID NO: 69014 - RNA, 19 nt, Artificial Sequence
  Oligomer
ugcaguagaccaguccaau

SEQ ID NO: 69015 - RNA, 19 nt, Artificial Sequence
  Oligomer
cuucaaaugcagaucuuuu

SEQ ID NO: 69016 - RNA, 19 nt, Artificial Sequence
  Oligomer
agcugcagcuaagaaacaa

SEQ ID NO: 69017 - RNA, 19 nt, Artificial Sequence
  Oligomer
uaaggagcugcagcuaaga

SEQ ID NO: 69018 - RNA, 19 nt, Artificial Sequence
  Oligomer
agcuugaucgccucuauaa

SEQ ID NO: 69019 - RNA, 19 nt, Artificial Sequence
  Oligomer
aacuuguggaggaaauuga

SEQ ID NO: 69020 - RNA, 19 nt, Artificial Sequence
  Oligomer
caacaagaucagcgacaac

SEQ ID NO: 69021 - RNA, 19 nt, Artificial Sequence
  Oligomer
aauaucgaagaaaggagaa

SEQ ID NO: 69022 - RNA, 19 nt, Artificial Sequence
  Oligomer
uucagcagcugcuccuaaa

SEQ ID NO: 69023 - RNA, 19 nt, Artificial Sequence
  Oligomer
uuauugggcaguugggaaa

SEQ ID NO: 69024 - RNA, 19 nt, Artificial Sequence
  Oligomer
auaaguauacagcgacaau

SEQ ID NO: 69025 - RNA, 19 nt, Artificial Sequence
  Oligomer
uagaggacauuuagcguga

SEQ ID NO: 69026 - RNA, 19 nt, Artificial Sequence
  Oligomer
gcuuggccugaaacuucca

SEQ ID NO: 69027 - RNA, 19 nt, Artificial Sequence
  Oligomer
gggauauguuccacguaac

SEQ ID NO: 69028 - RNA, 19 nt, Artificial Sequence
  Oligomer
agugcgaggaaauggagga

SEQ ID NO: 69029 - RNA, 19 nt, Artificial Sequence
  Oligomer
gcagacugcugcagauaag

SEQ ID NO: 69030 - RNA, 19 nt, Artificial Sequence
  Oligomer
ugcagacugcugcagauaa

SEQ ID NO: 69031 - RNA, 19 nt, Artificial Sequence
  Oligomer
cccuugcuuuacugcuaga

SEQ ID NO: 69032 - RNA, 19 nt, Artificial Sequence
  Oligomer
agagcguaucgcucaugga

SEQ ID NO: 69033 - RNA, 19 nt, Artificial Sequence
  Oligomer
ccagaagaaccaaauccag

SEQ ID NO: 69034 - RNA, 19 nt, Artificial Sequence
  Oligomer
guucuauuacagagccaga

SEQ ID NO: 69035 - RNA, 19 nt, Artificial Sequence
  Oligomer
guucaggagaaccaugaaa

SEQ ID NO: 69036 - RNA, 19 nt, Artificial Sequence
  Oligomer
acauuuauuccaauagcca

SEQ ID NO: 69037 - RNA, 19 nt, Artificial Sequence
  Oligomer
aacagcagcacccagagaa

SEQ ID NO: 69038 - RNA, 19 nt, Artificial Sequence
  Oligomer
uguauaugguaagccugua

SEQ ID NO: 69039 - RNA, 19 nt, Artificial Sequence
  Oligomer
cagacggaaguucucagca

SEQ ID NO: 69040 - RNA, 19 nt, Artificial Sequence
  Oligomer
uguuccuacaaaaccaaaa

SEQ ID NO: 69041 - RNA, 19 nt, Artificial Sequence
  Oligomer
gugaagauaucuugcggga

SEQ ID NO: 69042 - RNA, 19 nt, Artificial Sequence
  Oligomer
cguccguucucaauguuug

SEQ ID NO: 69043 - RNA, 19 nt, Artificial Sequence
  Oligomer
gcaaaaagaaaaucuacca

SEQ ID NO: 69044 - RNA, 19 nt, Artificial Sequence
  Oligomer
gcagcucuacagcaaaaag

SEQ ID NO: 69045 - RNA, 19 nt, Artificial Sequence
  Oligomer
guuccaguuacuccagaaa

SEQ ID NO: 69046 - RNA, 19 nt, Artificial Sequence
  Oligomer
aaggagcugcagcuaagaa

SEQ ID NO: 69047 - RNA, 19 nt, Artificial Sequence
  Oligomer
gcuugaucgccucuauaag

SEQ ID NO: 69048 - RNA, 19 nt, Artificial Sequence
  Oligomer
gcaacaaguugcugagcag

SEQ ID NO: 69049 - RNA, 19 nt, Artificial Sequence
  Oligomer
acaagaucagcgacaacag

SEQ ID NO: 69050 - RNA, 19 nt, Artificial Sequence
  Oligomer
acuaaggaacagcgcuuaa

SEQ ID NO: 69051 - RNA, 19 nt, Artificial Sequence
  Oligomer
gacucuugcugaacuucag

SEQ ID NO: 69052 - RNA, 19 nt, Artificial Sequence
  Oligomer
aggagaacgguguuaauag

SEQ ID NO: 69053 - RNA, 19 nt, Artificial Sequence
  Oligomer
aaucuuguuuguaggcuga

SEQ ID NO: 69054 - RNA, 19 nt, Artificial Sequence
  Oligomer
cuguuaguugguugucagu

SEQ ID NO: 69055 - RNA, 19 nt, Artificial Sequence
  Oligomer
uccuggugaauaucgaaga

SEQ ID NO: 69056 - RNA, 19 nt, Artificial Sequence
  Oligomer
aaauaaagcaucuacguca

SEQ ID NO: 69057 - RNA, 19 nt, Artificial Sequence
  Oligomer
cuugaaagcgaugaagaau

SEQ ID NO: 69058 - RNA, 19 nt, Artificial Sequence
  Oligomer
cucaggauccaaguuuaaa

SEQ ID NO: 69059 - RNA, 19 nt, Artificial Sequence
  Oligomer
gaaagaaggagacugcaug

SEQ ID NO: 69060 - RNA, 19 nt, Artificial Sequence
  Oligomer
ugaaagaaggagacugcau

SEQ ID NO: 69061 - RNA, 19 nt, Artificial Sequence
  Oligomer
acaugcagacugcugcaga

SEQ ID NO: 69062 - RNA, 19 nt, Artificial Sequence
  Oligomer
auuacauugugcugccuca

SEQ ID NO: 69063 - RNA, 19 nt, Artificial Sequence
  Oligomer
gcuagauucgucuuuggag

SEQ ID NO: 69064 - RNA, 19 nt, Artificial Sequence
  Oligomer
guagaaauccagaauccau

SEQ ID NO: 69065 - RNA, 19 nt, Artificial Sequence
  Oligomer
cauuuauuccaauagccag

SEQ ID NO: 69066 - RNA, 19 nt, Artificial Sequence
  Oligomer
agcagcacccagagaacau

SEQ ID NO: 69067 - RNA, 19 nt, Artificial Sequence
  Oligomer
ugcugcugcccagaaucaa

SEQ ID NO: 69068 - RNA, 19 nt, Artificial Sequence
  Oligomer
cuguaauugcugcugccca

SEQ ID NO: 69069 - RNA, 19 nt, Artificial Sequence
  Oligomer
agcaggcgccaggaaaaaa

SEQ ID NO: 69070 - RNA, 19 nt, Artificial Sequence
  Oligomer
cuaaucagccaccuucaga

SEQ ID NO: 69071 - RNA, 19 nt, Artificial Sequence
  Oligomer
auaucuugcgggaugcuca

SEQ ID NO: 69072 - RNA, 19 nt, Artificial Sequence
  Oligomer
gaggaagaaccagagcagu

SEQ ID NO: 69073 - RNA, 19 nt, Artificial Sequence
  Oligomer
uaugcagagacguggugga

SEQ ID NO: 69074 - RNA, 19 nt, Artificial Sequence
  Oligomer
gcuucuguaccucaaagca

SEQ ID NO: 69075 - RNA, 19 nt, Artificial Sequence
  Oligomer
cacaaacuaaaggcucuaa

SEQ ID NO: 69076 - RNA, 19 nt, Artificial Sequence
  Oligomer
uccaguuacuccagaaaca

SEQ ID NO: 69077 - RNA, 19 nt, Artificial Sequence
  Oligomer
ugaauaagcguaauucaga

SEQ ID NO: 69078 - RNA, 19 nt, Artificial Sequence
  Oligomer
agaaguuccaguuacucca

SEQ ID NO: 69079 - RNA, 19 nt, Artificial Sequence
  Oligomer
uauaaggagcugcagcuaa

SEQ ID NO: 69080 - RNA, 19 nt, Artificial Sequence
  Oligomer
gaaacuuguggaggaaauu

SEQ ID NO: 69081 - RNA, 19 nt, Artificial Sequence
  Oligomer
ggaacagaagagacuaagc

SEQ ID NO: 69082 - RNA, 19 nt, Artificial Sequence
  Oligomer
ugcugagcaggagaaacuu

SEQ ID NO: 69083 - RNA, 19 nt, Artificial Sequence
  Oligomer
ggcaaaaauuucacaagac

SEQ ID NO: 69084 - RNA, 19 nt, Artificial Sequence
  Oligomer
ggauauguuccacguaacu

SEQ ID NO: 69085 - RNA, 19 nt, Artificial Sequence
  Oligomer
gcgcuuugggauuaugaac

SEQ ID NO: 69086 - RNA, 19 nt, Artificial Sequence
  Oligomer
gccaugaccuacagugaca

SEQ ID NO: 69087 - RNA, 19 nt, Artificial Sequence
  Oligomer
aaggcaucacggcucuuca

SEQ ID NO: 69088 - RNA, 19 nt, Artificial Sequence
  Oligomer
uuaugagguugaugaccca

SEQ ID NO: 69089 - RNA, 19 nt, Artificial Sequence
  Oligomer
auacccauccaagucagcu

SEQ ID NO: 69090 - RNA, 19 nt, Artificial Sequence
  Oligomer
aacguaguucuauuacaga

SEQ ID NO: 69091 - RNA, 19 nt, Artificial Sequence
  Oligomer
ccuagaagccuuacgaaag

SEQ ID NO: 69092 - RNA, 19 nt, Artificial Sequence
  Oligomer
guaccaccuccuguuccua

SEQ ID NO: 69093 - RNA, 19 nt, Artificial Sequence
  Oligomer
agaaccagagcagugaaga

SEQ ID NO: 69094 - RNA, 19 nt, Artificial Sequence
  Oligomer
uuugguacucugaggaaga

SEQ ID NO: 69095 - RNA, 19 nt, Artificial Sequence
  Oligomer
gaugcaguagaccagucca

SEQ ID NO: 69096 - RNA, 19 nt, Artificial Sequence
  Oligomer
augguuccuuggucauuca

SEQ ID NO: 69097 - RNA, 19 nt, Artificial Sequence
  Oligomer
gcuguggaagaagaaggca

SEQ ID NO: 69098 - RNA, 19 nt, Artificial Sequence
  Oligomer
cuacaacaacagagggagu

SEQ ID NO: 69099 - RNA, 19 nt, Artificial Sequence
  Oligomer
caaucagucugcaguggcu

SEQ ID NO: 69100 - RNA, 19 nt, Artificial Sequence
  Oligomer
cagcuagagaugcucaaga

SEQ ID NO: 69101 - RNA, 19 nt, Artificial Sequence
  Oligomer
aacaaugagcagcacuuca

SEQ ID NO: 69102 - RNA, 19 nt, Artificial Sequence
  Oligomer
aaguugcugagcaggagaa

SEQ ID NO: 69103 - RNA, 19 nt, Artificial Sequence
  Oligomer
aaggaacagcgcuuaaagu

SEQ ID NO: 69104 - RNA, 19 nt, Artificial Sequence
  Oligomer
uaaggaacagcgcuuaaag

SEQ ID NO: 69105 - RNA, 19 nt, Artificial Sequence
  Oligomer
uugucaagaucauagcuga

SEQ ID NO: 69106 - RNA, 19 nt, Artificial Sequence
  Oligomer
uugucuuuuguaucucaga

SEQ ID NO: 69107 - RNA, 19 nt, Artificial Sequence
  Oligomer
guuuuuguagcaucuuaag

SEQ ID NO: 69108 - RNA, 19 nt, Artificial Sequence
  Oligomer
gugaauaucgaagaaagga

SEQ ID NO: 69109 - RNA, 19 nt, Artificial Sequence
  Oligomer
uuuauugggcaguugggaa

SEQ ID NO: 69110 - RNA, 19 nt, Artificial Sequence
  Oligomer
cguguagcacucagauaag

SEQ ID NO: 69111 - RNA, 19 nt, Artificial Sequence
  Oligomer
augaagaaugucucuagaa

SEQ ID NO: 69112 - RNA, 19 nt, Artificial Sequence
  Oligomer
ugggauuaugaaccucaga

SEQ ID NO: 69113 - RNA, 19 nt, Artificial Sequence
  Oligomer
uauggaguucaggagaaga

SEQ ID NO: 69114 - RNA, 19 nt, Artificial Sequence
  Oligomer
aaucguuaaguuccuggua

SEQ ID NO: 69115 - RNA, 19 nt, Artificial Sequence
  Oligomer
cacaugugcuugaugugua

SEQ ID NO: 69116 - RNA, 19 nt, Artificial Sequence
  Oligomer
aaagcccaguagaaaucca

SEQ ID NO: 69117 - RNA, 19 nt, Artificial Sequence
  Oligomer
uagaagccuuacgaaagaa

SEQ ID NO: 69118 - RNA, 19 nt, Artificial Sequence
  Oligomer
aggagaaccaugaaaacga

SEQ ID NO: 69119 - RNA, 19 nt, Artificial Sequence
  Oligomer
uaauugcugcugcccagaa

SEQ ID NO: 69120 - RNA, 19 nt, Artificial Sequence
  Oligomer
acguccaguugcggauaau

SEQ ID NO: 69121 - RNA, 19 nt, Artificial Sequence
  Oligomer
caaagacaccuuacuucca

SEQ ID NO: 69122 - RNA, 19 nt, Artificial Sequence
  Oligomer
gacccuuucuccagguucu

SEQ ID NO: 69123 - RNA, 19 nt, Artificial Sequence
  Oligomer
caagaugaugccgauguuu

SEQ ID NO: 69124 - RNA, 19 nt, Artificial Sequence
  Oligomer
aguuguuccguccauggga

SEQ ID NO: 69125 - RNA, 19 nt, Artificial Sequence
  Oligomer
agcaguugucaacaguugu

SEQ ID NO: 69126 - RNA, 19 nt, Artificial Sequence
  Oligomer
ugauugccauuuggcugaa

SEQ ID NO: 69127 - RNA, 19 nt, Artificial Sequence
  Oligomer
gcugcuucacaaacuaaag

SEQ ID NO: 69128 - RNA, 19 nt, Artificial Sequence
  Oligomer
auucagaaguggcagucau

SEQ ID NO: 69129 - RNA, 19 nt, Artificial Sequence
  Oligomer
augccaagcuacaacaaca

SEQ ID NO: 69130 - RNA, 19 nt, Artificial Sequence
  Oligomer
ucaagagcagaaugccaag

SEQ ID NO: 69131 - RNA, 19 nt, Artificial Sequence
  Oligomer
uagaagaacugaccaggca

SEQ ID NO: 69132 - RNA, 19 nt, Artificial Sequence
  Oligomer
aaaguagaagaacugacca

SEQ ID NO: 69133 - RNA, 19 nt, Artificial Sequence
  Oligomer
cagauugaagcccagcaac

SEQ ID NO: 69134 - RNA, 19 nt, Artificial Sequence
  Oligomer
cagcagcaacagauugaag

SEQ ID NO: 69135 - RNA, 19 nt, Artificial Sequence
  Oligomer
gaaucuuguuuguaggcug

SEQ ID NO: 69136 - RNA, 19 nt, Artificial Sequence
  Oligomer
caucgcugucucugauugu

SEQ ID NO: 69137 - RNA, 19 nt, Artificial Sequence
  Oligomer
guagcacucagauaaguau

SEQ ID NO: 69138 - RNA, 19 nt, Artificial Sequence
  Oligomer
uuagcgugaugaaauaaag

SEQ ID NO: 69139 - RNA, 19 nt, Artificial Sequence
  Oligomer
aggacauuuagcgugauga

SEQ ID NO: 69140 - RNA, 19 nt, Artificial Sequence
  Oligomer
uguacccaagaauuaaacc

SEQ ID NO: 69141 - RNA, 19 nt, Artificial Sequence
  Oligomer
uuuauggaguucaggagaa

SEQ ID NO: 69142 - RNA, 19 nt, Artificial Sequence
  Oligomer
uuaaguuccugguacaguu

SEQ ID NO: 69143 - RNA, 19 nt, Artificial Sequence
  Oligomer
aagcuuuuauaucagagga

SEQ ID NO: 69144 - RNA, 19 nt, Artificial Sequence
  Oligomer
gaagccuuacgaaagaaac

SEQ ID NO: 69145 - RNA, 19 nt, Artificial Sequence
  Oligomer
cacucagcccaacuaaauu

SEQ ID NO: 69146 - RNA, 19 nt, Artificial Sequence
  Oligomer
caguucaggagaaccauga

SEQ ID NO: 69147 - RNA, 19 nt, Artificial Sequence
  Oligomer
guaauugcugcugcccaga

SEQ ID NO: 69148 - RNA, 19 nt, Artificial Sequence
  Oligomer
cccuuucuccagguucuaa

SEQ ID NO: 69149 - RNA, 19 nt, Artificial Sequence
  Oligomer
ccguccaugggaacuaaac

SEQ ID NO: 69150 - RNA, 19 nt, Artificial Sequence
  Oligomer
caacaguuguuccguccau

SEQ ID NO: 69151 - RNA, 19 nt, Artificial Sequence
  Oligomer
uggacaaacuaaucagcca

SEQ ID NO: 69152 - RNA, 19 nt, Artificial Sequence
  Oligomer
caccuccuguuccuacaaa

SEQ ID NO: 69153 - RNA, 19 nt, Artificial Sequence
  Oligomer
gaugcucagguugcaaaua

SEQ ID NO: 69154 - RNA, 19 nt, Artificial Sequence
  Oligomer
acgagcgucgaagagacaa

SEQ ID NO: 69155 - RNA, 19 nt, Artificial Sequence
  Oligomer
ccaucauacccauccaagu

SEQ ID NO: 69156 - RNA, 19 nt, Artificial Sequence
  Oligomer
uuauuguucacugacaacc

SEQ ID NO: 69157 - RNA, 19 nt, Artificial Sequence
  Oligomer
cuuugucuugguuuaauuc

SEQ ID NO: 69158 - RNA, 19 nt, Artificial Sequence
  Oligomer
ucuuuuuaaacuuggaucc

SEQ ID NO: 69159 - RNA, 19 nt, Artificial Sequence
  Oligomer
uucaucacgcuaaaugucc

SEQ ID NO: 69160 - RNA, 19 nt, Artificial Sequence
  Oligomer
uuugguuuaguucccaugg

SEQ ID NO: 69161 - RNA, 19 nt, Artificial Sequence
  Oligomer
uucaucuucgucuucccug

SEQ ID NO: 69162 - RNA, 19 nt, Artificial Sequence
  Oligomer
ucuugguccacucacaaug

SEQ ID NO: 69163 - RNA, 19 nt, Artificial Sequence
  Oligomer
uuuucugaaggguggaagu

SEQ ID NO: 69164 - RNA, 19 nt, Artificial Sequence
  Oligomer
uuuugguuuaguucccaug

SEQ ID NO: 69165 - RNA, 19 nt, Artificial Sequence
  Oligomer
uucaauuuccuccacaagu

SEQ ID NO: 69166 - RNA, 19 nt, Artificial Sequence
  Oligomer
ucugacuuccaaaucguug

SEQ ID NO: 69167 - RNA, 19 nt, Artificial Sequence
  Oligomer
uuucccauugcuuagucuc

SEQ ID NO: 69168 - RNA, 19 nt, Artificial Sequence
  Oligomer
uucugaaggguggaaguaa

SEQ ID NO: 69169 - RNA, 19 nt, Artificial Sequence
  Oligomer
uuugucucuucgacgcucg

SEQ ID NO: 69170 - RNA, 19 nt, Artificial Sequence
  Oligomer
uucuucgauauucaccagg

SEQ ID NO: 69171 - RNA, 19 nt, Artificial Sequence
  Oligomer
uucuucaucgcuuucaagc

SEQ ID NO: 69172 - RNA, 19 nt, Artificial Sequence
  Oligomer
uuucaugggcagcucauca

SEQ ID NO: 69173 - RNA, 19 nt, Artificial Sequence
  Oligomer
ucuguuuugguuuuguagg

SEQ ID NO: 69174 - RNA, 19 nt, Artificial Sequence
  Oligomer
auuuacaccaaacuguacc

SEQ ID NO: 69175 - RNA, 19 nt, Artificial Sequence
  Oligomer
uccaucaucaacuugaucc

SEQ ID NO: 69176 - RNA, 19 nt, Artificial Sequence
  Oligomer
cuugguuuaauucuugggu

SEQ ID NO: 69177 - RNA, 19 nt, Artificial Sequence
  Oligomer
uuaaagucagcuaugaucu

SEQ ID NO: 69178 - RNA, 19 nt, Artificial Sequence
  Oligomer
uuacgcaaguuuguccuuu

SEQ ID NO: 69179 - RNA, 19 nt, Artificial Sequence
  Oligomer
uuuuagagccuuuaguuug

SEQ ID NO: 69180 - RNA, 19 nt, Artificial Sequence
  Oligomer
uugagcaucucuagcugcc

SEQ ID NO: 69181 - RNA, 19 nt, Artificial Sequence
  Oligomer
uucuucacugacaauauac

SEQ ID NO: 69182 - RNA, 19 nt, Artificial Sequence
  Oligomer
uuaucugagugcuacacgg

SEQ ID NO: 69183 - RNA, 19 nt, Artificial Sequence
  Oligomer
uucuucuggguuauucugg

SEQ ID NO: 69184 - RNA, 19 nt, Artificial Sequence
  Oligomer
uuuauuugcaaccugagca

SEQ ID NO: 69185 - RNA, 19 nt, Artificial Sequence
  Oligomer
uuggauccugagaucuugg

SEQ ID NO: 69186 - RNA, 19 nt, Artificial Sequence
  Oligomer
uacaugaggcagcacaaug

SEQ ID NO: 69187 - RNA, 19 nt, Artificial Sequence
  Oligomer
uuucugaaggguggaagua

SEQ ID NO: 69188 - RNA, 19 nt, Artificial Sequence
  Oligomer
uucgauauucaccaggaac

SEQ ID NO: 69189 - RNA, 19 nt, Artificial Sequence
  Oligomer
ucgcuuucaagcuacauug

SEQ ID NO: 69190 - RNA, 19 nt, Artificial Sequence
  Oligomer
cugacuuggauggguauga

SEQ ID NO: 69191 - RNA, 19 nt, Artificial Sequence
  Oligomer
guuuucugaaggguggaag

SEQ ID NO: 69192 - RNA, 19 nt, Artificial Sequence
  Oligomer
uaugcugggagauagcagc

SEQ ID NO: 69193 - RNA, 19 nt, Artificial Sequence
  Oligomer
auuugcaaccugagcaucc

SEQ ID NO: 69194 - RNA, 19 nt, Artificial Sequence
  Oligomer
auuaacaccguucuccuuu

SEQ ID NO: 69195 - RNA, 19 nt, Artificial Sequence
  Oligomer
uaagaugcuacaaaaacuc

SEQ ID NO: 69196 - RNA, 19 nt, Artificial Sequence
  Oligomer
uucucuucuagagacauuc

SEQ ID NO: 69197 - RNA, 19 nt, Artificial Sequence
  Oligomer
aauucuuggguacaguccc

SEQ ID NO: 69198 - RNA, 19 nt, Artificial Sequence
  Oligomer
augauugucaugcagucuc

SEQ ID NO: 69199 - RNA, 19 nt, Artificial Sequence
  Oligomer
uucauaaucccaaagcgca

SEQ ID NO: 69200 - RNA, 19 nt, Artificial Sequence
  Oligomer
ucugaaggguggaaguaag

SEQ ID NO: 69201 - RNA, 19 nt, Artificial Sequence
  Oligomer
uuuugacacagccaggacg

SEQ ID NO: 69202 - RNA, 19 nt, Artificial Sequence
  Oligomer
uaaaauucagccuacaaac

SEQ ID NO: 69203 - RNA, 19 nt, Artificial Sequence
  Oligomer
uuaucauuaaggcgcgccc

SEQ ID NO: 69204 - RNA, 19 nt, Artificial Sequence
  Oligomer
uucaggaaccagagagacc

SEQ ID NO: 69205 - RNA, 19 nt, Artificial Sequence
  Oligomer
uuuaguugggcugaguggc

SEQ ID NO: 69206 - RNA, 19 nt, Artificial Sequence
  Oligomer
uuucuugcuuagaaccugg

SEQ ID NO: 69207 - RNA, 19 nt, Artificial Sequence
  Oligomer
uauagggaccuacugcagc

SEQ ID NO: 69208 - RNA, 19 nt, Artificial Sequence
  Oligomer
uagcuuggcauucugcucu

SEQ ID NO: 69209 - RNA, 19 nt, Artificial Sequence
  Oligomer
uucuguuccacguggccuu

SEQ ID NO: 69210 - RNA, 19 nt, Artificial Sequence
  Oligomer
uugcuguugucgcugaucu

SEQ ID NO: 69211 - RNA, 19 nt, Artificial Sequence
  Oligomer
aucugcagcagucugcaug

SEQ ID NO: 69212 - RNA, 19 nt, Artificial Sequence
  Oligomer
uuccacguggccuuuaagu

SEQ ID NO: 69213 - RNA, 19 nt, Artificial Sequence
  Oligomer
uuuaagugcucucacuuuu

SEQ ID NO: 69214 - RNA, 19 nt, Artificial Sequence
  Oligomer
uuucagguucuggacugcc

SEQ ID NO: 69215 - RNA, 19 nt, Artificial Sequence
  Oligomer
uguagagcugccuucuucu

SEQ ID NO: 69216 - RNA, 19 nt, Artificial Sequence
  Oligomer
uuucuuagcugcagcuccu

SEQ ID NO: 69217 - RNA, 19 nt, Artificial Sequence
  Oligomer
aucaucuuggacccgaacc

SEQ ID NO: 69218 - RNA, 19 nt, Artificial Sequence
  Oligomer
uacacgguaagaaacaucg

SEQ ID NO: 69219 - RNA, 19 nt, Artificial Sequence
  Oligomer
uucgucuucccuguggaug

SEQ ID NO: 69220 - RNA, 19 nt, Artificial Sequence
  Oligomer
ugguccacucacaaugucc

SEQ ID NO: 69221 - RNA, 19 nt, Artificial Sequence
  Oligomer
uugugaagagccgugaugc

SEQ ID NO: 69222 - RNA, 19 nt, Artificial Sequence
  Oligomer
uuuaccaggaggcagagag

SEQ ID NO: 69223 - RNA, 19 nt, Artificial Sequence
  Oligomer
uuucugagcuggcagucac

SEQ ID NO: 69224 - RNA, 19 nt, Artificial Sequence
  Oligomer
uuugcaaccugagcauccc

SEQ ID NO: 69225 - RNA, 19 nt, Artificial Sequence
  Oligomer
uuucuuuuugcuguagagc

SEQ ID NO: 69226 - RNA, 19 nt, Artificial Sequence
  Oligomer
uuuugcuguagagcugccu

SEQ ID NO: 69227 - RNA, 19 nt, Artificial Sequence
  Oligomer
uugcuuagucucuucuguu

SEQ ID NO: 69228 - RNA, 19 nt, Artificial Sequence
  Oligomer
uuacggguaagucuguagc

SEQ ID NO: 69229 - RNA, 19 nt, Artificial Sequence
  Oligomer
gugaauucuucaauccuuc

SEQ ID NO: 69230 - RNA, 19 nt, Artificial Sequence
  Oligomer
uaggucauggcaaacacag

SEQ ID NO: 69231 - RNA, 19 nt, Artificial Sequence
  Oligomer
uucaugacgaaggaagaag

SEQ ID NO: 69232 - RNA, 19 nt, Artificial Sequence
  Oligomer
uuguccuuuuaccaggagg

SEQ ID NO: 69233 - RNA, 19 nt, Artificial Sequence
  Oligomer
uugacaacugcugagaacu

SEQ ID NO: 69234 - RNA, 19 nt, Artificial Sequence
  Oligomer
auauucaccaggaacuuuu

SEQ ID NO: 69235 - RNA, 19 nt, Artificial Sequence
  Oligomer
ucuggauuugguucuucug

SEQ ID NO: 69236 - RNA, 19 nt, Artificial Sequence
  Oligomer
uuccucugacuuccaaauc

SEQ ID NO: 69237 - RNA, 19 nt, Artificial Sequence
  Oligomer
uuugcuguagagcugccuu

SEQ ID NO: 69238 - RNA, 19 nt, Artificial Sequence
  Oligomer
ucaaacacucccucuguug

SEQ ID NO: 69239 - RNA, 19 nt, Artificial Sequence
  Oligomer
uuuuuaaacuuggauccug

SEQ ID NO: 69240 - RNA, 19 nt, Artificial Sequence
  Oligomer
ucaaauucucccuccaaag

SEQ ID NO: 69241 - RNA, 19 nt, Artificial Sequence
  Oligomer
uuccaaaucguugaagaac

SEQ ID NO: 69242 - RNA, 19 nt, Artificial Sequence
  Oligomer
uauuuggcccauuaggacc

SEQ ID NO: 69243 - RNA, 19 nt, Artificial Sequence
  Oligomer
ucugguuucgguaaggauu

SEQ ID NO: 69244 - RNA, 19 nt, Artificial Sequence
  Oligomer
uugguuuuguaggaacagg

SEQ ID NO: 69245 - RNA, 19 nt, Artificial Sequence
  Oligomer
ugugaagugcugcucauug

SEQ ID NO: 69246 - RNA, 19 nt, Artificial Sequence
  Oligomer
ucgauauucaccaggaacu

SEQ ID NO: 69247 - RNA, 19 nt, Artificial Sequence
  Oligomer
uucaucgcuuucaagcuac

SEQ ID NO: 69248 - RNA, 19 nt, Artificial Sequence
  Oligomer
uucugcucuugauucaauu

SEQ ID NO: 69249 - RNA, 19 nt, Artificial Sequence
  Oligomer
ugcagacugauugucaugg

SEQ ID NO: 69250 - RNA, 19 nt, Artificial Sequence
  Oligomer
ucaucuguucaauuuccuc

SEQ ID NO: 69251 - RNA, 19 nt, Artificial Sequence
  Oligomer
ucuccugcucagcaacuug

SEQ ID NO: 69252 - RNA, 19 nt, Artificial Sequence
  Oligomer
uuguugcugggcuucaauc

SEQ ID NO: 69253 - RNA, 19 nt, Artificial Sequence
  Oligomer
ucuguguggaaguuucagg

SEQ ID NO: 69254 - RNA, 19 nt, Artificial Sequence
  Oligomer
uggcaugucacuguucucu

SEQ ID NO: 69255 - RNA, 19 nt, Artificial Sequence
  Oligomer
gcugacuuggauggguaug

SEQ ID NO: 69256 - RNA, 19 nt, Artificial Sequence
  Oligomer
ugcuguugcguauacaugg

SEQ ID NO: 69257 - RNA, 19 nt, Artificial Sequence
  Oligomer
uuugagguacagaagcaga

SEQ ID NO: 69258 - RNA, 19 nt, Artificial Sequence
  Oligomer
uuggcuugggaaaagaucu

SEQ ID NO: 69259 - RNA, 19 nt, Artificial Sequence
  Oligomer
uucuuuuugcuguagagcu

SEQ ID NO: 69260 - RNA, 19 nt, Artificial Sequence
  Oligomer
uuagcuuccugauucucag

SEQ ID NO: 69261 - RNA, 19 nt, Artificial Sequence
  Oligomer
uccacucacaaugucccug

SEQ ID NO: 69262 - RNA, 19 nt, Artificial Sequence
  Oligomer
uuccaugagcgauacgcuc

SEQ ID NO: 69263 - RNA, 19 nt, Artificial Sequence
  Oligomer
aguuuuacgcaaguuuguc

SEQ ID NO: 69264 - RNA, 19 nt, Artificial Sequence
  Oligomer
cuucguuccucugacuucc

SEQ ID NO: 69265 - RNA, 19 nt, Artificial Sequence
  Oligomer
ucguugaagaacaucaaac

SEQ ID NO: 69266 - RNA, 19 nt, Artificial Sequence
  Oligomer
ucugauauaaaagcuucug

SEQ ID NO: 69267 - RNA, 19 nt, Artificial Sequence
  Oligomer
acaacugcugagaacuucc

SEQ ID NO: 69268 - RNA, 19 nt, Artificial Sequence
  Oligomer
ucaaacauugagaacggac

SEQ ID NO: 69269 - RNA, 19 nt, Artificial Sequence
  Oligomer
uccaugacugccacuucug

SEQ ID NO: 69270 - RNA, 19 nt, Artificial Sequence
  Oligomer
ugccauuuccugaaguuca

SEQ ID NO: 69271 - RNA, 19 nt, Artificial Sequence
  Oligomer
uuguucacugacaaccaac

SEQ ID NO: 69272 - RNA, 19 nt, Artificial Sequence
  Oligomer
uuuacuagacaggauucuu

SEQ ID NO: 69273 - RNA, 19 nt, Artificial Sequence
  Oligomer
agaaacaucggcaucaucu

SEQ ID NO: 69274 - RNA, 19 nt, Artificial Sequence
  Oligomer
uugaacuugcugccacggu

SEQ ID NO: 69275 - RNA, 19 nt, Artificial Sequence
  Oligomer
uuguagcuuggcauucugc

SEQ ID NO: 69276 - RNA, 19 nt, Artificial Sequence
  Oligomer
uuucuccugcucagcaacu

SEQ ID NO: 69277 - RNA, 19 nt, Artificial Sequence
  Oligomer
uaaauguccucuaauggug

SEQ ID NO: 69278 - RNA, 19 nt, Artificial Sequence
  Oligomer
ugaauucuucaauccuuca

SEQ ID NO: 69279 - RNA, 19 nt, Artificial Sequence
  Oligomer
ucuugugaaauuuuugcca

SEQ ID NO: 69280 - RNA, 19 nt, Artificial Sequence
  Oligomer
auucgauuucaucuucguc

SEQ ID NO: 69281 - RNA, 19 nt, Artificial Sequence
  Oligomer
uuucaucuucgucuucccu

SEQ ID NO: 69282 - RNA, 19 nt, Artificial Sequence
  Oligomer
uguccuuuuaccaggaggc

SEQ ID NO: 69283 - RNA, 19 nt, Artificial Sequence
  Oligomer
ugacuuggauggguaugau

SEQ ID NO: 69284 - RNA, 19 nt, Artificial Sequence
  Oligomer
uucaugguucuccugaacu

SEQ ID NO: 69285 - RNA, 19 nt, Artificial Sequence
  Oligomer
auugucaugguggcugucg

SEQ ID NO: 69286 - RNA, 19 nt, Artificial Sequence
  Oligomer
uucuugagcaucucuagcu

SEQ ID NO: 69287 - RNA, 19 nt, Artificial Sequence
  Oligomer
uuuccuccacaaguuuccc

SEQ ID NO: 69288 - RNA, 19 nt, Artificial Sequence
  Oligomer
uuaagugcucucacuuuuu

SEQ ID NO: 69289 - RNA, 19 nt, Artificial Sequence
  Oligomer
uuuagcuuagcuuccugau

SEQ ID NO: 69290 - RNA, 19 nt, Artificial Sequence
  Oligomer
uucuuggguacagucccag

SEQ ID NO: 69291 - RNA, 19 nt, Artificial Sequence
  Oligomer
uacguggaacauaucccuc

SEQ ID NO: 69292 - RNA, 19 nt, Artificial Sequence
  Oligomer
ucaugacgaaggaagaagc

SEQ ID NO: 69293 - RNA, 19 nt, Artificial Sequence
  Oligomer
ucccucaggcucauaauca

SEQ ID NO: 69294 - RNA, 19 nt, Artificial Sequence
  Oligomer
uauggauucuggauuucua

SEQ ID NO: 69295 - RNA, 19 nt, Artificial Sequence
  Oligomer
uuucguaaggcuucuaggu

SEQ ID NO: 69296 - RNA, 19 nt, Artificial Sequence
  Oligomer
uucguaaggcuucuagguc

SEQ ID NO: 69297 - RNA, 19 nt, Artificial Sequence
  Oligomer
ugaaggguggaaguaaggu

SEQ ID NO: 69298 - RNA, 19 nt, Artificial Sequence
  Oligomer
uuugguuuuguaggaacag

SEQ ID NO: 69299 - RNA, 19 nt, Artificial Sequence
  Oligomer
uugaaggacuccaaucagg

SEQ ID NO: 69300 - RNA, 19 nt, Artificial Sequence
  Oligomer
uagacgacuggauauaggg

SEQ ID NO: 69301 - RNA, 19 nt, Artificial Sequence
  Oligomer
uauagaggcgaucaagcuc

SEQ ID NO: 69302 - RNA, 19 nt, Artificial Sequence
  Oligomer
cuuagcuuccugauucuca

SEQ ID NO: 69303 - RNA, 19 nt, Artificial Sequence
  Oligomer
uugccagcaauuguugcug

SEQ ID NO: 69304 - RNA, 19 nt, Artificial Sequence
  Oligomer
uguugcugggcuucaaucu

SEQ ID NO: 69305 - RNA, 19 nt, Artificial Sequence
  Oligomer
uuacugguaccguagcuua

SEQ ID NO: 69306 - RNA, 19 nt, Artificial Sequence
  Oligomer
cuccuuaucauuaaggcgc

SEQ ID NO: 69307 - RNA, 19 nt, Artificial Sequence
  Oligomer
aagcugacuuggaugggua

SEQ ID NO: 69308 - RNA, 19 nt, Artificial Sequence
  Oligomer
ugggugcugcuguugauuc

SEQ ID NO: 69309 - RNA, 19 nt, Artificial Sequence
  Oligomer
cugguaugagucuugguca

SEQ ID NO: 69310 - RNA, 19 nt, Artificial Sequence
  Oligomer
uugagaacggacgcacuuu

SEQ ID NO: 69311 - RNA, 19 nt, Artificial Sequence
  Oligomer
cucugaagccugaaugacc

SEQ ID NO: 69312 - RNA, 19 nt, Artificial Sequence
  Oligomer
uuccaucagaugaaacugg

SEQ ID NO: 69313 - RNA, 19 nt, Artificial Sequence
  Oligomer
ucuacuuuugacacagcca

SEQ ID NO: 69314 - RNA, 19 nt, Artificial Sequence
  Oligomer
cuagagacauucuucaucg

SEQ ID NO: 69315 - RNA, 19 nt, Artificial Sequence
  Oligomer
agucuugugaaauuuuugc

SEQ ID NO: 69316 - RNA, 19 nt, Artificial Sequence
  Oligomer
uuacguggaacauaucccu

SEQ ID NO: 69317 - RNA, 19 nt, Artificial Sequence
  Oligomer
acguggaacauaucccucc

SEQ ID NO: 69318 - RNA, 19 nt, Artificial Sequence
  Oligomer
ugucaugcagucuccuucu

SEQ ID NO: 69319 - RNA, 19 nt, Artificial Sequence
  Oligomer
aauguaauggaguccaucc

SEQ ID NO: 69320 - RNA, 19 nt, Artificial Sequence
  Oligomer
ugaaaaguguggcccucug

SEQ ID NO: 69321 - RNA, 19 nt, Artificial Sequence
  Oligomer
uggagaaagggucuggucu

SEQ ID NO: 69322 - RNA, 19 nt, Artificial Sequence
  Oligomer
uuggccaaccgaagguaug

SEQ ID NO: 69323 - RNA, 19 nt, Artificial Sequence
  Oligomer
ugauccagagcauucccag

SEQ ID NO: 69324 - RNA, 19 nt, Artificial Sequence
  Oligomer
uugggaaaagaucugcauu

SEQ ID NO: 69325 - RNA, 19 nt, Artificial Sequence
  Oligomer
acgcuuauccaugacugcc

SEQ ID NO: 69326 - RNA, 19 nt, Artificial Sequence
  Oligomer
ugcagcuccuuauagaggc

SEQ ID NO: 69327 - RNA, 19 nt, Artificial Sequence
  Oligomer
uuagcuuagcuuccugauu

SEQ ID NO: 69328 - RNA, 19 nt, Artificial Sequence
  Oligomer
uuaguugccagcaauuguu

SEQ ID NO: 69329 - RNA, 19 nt, Artificial Sequence
  Oligomer
uauuguucacugacaacca

SEQ ID NO: 69330 - RNA, 19 nt, Artificial Sequence
  Oligomer
agcugauuucccaacugcc

SEQ ID NO: 69331 - RNA, 19 nt, Artificial Sequence
  Oligomer
ucaugcagucuccuucuuu

SEQ ID NO: 69332 - RNA, 19 nt, Artificial Sequence
  Oligomer
uucuuucaugggcagcuca

SEQ ID NO: 69333 - RNA, 19 nt, Artificial Sequence
  Oligomer
aucccaaagcgcauaaaug

SEQ ID NO: 69334 - RNA, 19 nt, Artificial Sequence
  Oligomer
acagagauggucuccaugg

SEQ ID NO: 69335 - RNA, 19 nt, Artificial Sequence
  Oligomer
uuuagaggccuuggugcgu

SEQ ID NO: 69336 - RNA, 19 nt, Artificial Sequence
  Oligomer
uaaggcuucuaggucagca

SEQ ID NO: 69337 - RNA, 19 nt, Artificial Sequence
  Oligomer
uucgguaaggauuagauaa

SEQ ID NO: 69338 - RNA, 19 nt, Artificial Sequence
  Oligomer
uuuuguaggaacaggaggu

SEQ ID NO: 69339 - RNA, 19 nt, Artificial Sequence
  Oligomer
ugaaggacuccaaucaggg

SEQ ID NO: 69340 - RNA, 19 nt, Artificial Sequence
  Oligomer
uuuagagccuuuaguuugu

SEQ ID NO: 69341 - RNA, 19 nt, Artificial Sequence
  Oligomer
ucacugacaauauacaagu

SEQ ID NO: 69342 - RNA, 19 nt, Artificial Sequence
  Oligomer
uccuucauucucuucuaga

SEQ ID NO: 69343 - RNA, 19 nt, Artificial Sequence
  Oligomer
uaauggaguccauccauca

SEQ ID NO: 69344 - RNA, 19 nt, Artificial Sequence
  Oligomer
augcucaccgagucuucuc

SEQ ID NO: 69345 - RNA, 19 nt, Artificial Sequence
  Oligomer
uggagauuugggcuguugu

SEQ ID NO: 69346 - RNA, 19 nt, Artificial Sequence
  Oligomer
ucagaguaccaaaggaagg

SEQ ID NO: 69347 - RNA, 19 nt, Artificial Sequence
  Oligomer
uuguuguagcuuggcauuc

SEQ ID NO: 69348 - RNA, 19 nt, Artificial Sequence
  Oligomer
uugucaugguggcugucga

SEQ ID NO: 69349 - RNA, 19 nt, Artificial Sequence
  Oligomer
ucuaauggugaauucuuca

SEQ ID NO: 69350 - RNA, 19 nt, Artificial Sequence
  Oligomer
uaaacuuggauccugagau

SEQ ID NO: 69351 - RNA, 19 nt, Artificial Sequence
  Oligomer
uucugagguucauaauccc

SEQ ID NO: 69352 - RNA, 19 nt, Artificial Sequence
  Oligomer
uucguuccucugacuucca

SEQ ID NO: 69353 - RNA, 19 nt, Artificial Sequence
  Oligomer
ucaggaaccagagagacca

SEQ ID NO: 69354 - RNA, 19 nt, Artificial Sequence
  Oligomer
auuuggcccauuaggaccc

SEQ ID NO: 69355 - RNA, 19 nt, Artificial Sequence
  Oligomer
ucuaggucagcaucacucu

SEQ ID NO: 69356 - RNA, 19 nt, Artificial Sequence
  Oligomer
ucauguugggcagugucug

SEQ ID NO: 69357 - RNA, 19 nt, Artificial Sequence
  Oligomer
uugggcagugucuguauuu

SEQ ID NO: 69358 - RNA, 19 nt, Artificial Sequence
  Oligomer
ucuuuuugcuguagagcug

SEQ ID NO: 69359 - RNA, 19 nt, Artificial Sequence
  Oligomer
uggaacuucugugaagugc

SEQ ID NO: 69360 - RNA, 19 nt, Artificial Sequence
  Oligomer
cugauugucaugguggcug

SEQ ID NO: 69361 - RNA, 19 nt, Artificial Sequence
  Oligomer
ucagcuauuucuuuuagcc

SEQ ID NO: 69362 - RNA, 19 nt, Artificial Sequence
  Oligomer
ccuuucuucgauauucacc

SEQ ID NO: 69363 - RNA, 19 nt, Artificial Sequence
  Oligomer
uucuguguggaaguuucag

SEQ ID NO: 69364 - RNA, 19 nt, Artificial Sequence
  Oligomer
ucaugggcagcucaucauc

SEQ ID NO: 69365 - RNA, 19 nt, Artificial Sequence
  Oligomer
uugggagcacugaguguag

SEQ ID NO: 69366 - RNA, 19 nt, Artificial Sequence
  Oligomer
auauggauucuggauuucu

SEQ ID NO: 69367 - RNA, 19 nt, Artificial Sequence
  Oligomer
aaaucguugaagaacauca

SEQ ID NO: 69368 - RNA, 19 nt, Artificial Sequence
  Oligomer
ucgcucauuauccgcaacu

SEQ ID NO: 69369 - RNA, 19 nt, Artificial Sequence
  Oligomer
aguuuuuuccuggcgccug

SEQ ID NO: 69370 - RNA, 19 nt, Artificial Sequence
  Oligomer
uguagcuuggcauucugcu

SEQ ID NO: 69371 - RNA, 19 nt, Artificial Sequence
  Oligomer
guuucuuagcugcagcucc

SEQ ID NO: 69372 - RNA, 19 nt, Artificial Sequence
  Oligomer
aaagaaauugggagcacug

SEQ ID NO: 69373 - RNA, 19 nt, Artificial Sequence
  Oligomer
aucacuaucagcagcauuu

SEQ ID NO: 69374 - RNA, 19 nt, Artificial Sequence
  Oligomer
ucucuguacaaggucaaau

SEQ ID NO: 69375 - RNA, 19 nt, Artificial Sequence
  Oligomer
augagcgauacgcucugag

SEQ ID NO: 69376 - RNA, 19 nt, Artificial Sequence
  Oligomer
uuuacgcaaguuuguccuu

SEQ ID NO: 69377 - RNA, 19 nt, Artificial Sequence
  Oligomer
uucuggguuauucuggaga

SEQ ID NO: 69378 - RNA, 19 nt, Artificial Sequence
  Oligomer
uuucgggcuccacauguaa

SEQ ID NO: 69379 - RNA, 19 nt, Artificial Sequence
  Oligomer
uauggugguccucugauau

SEQ ID NO: 69380 - RNA, 19 nt, Artificial Sequence
  Oligomer
uucagguucuggacugcca

SEQ ID NO: 69381 - RNA, 19 nt, Artificial Sequence
  Oligomer
uaaugucugaagguggcug

SEQ ID NO: 69382 - RNA, 19 nt, Artificial Sequence
  Oligomer
ugaagccugaaugaccaag

SEQ ID NO: 69383 - RNA, 19 nt, Artificial Sequence
  Oligomer
aucucuagcugccugguca

SEQ ID NO: 69384 - RNA, 19 nt, Artificial Sequence
  Oligomer
uccacaaguuucccauugc

SEQ ID NO: 69385 - RNA, 19 nt, Artificial Sequence
  Oligomer
ucuaauuacugguaccgua

SEQ ID NO: 69386 - RNA, 19 nt, Artificial Sequence
  Oligomer
aucgcuuucaagcuacauu

SEQ ID NO: 69387 - RNA, 19 nt, Artificial Sequence
  Oligomer
uucccuguggaugauuguc

SEQ ID NO: 69388 - RNA, 19 nt, Artificial Sequence
  Oligomer
ucuccugaacuccauaaag

SEQ ID NO: 69389 - RNA, 19 nt, Artificial Sequence
  Oligomer
uacaccaaacuguaccagg

SEQ ID NO: 69390 - RNA, 19 nt, Artificial Sequence
  Oligomer
ccaguuuuacgcaaguuug

SEQ ID NO: 69391 - RNA, 19 nt, Artificial Sequence
  Oligomer
ugucacuguucucuguacu

SEQ ID NO: 69392 - RNA, 19 nt, Artificial Sequence
  Oligomer
uucuggauuucuacugggc

SEQ ID NO: 69393 - RNA, 19 nt, Artificial Sequence
  Oligomer
ucuacugggcuuucugagc

SEQ ID NO: 69394 - RNA, 19 nt, Artificial Sequence
  Oligomer
acagaagcugacuuggaug

SEQ ID NO: 69395 - RNA, 19 nt, Artificial Sequence
  Oligomer
gacuuggauggguaugaug

SEQ ID NO: 69396 - RNA, 19 nt, Artificial Sequence
  Oligomer
uguuucagguucuggacug

SEQ ID NO: 69397 - RNA, 19 nt, Artificial Sequence
  Oligomer
cugaaggguggaaguaagg

SEQ ID NO: 69398 - RNA, 19 nt, Artificial Sequence
  Oligomer
acuuccgucuggcuuaaug

SEQ ID NO: 69399 - RNA, 19 nt, Artificial Sequence
  Oligomer
ugaagguggcugauuaguu

SEQ ID NO: 69400 - RNA, 19 nt, Artificial Sequence
  Oligomer
accacgucucugcauauug

SEQ ID NO: 69401 - RNA, 19 nt, Artificial Sequence
  Oligomer
uggauuuuagagccuuuag

SEQ ID NO: 69402 - RNA, 19 nt, Artificial Sequence
  Oligomer
auauuguuucuggaguaac

SEQ ID NO: 69403 - RNA, 19 nt, Artificial Sequence
  Oligomer
uggauauagggaccuacug

SEQ ID NO: 69404 - RNA, 19 nt, Artificial Sequence
  Oligomer
uucuucuuccacagccggu

SEQ ID NO: 69405 - RNA, 19 nt, Artificial Sequence
  Oligomer
uucuggaguaacuggaacu

SEQ ID NO: 69406 - RNA, 19 nt, Artificial Sequence
  Oligomer
acacgcuuauccaugacug

SEQ ID NO: 69407 - RNA, 19 nt, Artificial Sequence
  Oligomer
ucuagcugccuggucaguu

SEQ ID NO: 69408 - RNA, 19 nt, Artificial Sequence
  Oligomer
uccuccacaaguuucccau

SEQ ID NO: 69409 - RNA, 19 nt, Artificial Sequence
  Oligomer
uuccugauucucagcuauu

SEQ ID NO: 69410 - RNA, 19 nt, Artificial Sequence
  Oligomer
cuuguugcuguugucgcug

SEQ ID NO: 69411 - RNA, 19 nt, Artificial Sequence
  Oligomer
uuuccugaaguucagcaag

SEQ ID NO: 69412 - RNA, 19 nt, Artificial Sequence
  Oligomer
aauauuacggguaagucug

SEQ ID NO: 69413 - RNA, 19 nt, Artificial Sequence
  Oligomer
ucuguagcaaguuucuaau

SEQ ID NO: 69414 - RNA, 19 nt, Artificial Sequence
  Oligomer
uacaagugugcagugccuu

SEQ ID NO: 69415 - RNA, 19 nt, Artificial Sequence
  Oligomer
acaagugugcagugccuuc

SEQ ID NO: 69416 - RNA, 19 nt, Artificial Sequence
  Oligomer
ucaauccuucauucucuuc

SEQ ID NO: 69417 - RNA, 19 nt, Artificial Sequence
  Oligomer
auaucccuccuuaucauua

SEQ ID NO: 69418 - RNA, 19 nt, Artificial Sequence
  Oligomer
uucaugggcagcucaucau

SEQ ID NO: 69419 - RNA, 19 nt, Artificial Sequence
  Oligomer
uccauuuccucgcacuuau

SEQ ID NO: 69420 - RNA, 19 nt, Artificial Sequence
  Oligomer
uguuacaugaggcagcaca

SEQ ID NO: 69421 - RNA, 19 nt, Artificial Sequence
  Oligomer
auggaguccauccaucacu

SEQ ID NO: 69422 - RNA, 19 nt, Artificial Sequence
  Oligomer
uuuacaccaaacuguacca

SEQ ID NO: 69423 - RNA, 19 nt, Artificial Sequence
  Oligomer
uuucuguguggccugcaca

SEQ ID NO: 69424 - RNA, 19 nt, Artificial Sequence
  Oligomer
ucucccuccaaagacgaau

SEQ ID NO: 69425 - RNA, 19 nt, Artificial Sequence
  Oligomer
auuugggcuguugucuggg

SEQ ID NO: 69426 - RNA, 19 nt, Artificial Sequence
  Oligomer
uucugagcuggcagucaca

SEQ ID NO: 69427 - RNA, 19 nt, Artificial Sequence
  Oligomer
ugaauauuuggcccauuag

SEQ ID NO: 69428 - RNA, 19 nt, Artificial Sequence
  Oligomer
uuagauaagaaaggcagua

SEQ ID NO: 69429 - RNA, 19 nt, Artificial Sequence
  Oligomer
uuuaguucccauggacgga

SEQ ID NO: 69430 - RNA, 19 nt, Artificial Sequence
  Oligomer
uucccauggacggaacaac

SEQ ID NO: 69431 - RNA, 19 nt, Artificial Sequence
  Oligomer
uuguaggaacaggaggugg

SEQ ID NO: 69432 - RNA, 19 nt, Artificial Sequence
  Oligomer
cuucucuuucucccucagc

SEQ ID NO: 69433 - RNA, 19 nt, Artificial Sequence
  Oligomer
ucucauguugggcaguguc

SEQ ID NO: 69434 - RNA, 19 nt, Artificial Sequence
  Oligomer
ucgauccugccguucuuga

SEQ ID NO: 69435 - RNA, 19 nt, Artificial Sequence
  Oligomer
agcaagagucagauccauc

SEQ ID NO: 69436 - RNA, 19 nt, Artificial Sequence
  Oligomer
ucagagacagcgaugugac

SEQ ID NO: 69437 - RNA, 19 nt, Artificial Sequence
  Oligomer
ucccuguggaugauuguca

SEQ ID NO: 69438 - RNA, 19 nt, Artificial Sequence
  Oligomer
cuguggaugauugucaugc

SEQ ID NO: 69439 - RNA, 19 nt, Artificial Sequence
  Oligomer
ucuccuucuuucaugggca

SEQ ID NO: 69440 - RNA, 19 nt, Artificial Sequence
  Oligomer
uguagccuuccuccauuuc

SEQ ID NO: 69441 - RNA, 19 nt, Artificial Sequence
  Oligomer
uuccucgcacuuaucugca

SEQ ID NO: 69442 - RNA, 19 nt, Artificial Sequence
  Oligomer
cuccagguacacaucaagc

SEQ ID NO: 69443 - RNA, 19 nt, Artificial Sequence
  Oligomer
uggguuauucuggagauuu

SEQ ID NO: 69444 - RNA, 19 nt, Artificial Sequence
  Oligomer
ugguccucugauauaaaag

SEQ ID NO: 69445 - RNA, 19 nt, Artificial Sequence
  Oligomer
uggccgaggaauucuuucg

SEQ ID NO: 69446 - RNA, 19 nt, Artificial Sequence
  Oligomer
uugcccuggcuauuggaau

SEQ ID NO: 69447 - RNA, 19 nt, Artificial Sequence
  Oligomer
auucugggcagcagcaauu

SEQ ID NO: 69448 - RNA, 19 nt, Artificial Sequence
  Oligomer
ugcuggaaguuuuuuccug

SEQ ID NO: 69449 - RNA, 19 nt, Artificial Sequence
  Oligomer
ucuugcuuagaaccuggag

SEQ ID NO: 69450 - RNA, 19 nt, Artificial Sequence
  Oligomer
uucaaacacucccucuguu

SEQ ID NO: 69451 - RNA, 19 nt, Artificial Sequence
  Oligomer
auagaggcgaucaagcuca

SEQ ID NO: 69452 - RNA, 19 nt, Artificial Sequence
  Oligomer
ucccauugcuuagucucuu

SEQ ID NO: 69453 - RNA, 19 nt, Artificial Sequence
  Oligomer
uguuccuuaguugccagca

SEQ ID NO: 69454 - RNA, 19 nt, Artificial Sequence
  Oligomer
ucuucacugacaauauaca

SEQ ID NO: 69455 - RNA, 19 nt, Artificial Sequence
  Oligomer
ugcuacacgggacaccuuu

SEQ ID NO: 69456 - RNA, 19 nt, Artificial Sequence
  Oligomer
ucccuccuuaucauuaagg

SEQ ID NO: 69457 - RNA, 19 nt, Artificial Sequence
  Oligomer
ucccaaagcgcauaaauga

SEQ ID NO: 69458 - RNA, 19 nt, Artificial Sequence
  Oligomer
ucuguacaaggucaaauuc

SEQ ID NO: 69459 - RNA, 19 nt, Artificial Sequence
  Oligomer
uacgcaaguuuguccuuuu

SEQ ID NO: 69460 - RNA, 19 nt, Artificial Sequence
  Oligomer
cuuuucgggcuccacaugu

SEQ ID NO: 69461 - RNA, 19 nt, Artificial Sequence
  Oligomer
cugaacugaagaaacaggc

SEQ ID NO: 69462 - RNA, 19 nt, Artificial Sequence
  Oligomer
uacacuugaaaaguguggc

SEQ ID NO: 69463 - RNA, 19 nt, Artificial Sequence
  Oligomer
agcagguggacuuucuugc

SEQ ID NO: 69464 - RNA, 19 nt, Artificial Sequence
  Oligomer
auugagaacggacgcacuu

SEQ ID NO: 69465 - RNA, 19 nt, Artificial Sequence
  Oligomer
ugggaaaagaucugcauuu

SEQ ID NO: 69466 - RNA, 19 nt, Artificial Sequence
  Oligomer
ugcauauuguuucuggagu

SEQ ID NO: 69467 - RNA, 19 nt, Artificial Sequence
  Oligomer
ugauucucagcuauuucuu

SEQ ID NO: 69468 - RNA, 19 nt, Artificial Sequence
  Oligomer
uaacaguucuucacugaca

SEQ ID NO: 69469 - RNA, 19 nt, Artificial Sequence
  Oligomer
uguagaaaacaggauuguc

SEQ ID NO: 69470 - RNA, 19 nt, Artificial Sequence
  Oligomer
uaucugagugcuacacggg

SEQ ID NO: 69471 - RNA, 19 nt, Artificial Sequence
  Oligomer
uucauucucuucuagagac

SEQ ID NO: 69472 - RNA, 19 nt, Artificial Sequence
  Oligomer
uuaaacuuggauccugaga

SEQ ID NO: 69473 - RNA, 19 nt, Artificial Sequence
  Oligomer
auucuuggguacaguccca

SEQ ID NO: 69474 - RNA, 19 nt, Artificial Sequence
  Oligomer
uaucauuaaggcgcgccca

SEQ ID NO: 69475 - RNA, 19 nt, Artificial Sequence
  Oligomer
acuuggacguuguuacaug

SEQ ID NO: 69476 - RNA, 19 nt, Artificial Sequence
  Oligomer
acuucguuccucugacuuc

SEQ ID NO: 69477 - RNA, 19 nt, Artificial Sequence
  Oligomer
uacuccuccagguacacau

SEQ ID NO: 69478 - RNA, 19 nt, Artificial Sequence
  Oligomer
ugguucuucuggguuauuc

SEQ ID NO: 69479 - RNA, 19 nt, Artificial Sequence
  Oligomer
aaugauucaggaaccagag

SEQ ID NO: 69480 - RNA, 19 nt, Artificial Sequence
  Oligomer
uucgggcuccacauguaaa

SEQ ID NO: 69481 - RNA, 19 nt, Artificial Sequence
  Oligomer
ucuggauuucuacugggcu

SEQ ID NO: 69482 - RNA, 19 nt, Artificial Sequence
  Oligomer
auuaggacccucuggcucu

SEQ ID NO: 69483 - RNA, 19 nt, Artificial Sequence
  Oligomer
auacacuugaaaagugugg

SEQ ID NO: 69484 - RNA, 19 nt, Artificial Sequence
  Oligomer
ccacacuucagccaaaugg

SEQ ID NO: 69485 - RNA, 19 nt, Artificial Sequence
  Oligomer
uuccgucuggcuuaauguc

SEQ ID NO: 69486 - RNA, 19 nt, Artificial Sequence
  Oligomer
ugguacuuuagccacauuu

SEQ ID NO: 69487 - RNA, 19 nt, Artificial Sequence
  Oligomer
acgcacuuucuucucuuuc

SEQ ID NO: 69488 - RNA, 19 nt, Artificial Sequence
  Oligomer
ugagguacagaagcagagc

SEQ ID NO: 69489 - RNA, 19 nt, Artificial Sequence
  Oligomer
acuccaaucagggccaacu

SEQ ID NO: 69490 - RNA, 19 nt, Artificial Sequence
  Oligomer
acuggauggauuuuagagc

SEQ ID NO: 69491 - RNA, 19 nt, Artificial Sequence
  Oligomer
uccacguggccuuuaagug

SEQ ID NO: 69492 - RNA, 19 nt, Artificial Sequence
  Oligomer
agcaaguuucuaauuucug

SEQ ID NO: 69493 - RNA, 19 nt, Artificial Sequence
  Oligomer
cuaauuacugguaccguag

SEQ ID NO: 69494 - RNA, 19 nt, Artificial Sequence
  Oligomer
cugauuucccaacugccca

SEQ ID NO: 69495 - RNA, 19 nt, Artificial Sequence
  Oligomer
accaccauucgauuucauc

SEQ ID NO: 69496 - RNA, 19 nt, Artificial Sequence
  Oligomer
ucuucccuguggaugauug

SEQ ID NO: 69497 - RNA, 19 nt, Artificial Sequence
  Oligomer
acuuaucugcagcagucug

SEQ ID NO: 69498 - RNA, 19 nt, Artificial Sequence
  Oligomer
uccaucacuaucagcagca

SEQ ID NO: 69499 - RNA, 19 nt, Artificial Sequence
  Oligomer
aauuucacccucauuccau

SEQ ID NO: 69500 - RNA, 19 nt, Artificial Sequence
  Oligomer
uacgcucugagccaguuuu

SEQ ID NO: 69501 - RNA, 19 nt, Artificial Sequence
  Oligomer
auguggagccucuggauuu

SEQ ID NO: 69502 - RNA, 19 nt, Artificial Sequence
  Oligomer
uguaaauauggauucugga

SEQ ID NO: 69503 - RNA, 19 nt, Artificial Sequence
  Oligomer
auauuuggcccauuaggac

SEQ ID NO: 69504 - RNA, 19 nt, Artificial Sequence
  Oligomer
uacguuucuuuagaggccu

SEQ ID NO: 69505 - RNA, 19 nt, Artificial Sequence
  Oligomer
ugcguuagacaguuucuuu

SEQ ID NO: 69506 - RNA, 19 nt, Artificial Sequence
  Oligomer
ucgguaaggauuagauaag

SEQ ID NO: 69507 - RNA, 19 nt, Artificial Sequence
  Oligomer
uauccgcaacuggacguuc

SEQ ID NO: 69508 - RNA, 19 nt, Artificial Sequence
  Oligomer
uuaguucccauggacggaa

SEQ ID NO: 69509 - RNA, 19 nt, Artificial Sequence
  Oligomer
uccgucuggcuuaaugucu

SEQ ID NO: 69510 - RNA, 19 nt, Artificial Sequence
  Oligomer
ucuggcuuaaugucugaag

SEQ ID NO: 69511 - RNA, 19 nt, Artificial Sequence
  Oligomer
aagguggcugauuaguuug

SEQ ID NO: 69512 - RNA, 19 nt, Artificial Sequence
  Oligomer
ccaaauggcaaucacucuc

SEQ ID NO: 69513 - RNA, 19 nt, Artificial Sequence
  Oligomer
uguaggaacaggagguggu

SEQ ID NO: 69514 - RNA, 19 nt, Artificial Sequence
  Oligomer
auuggacuggucuacugca

SEQ ID NO: 69515 - RNA, 19 nt, Artificial Sequence
  Oligomer
aaaagaucugcauuugaag

SEQ ID NO: 69516 - RNA, 19 nt, Artificial Sequence
  Oligomer
uuguuucuuagcugcagcu

SEQ ID NO: 69517 - RNA, 19 nt, Artificial Sequence
  Oligomer
ucuuagcugcagcuccuua

SEQ ID NO: 69518 - RNA, 19 nt, Artificial Sequence
  Oligomer
uuauagaggcgaucaagcu

SEQ ID NO: 69519 - RNA, 19 nt, Artificial Sequence
  Oligomer
ucaauuuccuccacaaguu

SEQ ID NO: 69520 - RNA, 19 nt, Artificial Sequence
  Oligomer
guugucgcugaucuuguug

SEQ ID NO: 69521 - RNA, 19 nt, Artificial Sequence
  Oligomer
uucuccuuucuucgauauu

SEQ ID NO: 69522 - RNA, 19 nt, Artificial Sequence
  Oligomer
uuuaggagcagcugcugaa

SEQ ID NO: 69523 - RNA, 19 nt, Artificial Sequence
  Oligomer
uuucccaacugcccaauaa

SEQ ID NO: 69524 - RNA, 19 nt, Artificial Sequence
  Oligomer
auugucgcuguauacuuau

SEQ ID NO: 69525 - RNA, 19 nt, Artificial Sequence
  Oligomer
ucacgcuaaauguccucua

SEQ ID NO: 69526 - RNA, 19 nt, Artificial Sequence
  Oligomer
uggaaguuucaggccaagc

SEQ ID NO: 69527 - RNA, 19 nt, Artificial Sequence
  Oligomer
guuacguggaacauauccc

SEQ ID NO: 69528 - RNA, 19 nt, Artificial Sequence
  Oligomer
uccuccauuuccucgcacu

SEQ ID NO: 69529 - RNA, 19 nt, Artificial Sequence
  Oligomer
cuuaucugcagcagucugc

SEQ ID NO: 69530 - RNA, 19 nt, Artificial Sequence
  Oligomer
uuaucugcagcagucugca

SEQ ID NO: 69531 - RNA, 19 nt, Artificial Sequence
  Oligomer
ucuagcaguaaagcaaggg

SEQ ID NO: 69532 - RNA, 19 nt, Artificial Sequence
  Oligomer
uccaugagcgauacgcucu

SEQ ID NO: 69533 - RNA, 19 nt, Artificial Sequence
  Oligomer
cuggauuugguucuucugg

SEQ ID NO: 69534 - RNA, 19 nt, Artificial Sequence
  Oligomer
ucuggcucuguaauagaac

SEQ ID NO: 69535 - RNA, 19 nt, Artificial Sequence
  Oligomer
uuucaugguucuccugaac

SEQ ID NO: 69536 - RNA, 19 nt, Artificial Sequence
  Oligomer
uggcuauuggaauaaaugu

SEQ ID NO: 69537 - RNA, 19 nt, Artificial Sequence
  Oligomer
uucucugggugcugcuguu

SEQ ID NO: 69538 - RNA, 19 nt, Artificial Sequence
  Oligomer
uacaggcuuaccauauaca

SEQ ID NO: 69539 - RNA, 19 nt, Artificial Sequence
  Oligomer
ugcugagaacuuccgucug

SEQ ID NO: 69540 - RNA, 19 nt, Artificial Sequence
  Oligomer
uuuugguuuuguaggaaca

SEQ ID NO: 69541 - RNA, 19 nt, Artificial Sequence
  Oligomer
ucccgcaagauaucuucac

SEQ ID NO: 69542 - RNA, 19 nt, Artificial Sequence
  Oligomer
caaacauugagaacggacg

SEQ ID NO: 69543 - RNA, 19 nt, Artificial Sequence
  Oligomer
ugguagauuuucuuuuugc

SEQ ID NO: 69544 - RNA, 19 nt, Artificial Sequence
  Oligomer
cuuuuugcuguagagcugc

SEQ ID NO: 69545 - RNA, 19 nt, Artificial Sequence
  Oligomer
uuucuggaguaacuggaac

SEQ ID NO: 69546 - RNA, 19 nt, Artificial Sequence
  Oligomer
uucuuagcugcagcuccuu

SEQ ID NO: 69547 - RNA, 19 nt, Artificial Sequence
  Oligomer
cuuauagaggcgaucaagc

SEQ ID NO: 69548 - RNA, 19 nt, Artificial Sequence
  Oligomer
cugcucagcaacuuguugc

SEQ ID NO: 69549 - RNA, 19 nt, Artificial Sequence
  Oligomer
cuguugucgcugaucuugu

SEQ ID NO: 69550 - RNA, 19 nt, Artificial Sequence
  Oligomer
uuaagcgcuguuccuuagu

SEQ ID NO: 69551 - RNA, 19 nt, Artificial Sequence
  Oligomer
cugaaguucagcaagaguc

SEQ ID NO: 69552 - RNA, 19 nt, Artificial Sequence
  Oligomer
cuauuaacaccguucuccu

SEQ ID NO: 69553 - RNA, 19 nt, Artificial Sequence
  Oligomer
ucagccuacaaacaagauu

SEQ ID NO: 69554 - RNA, 19 nt, Artificial Sequence
  Oligomer
acugacaaccaacuaacag

SEQ ID NO: 69555 - RNA, 19 nt, Artificial Sequence
  Oligomer
ucuucgauauucaccagga

SEQ ID NO: 69556 - RNA, 19 nt, Artificial Sequence
  Oligomer
ugacguagaugcuuuauuu

SEQ ID NO: 69557 - RNA, 19 nt, Artificial Sequence
  Oligomer
auucuucaucgcuuucaag

SEQ ID NO: 69558 - RNA, 19 nt, Artificial Sequence
  Oligomer
uuuaaacuuggauccugag

SEQ ID NO: 69559 - RNA, 19 nt, Artificial Sequence
  Oligomer
caugcagucuccuucuuuc

SEQ ID NO: 69560 - RNA, 19 nt, Artificial Sequence
  Oligomer
augcagucuccuucuuuca

SEQ ID NO: 69561 - RNA, 19 nt, Artificial Sequence
  Oligomer
ucugcagcagucugcaugu

SEQ ID NO: 69562 - RNA, 19 nt, Artificial Sequence
  Oligomer
ugaggcagcacaauguaau

SEQ ID NO: 69563 - RNA, 19 nt, Artificial Sequence
  Oligomer
cuccaaagacgaaucuagc

SEQ ID NO: 69564 - RNA, 19 nt, Artificial Sequence
  Oligomer
auggauucuggauuucuac

SEQ ID NO: 69565 - RNA, 19 nt, Artificial Sequence
  Oligomer
cuggcuauuggaauaaaug

SEQ ID NO: 69566 - RNA, 19 nt, Artificial Sequence
  Oligomer
auguucucugggugcugcu

SEQ ID NO: 69567 - RNA, 19 nt, Artificial Sequence
  Oligomer
uugauucugggcagcagca

SEQ ID NO: 69568 - RNA, 19 nt, Artificial Sequence
  Oligomer
ugggcagcagcaauuacag

SEQ ID NO: 69569 - RNA, 19 nt, Artificial Sequence
  Oligomer
uuuuuuccuggcgccugcu

SEQ ID NO: 69570 - RNA, 19 nt, Artificial Sequence
  Oligomer
ucugaagguggcugauuag

SEQ ID NO: 69571 - RNA, 19 nt, Artificial Sequence
  Oligomer
ugagcaucccgcaagauau

SEQ ID NO: 69572 - RNA, 19 nt, Artificial Sequence
  Oligomer
acugcucugguucuuccuc

SEQ ID NO: 69573 - RNA, 19 nt, Artificial Sequence
  Oligomer
uccaccacgucucugcaua

SEQ ID NO: 69574 - RNA, 19 nt, Artificial Sequence
  Oligomer
ugcuuugagguacagaagc

SEQ ID NO: 69575 - RNA, 19 nt, Artificial Sequence
  Oligomer
uuagagccuuuaguuugug

SEQ ID NO: 69576 - RNA, 19 nt, Artificial Sequence
  Oligomer
uguuucuggaguaacugga

SEQ ID NO: 69577 - RNA, 19 nt, Artificial Sequence
  Oligomer
ucugaauuacgcuuauuca

SEQ ID NO: 69578 - RNA, 19 nt, Artificial Sequence
  Oligomer
uggaguaacuggaacuucu

SEQ ID NO: 69579 - RNA, 19 nt, Artificial Sequence
  Oligomer
uuagcugcagcuccuuaua

SEQ ID NO: 69580 - RNA, 19 nt, Artificial Sequence
  Oligomer
aauuuccuccacaaguuuc

SEQ ID NO: 69581 - RNA, 19 nt, Artificial Sequence
  Oligomer
gcuuagucucuucuguucc

SEQ ID NO: 69582 - RNA, 19 nt, Artificial Sequence
  Oligomer
aaguuucuccugcucagca

SEQ ID NO: 69583 - RNA, 19 nt, Artificial Sequence
  Oligomer
gucuugugaaauuuuugcc

SEQ ID NO: 69584 - RNA, 19 nt, Artificial Sequence
  Oligomer
aguuacguggaacauaucc

SEQ ID NO: 69585 - RNA, 19 nt, Artificial Sequence
  Oligomer
guucauaaucccaaagcgc

SEQ ID NO: 69586 - RNA, 19 nt, Artificial Sequence
  Oligomer
ugucacuguaggucauggc

SEQ ID NO: 69587 - RNA, 19 nt, Artificial Sequence
  Oligomer
ugaagagccgugaugccuu

SEQ ID NO: 69588 - RNA, 19 nt, Artificial Sequence
  Oligomer
ugggucaucaaccucauaa

SEQ ID NO: 69589 - RNA, 19 nt, Artificial Sequence
  Oligomer
agcugacuuggauggguau

SEQ ID NO: 69590 - RNA, 19 nt, Artificial Sequence
  Oligomer
ucuguaauagaacuacguu

SEQ ID NO: 69591 - RNA, 19 nt, Artificial Sequence
  Oligomer
cuuucguaaggcuucuagg

SEQ ID NO: 69592 - RNA, 19 nt, Artificial Sequence
  Oligomer
uaggaacaggaggugguac

SEQ ID NO: 69593 - RNA, 19 nt, Artificial Sequence
  Oligomer
ucuucacugcucugguucu

SEQ ID NO: 69594 - RNA, 19 nt, Artificial Sequence
  Oligomer
ucuuccucagaguaccaaa

SEQ ID NO: 69595 - RNA, 19 nt, Artificial Sequence
  Oligomer
uggacuggucuacugcauc

SEQ ID NO: 69596 - RNA, 19 nt, Artificial Sequence
  Oligomer
ugaaugaccaaggaaccau

SEQ ID NO: 69597 - RNA, 19 nt, Artificial Sequence
  Oligomer
ugccuucuucuuccacagc

SEQ ID NO: 69598 - RNA, 19 nt, Artificial Sequence
  Oligomer
acucccucuguuguuguag

SEQ ID NO: 69599 - RNA, 19 nt, Artificial Sequence
  Oligomer
agccacugcagacugauug

SEQ ID NO: 69600 - RNA, 19 nt, Artificial Sequence
  Oligomer
ucuugagcaucucuagcug

SEQ ID NO: 69601 - RNA, 19 nt, Artificial Sequence
  Oligomer
ugaagugcugcucauuguu

SEQ ID NO: 69602 - RNA, 19 nt, Artificial Sequence
  Oligomer
uucuccugcucagcaacuu

SEQ ID NO: 69603 - RNA, 19 nt, Artificial Sequence
  Oligomer
acuuuaagcgcuguuccuu

SEQ ID NO: 69604 - RNA, 19 nt, Artificial Sequence
  Oligomer
cuuuaagcgcuguuccuua

SEQ ID NO: 69605 - RNA, 19 nt, Artificial Sequence
  Oligomer
ucagcuaugaucuugacaa

SEQ ID NO: 69606 - RNA, 19 nt, Artificial Sequence
  Oligomer
ucugagauacaaaagacaa

SEQ ID NO: 69607 - RNA, 19 nt, Artificial Sequence
  Oligomer
cuuaagaugcuacaaaaac

SEQ ID NO: 69608 - RNA, 19 nt, Artificial Sequence
  Oligomer
uccuuucuucgauauucac

SEQ ID NO: 69609 - RNA, 19 nt, Artificial Sequence
  Oligomer
uucccaacugcccaauaaa

SEQ ID NO: 69610 - RNA, 19 nt, Artificial Sequence
  Oligomer
cuuaucugagugcuacacg

SEQ ID NO: 69611 - RNA, 19 nt, Artificial Sequence
  Oligomer
uucuagagacauucuucau

SEQ ID NO: 69612 - RNA, 19 nt, Artificial Sequence
  Oligomer
ucugagguucauaauccca

SEQ ID NO: 69613 - RNA, 19 nt, Artificial Sequence
  Oligomer
ucuucuccugaacuccaua

SEQ ID NO: 69614 - RNA, 19 nt, Artificial Sequence
  Oligomer
uaccaggaacuuaacgauu

SEQ ID NO: 69615 - RNA, 19 nt, Artificial Sequence
  Oligomer
uacacaucaagcacaugug

SEQ ID NO: 69616 - RNA, 19 nt, Artificial Sequence
  Oligomer
uggauuucuacugggcuuu

SEQ ID NO: 69617 - RNA, 19 nt, Artificial Sequence
  Oligomer
uucuuucguaaggcuucua

SEQ ID NO: 69618 - RNA, 19 nt, Artificial Sequence
  Oligomer
ucguuuucaugguucuccu

SEQ ID NO: 69619 - RNA, 19 nt, Artificial Sequence
  Oligomer
uucugggcagcagcaauua

SEQ ID NO: 69620 - RNA, 19 nt, Artificial Sequence
  Oligomer
auuauccgcaacuggacgu

SEQ ID NO: 69621 - RNA, 19 nt, Artificial Sequence
  Oligomer
uggaaguaaggugucuuug

SEQ ID NO: 69622 - RNA, 19 nt, Artificial Sequence
  Oligomer
agaaccuggagaaaggguc

SEQ ID NO: 69623 - RNA, 19 nt, Artificial Sequence
  Oligomer
aaacaucggcaucaucuug

SEQ ID NO: 69624 - RNA, 19 nt, Artificial Sequence
  Oligomer
ucccauggacggaacaacu

SEQ ID NO: 69625 - RNA, 19 nt, Artificial Sequence
  Oligomer
acaacuguugacaacugcu

SEQ ID NO: 69626 - RNA, 19 nt, Artificial Sequence
  Oligomer
uucagccaaauggcaauca

SEQ ID NO: 69627 - RNA, 19 nt, Artificial Sequence
  Oligomer
cuuuaguuugugaagcagc

SEQ ID NO: 69628 - RNA, 19 nt, Artificial Sequence
  Oligomer
augacugccacuucugaau

SEQ ID NO: 69629 - RNA, 19 nt, Artificial Sequence
  Oligomer
uguuguuguagcuuggcau

SEQ ID NO: 69630 - RNA, 19 nt, Artificial Sequence
  Oligomer
cuuggcauucugcucuuga

SEQ ID NO: 69631 - RNA, 19 nt, Artificial Sequence
  Oligomer
ugccuggucaguucuucua

SEQ ID NO: 69632 - RNA, 19 nt, Artificial Sequence
  Oligomer
uggucaguucuucuacuuu

SEQ ID NO: 69633 - RNA, 19 nt, Artificial Sequence
  Oligomer
guugcugggcuucaaucug

SEQ ID NO: 69634 - RNA, 19 nt, Artificial Sequence
  Oligomer
cuucaaucuguugcugcug

SEQ ID NO: 69635 - RNA, 19 nt, Artificial Sequence
  Oligomer
cagccuacaaacaagauuc

SEQ ID NO: 69636 - RNA, 19 nt, Artificial Sequence
  Oligomer
acaaucagagacagcgaug

SEQ ID NO: 69637 - RNA, 19 nt, Artificial Sequence
  Oligomer
auacuuaucugagugcuac

SEQ ID NO: 69638 - RNA, 19 nt, Artificial Sequence
  Oligomer
cuuuauuucaucacgcuaa

SEQ ID NO: 69639 - RNA, 19 nt, Artificial Sequence
  Oligomer
ucaucacgcuaaauguccu

SEQ ID NO: 69640 - RNA, 19 nt, Artificial Sequence
  Oligomer
gguuuaauucuuggguaca

SEQ ID NO: 69641 - RNA, 19 nt, Artificial Sequence
  Oligomer
uucuccugaacuccauaaa

SEQ ID NO: 69642 - RNA, 19 nt, Artificial Sequence
  Oligomer
aacuguaccaggaacuuaa

SEQ ID NO: 69643 - RNA, 19 nt, Artificial Sequence
  Oligomer
uccucugauauaaaagcuu

SEQ ID NO: 69644 - RNA, 19 nt, Artificial Sequence
  Oligomer
guuucuuucguaaggcuuc

SEQ ID NO: 69645 - RNA, 19 nt, Artificial Sequence
  Oligomer
aauuuaguugggcugagug

SEQ ID NO: 69646 - RNA, 19 nt, Artificial Sequence
  Oligomer
ucaugguucuccugaacug

SEQ ID NO: 69647 - RNA, 19 nt, Artificial Sequence
  Oligomer
ucugggcagcagcaauuac

SEQ ID NO: 69648 - RNA, 19 nt, Artificial Sequence
  Oligomer
uuagaaccuggagaaaggg

SEQ ID NO: 69649 - RNA, 19 nt, Artificial Sequence
  Oligomer
guuuaguucccauggacgg

SEQ ID NO: 69650 - RNA, 19 nt, Artificial Sequence
  Oligomer
auggacggaacaacuguug

SEQ ID NO: 69651 - RNA, 19 nt, Artificial Sequence
  Oligomer
uggcugauuaguuugucca

SEQ ID NO: 69652 - RNA, 19 nt, Artificial Sequence
  Oligomer
uuuguaggaacaggaggug

SEQ ID NO: 69653 - RNA, 19 nt, Artificial Sequence
  Oligomer
uauuugcaaccugagcauc

SEQ ID NO: 69654 - RNA, 19 nt, Artificial Sequence
  Oligomer
uugucucuucgacgcucgu

SEQ ID NO: 69655 - RNA, 21 nt, Artificial Sequence
  Oligomer
cgaugaagaaugucucuagaa

SEQ ID NO: 69656 - RNA, 21 nt, Artificial Sequence
  Oligomer
cuuacuuccacccuucagaaa

SEQ ID NO: 69657 - RNA, 21 nt, Artificial Sequence
  Oligomer
gaauuaaaccaagacaaagga

SEQ ID NO: 69658 - RNA, 21 nt, Artificial Sequence
  Oligomer
uacccaagaauuaaaccaaga

SEQ ID NO: 69659 - RNA, 21 nt, Artificial Sequence
  Oligomer
gggacuguacccaagaauuaa

SEQ ID NO: 69660 - RNA, 21 nt, Artificial Sequence
  Oligomer
gaugaugagcugcccaugaaa

SEQ ID NO: 69661 - RNA, 21 nt, Artificial Sequence
  Oligomer
cguugaccaagacucauacca

SEQ ID NO: 69662 - RNA, 21 nt, Artificial Sequence
  Oligomer
gaauaacccagaagaaccaaa

SEQ ID NO: 69663 - RNA, 21 nt, Artificial Sequence
  Oligomer
aggagaaccaugaaaacgaaa

SEQ ID NO: 69664 - RNA, 21 nt, Artificial Sequence
  Oligomer
gaaucaagagcagaaugccaa

SEQ ID NO: 69665 - RNA, 21 nt, Artificial Sequence
  Oligomer
caggcagcuagagaugcucaa

SEQ ID NO: 69666 - RNA, 21 nt, Artificial Sequence
  Oligomer
gcaccaaggccucuaaagaaa

SEQ ID NO: 69667 - RNA, 21 nt, Artificial Sequence
  Oligomer
uuacuuccacccuucagaaaa

SEQ ID NO: 69668 - RNA, 21 nt, Artificial Sequence
  Oligomer
gccugaaacuuccacacagaa

SEQ ID NO: 69669 - RNA, 21 nt, Artificial Sequence
  Oligomer
gaugcucagguugcaaauaaa

SEQ ID NO: 69670 - RNA, 21 nt, Artificial Sequence
  Oligomer
ggaugcucagguugcaaauaa

SEQ ID NO: 69671 - RNA, 21 nt, Artificial Sequence
  Oligomer
ggagggauauguuccacguaa

SEQ ID NO: 69672 - RNA, 21 nt, Artificial Sequence
  Oligomer
cauggauaagcguguuaauga

SEQ ID NO: 69673 - RNA, 21 nt, Artificial Sequence
  Oligomer
caucauacccauccaagucag

SEQ ID NO: 69674 - RNA, 21 nt, Artificial Sequence
  Oligomer
gcagaucuuuucccaagccaa

SEQ ID NO: 69675 - RNA, 21 nt, Artificial Sequence
  Oligomer
gaaucaacagcagcacccaga

SEQ ID NO: 69676 - RNA, 21 nt, Artificial Sequence
  Oligomer
aagagaaugaaggauugaaga

SEQ ID NO: 69677 - RNA, 21 nt, Artificial Sequence
  Oligomer
cuguacccaagaauuaaacca

SEQ ID NO: 69678 - RNA, 21 nt, Artificial Sequence
  Oligomer
caugcagacugcugcagauaa

SEQ ID NO: 69679 - RNA, 21 nt, Artificial Sequence
  Oligomer
agaugaugccgauguuucuua

SEQ ID NO: 69680 - RNA, 21 nt, Artificial Sequence
  Oligomer
gaaggcagcucuacagcaaaa

SEQ ID NO: 69681 - RNA, 21 nt, Artificial Sequence
  Oligomer
uaaggagcugcagcuaagaaa

SEQ ID NO: 69682 - RNA, 21 nt, Artificial Sequence
  Oligomer
gcugggacuguacccaagaau

SEQ ID NO: 69683 - RNA, 21 nt, Artificial Sequence
  Oligomer
ccugguacaguuugguguaaa

SEQ ID NO: 69684 - RNA, 21 nt, Artificial Sequence
  Oligomer
cauuuauugggcaguugggaa

SEQ ID NO: 69685 - RNA, 21 nt, Artificial Sequence
  Oligomer
acaagaauccugucuaguaaa

SEQ ID NO: 69686 - RNA, 21 nt, Artificial Sequence
  Oligomer
gaaggauugaagaauucacca

SEQ ID NO: 69687 - RNA, 21 nt, Artificial Sequence
  Oligomer
cauacccauccaagucagcuu

SEQ ID NO: 69688 - RNA, 21 nt, Artificial Sequence
  Oligomer
guuccguccaugggaacuaaa

SEQ ID NO: 69689 - RNA, 21 nt, Artificial Sequence
  Oligomer
ccaccuccuguuccuacaaaa

SEQ ID NO: 69690 - RNA, 21 nt, Artificial Sequence
  Oligomer
gaagaagaaggcagcucuaca

SEQ ID NO: 69691 - RNA, 21 nt, Artificial Sequence
  Oligomer
ccuguuccuacaaaaccaaaa

SEQ ID NO: 69692 - RNA, 21 nt, Artificial Sequence
  Oligomer
cagcucuacagcaaaaagaaa

SEQ ID NO: 69693 - RNA, 21 nt, Artificial Sequence
  Oligomer
gaucgacagccaccaugacaa

SEQ ID NO: 69694 - RNA, 21 nt, Artificial Sequence
  Oligomer
caacuaaggaacagcgcuuaa

SEQ ID NO: 69695 - RNA, 21 nt, Artificial Sequence
  Oligomer
caggauccaaguuuaaaaaga

SEQ ID NO: 69696 - RNA, 21 nt, Artificial Sequence
  Oligomer
gaucucaggauccaaguuuaa

SEQ ID NO: 69697 - RNA, 21 nt, Artificial Sequence
  Oligomer
ugaugaugagcugcccaugaa

SEQ ID NO: 69698 - RNA, 21 nt, Artificial Sequence
  Oligomer
aggagaagaugggcauaauga

SEQ ID NO: 69699 - RNA, 21 nt, Artificial Sequence
  Oligomer
cauccaagucagcuucuguga

SEQ ID NO: 69700 - RNA, 21 nt, Artificial Sequence
  Oligomer
gaugcugaccuagaagccuua

SEQ ID NO: 69701 - RNA, 21 nt, Artificial Sequence
  Oligomer
cccugauuggaguccuucaaa

SEQ ID NO: 69702 - RNA, 21 nt, Artificial Sequence
  Oligomer
aagagacuaagcaaugggaaa

SEQ ID NO: 69703 - RNA, 21 nt, Artificial Sequence
  Oligomer
caaugagcagcacuucacaga

SEQ ID NO: 69704 - RNA, 21 nt, Artificial Sequence
  Oligomer
gcugcagauaagugcgaggaa

SEQ ID NO: 69705 - RNA, 21 nt, Artificial Sequence
  Oligomer
gaaaauacagacacugcccaa

SEQ ID NO: 69706 - RNA, 21 nt, Artificial Sequence
  Oligomer
caagaucagcgacaacagcaa

SEQ ID NO: 69707 - RNA, 21 nt, Artificial Sequence
  Oligomer
gaaacaacaagaucagcgaca

SEQ ID NO: 69708 - RNA, 21 nt, Artificial Sequence
  Oligomer
ugaugagcugcccaugaaaga

SEQ ID NO: 69709 - RNA, 21 nt, Artificial Sequence
  Oligomer
agaccguggcagcaaguucaa

SEQ ID NO: 69710 - RNA, 21 nt, Artificial Sequence
  Oligomer
guccaugggaacuaaaccaaa

SEQ ID NO: 69711 - RNA, 21 nt, Artificial Sequence
  Oligomer
gcagcuagagaugcucaagaa

SEQ ID NO: 69712 - RNA, 21 nt, Artificial Sequence
  Oligomer
guugguugucagugaacaaua

SEQ ID NO: 69713 - RNA, 21 nt, Artificial Sequence
  Oligomer
agagcagaaugccaagcuaca

SEQ ID NO: 69714 - RNA, 21 nt, Artificial Sequence
  Oligomer
gaaauagcugagaaucaggaa

SEQ ID NO: 69715 - RNA, 21 nt, Artificial Sequence
  Oligomer
cagacauuaagccagacggaa

SEQ ID NO: 69716 - RNA, 21 nt, Artificial Sequence
  Oligomer
ggaucaaguugaugauggaga

SEQ ID NO: 69717 - RNA, 21 nt, Artificial Sequence
  Oligomer
cguguagcacucagauaagua

SEQ ID NO: 69718 - RNA, 21 nt, Artificial Sequence
  Oligomer
ggaagacgaagaugaaaucga

SEQ ID NO: 69719 - RNA, 21 nt, Artificial Sequence
  Oligomer
gaccaagaucucaggauccaa

SEQ ID NO: 69720 - RNA, 21 nt, Artificial Sequence
  Oligomer
cccagaagaaccaaauccaga

SEQ ID NO: 69721 - RNA, 21 nt, Artificial Sequence
  Oligomer
aguagaaauccagaauccaua

SEQ ID NO: 69722 - RNA, 21 nt, Artificial Sequence
  Oligomer
ccagagaacauuuauuccaau

SEQ ID NO: 69723 - RNA, 21 nt, Artificial Sequence
  Oligomer
cguccaugggaacuaaaccaa

SEQ ID NO: 69724 - RNA, 21 nt, Artificial Sequence
  Oligomer
cacgagcgucgaagagacaaa

SEQ ID NO: 69725 - RNA, 21 nt, Artificial Sequence
  Oligomer
gaaugcucuggaucaaguuga

SEQ ID NO: 69726 - RNA, 21 nt, Artificial Sequence
  Oligomer
caagcuacaacaacagaggga

SEQ ID NO: 69727 - RNA, 21 nt, Artificial Sequence
  Oligomer
gagcugcagcuaagaaacaaa

SEQ ID NO: 69728 - RNA, 21 nt, Artificial Sequence
  Oligomer
agcugagaaucaggaagcuaa

SEQ ID NO: 69729 - RNA, 21 nt, Artificial Sequence
  Oligomer
caagaauccugucuaguaaau

SEQ ID NO: 69730 - RNA, 21 nt, Artificial Sequence
  Oligomer
caguccagaaccugaaacaga

SEQ ID NO: 69731 - RNA, 21 nt, Artificial Sequence
  Oligomer
uguaauugcugcugcccagaa

SEQ ID NO: 69732 - RNA, 21 nt, Artificial Sequence
  Oligomer
acagcaggcgccaggaaaaaa

SEQ ID NO: 69733 - RNA, 21 nt, Artificial Sequence
  Oligomer
ugagcuugaucgccucuauaa

SEQ ID NO: 69734 - RNA, 21 nt, Artificial Sequence
  Oligomer
gauggaucugacucuugcuga

SEQ ID NO: 69735 - RNA, 21 nt, Artificial Sequence
  Oligomer
caagaucauagcugacuuuaa

SEQ ID NO: 69736 - RNA, 21 nt, Artificial Sequence
  Oligomer
agauaagugcgaggaaaugga

SEQ ID NO: 69737 - RNA, 21 nt, Artificial Sequence
  Oligomer
ucccaucauacccauccaagu

SEQ ID NO: 69738 - RNA, 21 nt, Artificial Sequence
  Oligomer
gggccacacuuuucaagugua

SEQ ID NO: 69739 - RNA, 21 nt, Artificial Sequence
  Oligomer
cuuucuccagguucuaagcaa

SEQ ID NO: 69740 - RNA, 21 nt, Artificial Sequence
  Oligomer
agaaagugcguccguucucaa

SEQ ID NO: 69741 - RNA, 21 nt, Artificial Sequence
  Oligomer
cgcugagggagaaagagaaga

SEQ ID NO: 69742 - RNA, 21 nt, Artificial Sequence
  Oligomer
ggcucugcuucuguaccucaa

SEQ ID NO: 69743 - RNA, 21 nt, Artificial Sequence
  Oligomer
agcucuacagcaaaaagaaaa

SEQ ID NO: 69744 - RNA, 21 nt, Artificial Sequence
  Oligomer
ggcagcucuacagcaaaaaga

SEQ ID NO: 69745 - RNA, 21 nt, Artificial Sequence
  Oligomer
caaugggaaacuuguggagga

SEQ ID NO: 69746 - RNA, 21 nt, Artificial Sequence
  Oligomer
caacaauugcuggcaacuaag

SEQ ID NO: 69747 - RNA, 21 nt, Artificial Sequence
  Oligomer
gcaacaauugcuggcaacuaa

SEQ ID NO: 69748 - RNA, 21 nt, Artificial Sequence
  Oligomer
cgcuguguuugccaugaccua

SEQ ID NO: 69749 - RNA, 21 nt, Artificial Sequence
  Oligomer
aauuugaccuuguacagagaa

SEQ ID NO: 69750 - RNA, 21 nt, Artificial Sequence
  Oligomer
gucuuuggagggagaauuuga

SEQ ID NO: 69751 - RNA, 21 nt, Artificial Sequence
  Oligomer
cagagcguaucgcucauggaa

SEQ ID NO: 69752 - RNA, 21 nt, Artificial Sequence
  Oligomer
ggaagucagaggaacgaaguu

SEQ ID NO: 69753 - RNA, 21 nt, Artificial Sequence
  Oligomer
uacccauccaagucagcuucu

SEQ ID NO: 69754 - RNA, 21 nt, Artificial Sequence
  Oligomer
caggagaaccaugaaaacgaa

SEQ ID NO: 69755 - RNA, 21 nt, Artificial Sequence
  Oligomer
cccagagaacauuuauuccaa

SEQ ID NO: 69756 - RNA, 21 nt, Artificial Sequence
  Oligomer
ucaacagcagcacccagagaa

SEQ ID NO: 69757 - RNA, 21 nt, Artificial Sequence
  Oligomer
gagugauugccauuuggcuga

SEQ ID NO: 69758 - RNA, 21 nt, Artificial Sequence
  Oligomer
ugcucagguugcaaauaaaaa

SEQ ID NO: 69759 - RNA, 21 nt, Artificial Sequence
  Oligomer
gcacuuaaaggccacguggaa

SEQ ID NO: 69760 - RNA, 21 nt, Artificial Sequence
  Oligomer
gcuugauguguaccuggagga

SEQ ID NO: 69761 - RNA, 21 nt, Artificial Sequence
  Oligomer
cugugacugccagcucagaaa

SEQ ID NO: 69762 - RNA, 21 nt, Artificial Sequence
  Oligomer
ugaccuagaagccuuacgaaa

SEQ ID NO: 69763 - RNA, 21 nt, Artificial Sequence
  Oligomer
ccagagugaugcugaccuaga

SEQ ID NO: 69764 - RNA, 21 nt, Artificial Sequence
  Oligomer
ucacgagcgucgaagagacaa

SEQ ID NO: 69765 - RNA, 21 nt, Artificial Sequence
  Oligomer
cgugguggaucugugcaaaga

SEQ ID NO: 69766 - RNA, 21 nt, Artificial Sequence
  Oligomer
gauuggaguccuucaaaugca

SEQ ID NO: 69767 - RNA, 21 nt, Artificial Sequence
  Oligomer
gaaacuuguggaggaaauuga

SEQ ID NO: 69768 - RNA, 21 nt, Artificial Sequence
  Oligomer
gcuacagacuuacccguaaua

SEQ ID NO: 69769 - RNA, 21 nt, Artificial Sequence
  Oligomer
ggcaaaaauuucacaagacuu

SEQ ID NO: 69770 - RNA, 21 nt, Artificial Sequence
  Oligomer
gugggcgcgccuuaaugauaa

SEQ ID NO: 69771 - RNA, 21 nt, Artificial Sequence
  Oligomer
gaaugaugaugagcugcccau

SEQ ID NO: 69772 - RNA, 21 nt, Artificial Sequence
  Oligomer
ggaugguuccuuggucauuca

SEQ ID NO: 69773 - RNA, 21 nt, Artificial Sequence
  Oligomer
acagauugaagcccagcaaca

SEQ ID NO: 69774 - RNA, 21 nt, Artificial Sequence
  Oligomer
cagcgacaauccuguuuucua

SEQ ID NO: 69775 - RNA, 21 nt, Artificial Sequence
  Oligomer
agaaggagacugcaugacaau

SEQ ID NO: 69776 - RNA, 21 nt, Artificial Sequence
  Oligomer
agugauggauggacuccauua

SEQ ID NO: 69777 - RNA, 21 nt, Artificial Sequence
  Oligomer
cgaaagaaacugucuaacgca

SEQ ID NO: 69778 - RNA, 21 nt, Artificial Sequence
  Oligomer
gccuguuucuucaguucagga

SEQ ID NO: 69779 - RNA, 21 nt, Artificial Sequence
  Oligomer
cagccuuccaaagacaccuua

SEQ ID NO: 69780 - RNA, 21 nt, Artificial Sequence
  Oligomer
gguucuaagcaagaaagucca

SEQ ID NO: 69781 - RNA, 21 nt, Artificial Sequence
  Oligomer
cacugggaaugcucuggauca

SEQ ID NO: 69782 - RNA, 21 nt, Artificial Sequence
  Oligomer
aacuaaaggcucuaaaaucca

SEQ ID NO: 69783 - RNA, 21 nt, Artificial Sequence
  Oligomer
gaaguuccaguuacuccagaa

SEQ ID NO: 69784 - RNA, 21 nt, Artificial Sequence
  Oligomer
cugagcuugaucgccucuaua

SEQ ID NO: 69785 - RNA, 21 nt, Artificial Sequence
  Oligomer
ggcagcuagagaugcucaaga

SEQ ID NO: 69786 - RNA, 21 nt, Artificial Sequence
  Oligomer
agaacugaccaggcagcuaga

SEQ ID NO: 69787 - RNA, 21 nt, Artificial Sequence
  Oligomer
guaacaaugagcagcacuuca

SEQ ID NO: 69788 - RNA, 21 nt, Artificial Sequence
  Oligomer
guagcuugaaagcgaugaaga

SEQ ID NO: 69789 - RNA, 21 nt, Artificial Sequence
  Oligomer
agaauuaaaccaagacaaagg

SEQ ID NO: 69790 - RNA, 21 nt, Artificial Sequence
  Oligomer
ugggacuguacccaagaauua

SEQ ID NO: 69791 - RNA, 21 nt, Artificial Sequence
  Oligomer
aggaaauggaggaaggcuaca

SEQ ID NO: 69792 - RNA, 21 nt, Artificial Sequence
  Oligomer
agaggcuccacaugugcuuga

SEQ ID NO: 69793 - RNA, 21 nt, Artificial Sequence
  Oligomer
agcucagaaagcccaguagaa

SEQ ID NO: 69794 - RNA, 21 nt, Artificial Sequence
  Oligomer
cgcaccaaggccucuaaagaa

SEQ ID NO: 69795 - RNA, 21 nt, Artificial Sequence
  Oligomer
acagcagcacccagagaacau

SEQ ID NO: 69796 - RNA, 21 nt, Artificial Sequence
  Oligomer
accuuacuuccacccuucaga

SEQ ID NO: 69797 - RNA, 21 nt, Artificial Sequence
  Oligomer
cuuugguacucugaggaagaa

SEQ ID NO: 69798 - RNA, 21 nt, Artificial Sequence
  Oligomer
ggcugcaguaggucccuauau

SEQ ID NO: 69799 - RNA, 21 nt, Artificial Sequence
  Oligomer
accaguuucaucugauggaaa

SEQ ID NO: 69800 - RNA, 21 nt, Artificial Sequence
  Oligomer
acuuguggaggaaauugaaca

SEQ ID NO: 69801 - RNA, 21 nt, Artificial Sequence
  Oligomer
gcaacaaguugcugagcagga

SEQ ID NO: 69802 - RNA, 21 nt, Artificial Sequence
  Oligomer
gacucuugcugaacuucagga

SEQ ID NO: 69803 - RNA, 21 nt, Artificial Sequence
  Oligomer
uggugaauaucgaagaaagga

SEQ ID NO: 69804 - RNA, 21 nt, Artificial Sequence
  Oligomer
aaguuccuggugaauaucgaa

SEQ ID NO: 69805 - RNA, 21 nt, Artificial Sequence
  Oligomer
ucuuuauggaguucaggagaa

SEQ ID NO: 69806 - RNA, 21 nt, Artificial Sequence
  Oligomer
uaacaacguccaaguguguaa

SEQ ID NO: 69807 - RNA, 21 nt, Artificial Sequence
  Oligomer
uaaugggccaaauauucagaa

SEQ ID NO: 69808 - RNA, 21 nt, Artificial Sequence
  Oligomer
agaggguccuaaugggccaaa

SEQ ID NO: 69809 - RNA, 21 nt, Artificial Sequence
  Oligomer
cuggcaguccagaaccugaaa

SEQ ID NO: 69810 - RNA, 21 nt, Artificial Sequence
  Oligomer
gacccuuucuccagguucuaa

SEQ ID NO: 69811 - RNA, 21 nt, Artificial Sequence
  Oligomer
uccuguuccuacaaaaccaaa

SEQ ID NO: 69812 - RNA, 21 nt, Artificial Sequence
  Oligomer
ucaagaacggcaggaucgaca

SEQ ID NO: 69813 - RNA, 21 nt, Artificial Sequence
  Oligomer
augggaaacuuguggaggaaa

SEQ ID NO: 69814 - RNA, 21 nt, Artificial Sequence
  Oligomer
uaaaggccacguggaacagaa

SEQ ID NO: 69815 - RNA, 21 nt, Artificial Sequence
  Oligomer
cgacaauccuguuuucuacaa

SEQ ID NO: 69816 - RNA, 21 nt, Artificial Sequence
  Oligomer
gaagaaugucucuagaagaga

SEQ ID NO: 69817 - RNA, 21 nt, Artificial Sequence
  Oligomer
caugaaagaaggagacugcau

SEQ ID NO: 69818 - RNA, 21 nt, Artificial Sequence
  Oligomer
gcucauggaaugagggugaaa

SEQ ID NO: 69819 - RNA, 21 nt, Artificial Sequence
  Oligomer
aguucaggagaaccaugaaaa

SEQ ID NO: 69820 - RNA, 21 nt, Artificial Sequence
  Oligomer
cuuggucauucaggcuucaga

SEQ ID NO: 69821 - RNA, 21 nt, Artificial Sequence
  Oligomer
gaugguuccuuggucauucag

SEQ ID NO: 69822 - RNA, 21 nt, Artificial Sequence
  Oligomer
caauguagcuugaaagcgaug

SEQ ID NO: 69823 - RNA, 21 nt, Artificial Sequence
  Oligomer
gagcuuggccugaaacuucca

SEQ ID NO: 69824 - RNA, 21 nt, Artificial Sequence
  Oligomer
ccuuaaugauaaggagggaua

SEQ ID NO: 69825 - RNA, 21 nt, Artificial Sequence
  Oligomer
aaucguuaaguuccugguaca

SEQ ID NO: 69826 - RNA, 21 nt, Artificial Sequence
  Oligomer
cuuaucuaauccuuaccgaaa

SEQ ID NO: 69827 - RNA, 21 nt, Artificial Sequence
  Oligomer
ggcaguccagaaccugaaaca

SEQ ID NO: 69828 - RNA, 21 nt, Artificial Sequence
  Oligomer
gaacguccaguugcggauaau

SEQ ID NO: 69829 - RNA, 21 nt, Artificial Sequence
  Oligomer
cuuccacccuucagaaaaccc

SEQ ID NO: 69830 - RNA, 21 nt, Artificial Sequence
  Oligomer
gaagaaggcagcucuacagca

SEQ ID NO: 69831 - RNA, 21 nt, Artificial Sequence
  Oligomer
gaaugccaagcuacaacaaca

SEQ ID NO: 69832 - RNA, 21 nt, Artificial Sequence
  Oligomer
cagaaugccaagcuacaacaa

SEQ ID NO: 69833 - RNA, 21 nt, Artificial Sequence
  Oligomer
gcagaaugccaagcuacaaca

SEQ ID NO: 69834 - RNA, 21 nt, Artificial Sequence
  Oligomer
auaaggagcugcagcuaagaa

SEQ ID NO: 69835 - RNA, 21 nt, Artificial Sequence
  Oligomer
ucuauaaggagcugcagcuaa

SEQ ID NO: 69836 - RNA, 21 nt, Artificial Sequence
  Oligomer
caaucagucugcaguggcuga

SEQ ID NO: 69837 - RNA, 21 nt, Artificial Sequence
  Oligomer
auuuguuccagcaaaaacaga

SEQ ID NO: 69838 - RNA, 21 nt, Artificial Sequence
  Oligomer
gguugucagugaacaauaacu

SEQ ID NO: 69839 - RNA, 21 nt, Artificial Sequence
  Oligomer
uagcuugaaagcgaugaagaa

SEQ ID NO: 69840 - RNA, 21 nt, Artificial Sequence
  Oligomer
ccaugaaagaaggagacugca

SEQ ID NO: 69841 - RNA, 21 nt, Artificial Sequence
  Oligomer
gggacauugugaguggaccaa

SEQ ID NO: 69842 - RNA, 21 nt, Artificial Sequence
  Oligomer
ugcagauaagugcgaggaaau

SEQ ID NO: 69843 - RNA, 21 nt, Artificial Sequence
  Oligomer
ugaccuacagugacaugcaga

SEQ ID NO: 69844 - RNA, 21 nt, Artificial Sequence
  Oligomer
gguacaguuugguguaaaugu

SEQ ID NO: 69845 - RNA, 21 nt, Artificial Sequence
  Oligomer
gguccuaaugggccaaauauu

SEQ ID NO: 69846 - RNA, 21 nt, Artificial Sequence
  Oligomer
ggguccuaaugggccaaauau

SEQ ID NO: 69847 - RNA, 21 nt, Artificial Sequence
  Oligomer
cguaguucuauuacagagcca

SEQ ID NO: 69848 - RNA, 21 nt, Artificial Sequence
  Oligomer
caguucaggagaaccaugaaa

SEQ ID NO: 69849 - RNA, 21 nt, Artificial Sequence
  Oligomer
cguccaguugcggauaaugag

SEQ ID NO: 69850 - RNA, 21 nt, Artificial Sequence
  Oligomer
uugaccaagacucauaccaga

SEQ ID NO: 69851 - RNA, 21 nt, Artificial Sequence
  Oligomer
gagggagaaagagaagaaagu

SEQ ID NO: 69852 - RNA, 21 nt, Artificial Sequence
  Oligomer
aggagcugcagcuaagaaaca

SEQ ID NO: 69853 - RNA, 21 nt, Artificial Sequence
  Oligomer
acuuaaaggccacguggaaca

SEQ ID NO: 69854 - RNA, 21 nt, Artificial Sequence
  Oligomer
auuuauugggcaguugggaaa

SEQ ID NO: 69855 - RNA, 21 nt, Artificial Sequence
  Oligomer
ccugaaacuuccacacagaau

SEQ ID NO: 69856 - RNA, 21 nt, Artificial Sequence
  Oligomer
aggagggauauguuccacgua

SEQ ID NO: 69857 - RNA, 21 nt, Artificial Sequence
  Oligomer
aagacgaagaugaaaucgaau

SEQ ID NO: 69858 - RNA, 21 nt, Artificial Sequence
  Oligomer
gacauugugaguggaccaaga

SEQ ID NO: 69859 - RNA, 21 nt, Artificial Sequence
  Oligomer
gcuacacucagugcucccaau

SEQ ID NO: 69860 - RNA, 21 nt, Artificial Sequence
  Oligomer
auggaaugagggugaaauuca

SEQ ID NO: 69861 - RNA, 21 nt, Artificial Sequence
  Oligomer
guggucucucugguuccugaa

SEQ ID NO: 69862 - RNA, 21 nt, Artificial Sequence
  Oligomer
gccacacuuuucaaguguaua

SEQ ID NO: 69863 - RNA, 21 nt, Artificial Sequence
  Oligomer
aacuaaucagccaccuucaga

SEQ ID NO: 69864 - RNA, 21 nt, Artificial Sequence
  Oligomer
agucgucuacuaugccucgga

SEQ ID NO: 69865 - RNA, 21 nt, Artificial Sequence
  Oligomer
agaaauagcugagaaucagga

SEQ ID NO: 69866 - RNA, 21 nt, Artificial Sequence
  Oligomer
gauugaagcccagcaacaauu

SEQ ID NO: 69867 - RNA, 21 nt, Artificial Sequence
  Oligomer
ggugaauaucgaagaaaggag

SEQ ID NO: 69868 - RNA, 21 nt, Artificial Sequence
  Oligomer
uaugcgcuuugggauuaugaa

SEQ ID NO: 69869 - RNA, 21 nt, Artificial Sequence
  Oligomer
gacugcugcagauaagugcga

SEQ ID NO: 69870 - RNA, 21 nt, Artificial Sequence
  Oligomer
guaacaacguccaagugugua

SEQ ID NO: 69871 - RNA, 21 nt, Artificial Sequence
  Oligomer
cugguacaguuugguguaaau

SEQ ID NO: 69872 - RNA, 21 nt, Artificial Sequence
  Oligomer
aggcaucacggcucuucacaa

SEQ ID NO: 69873 - RNA, 21 nt, Artificial Sequence
  Oligomer
cgcucauggaaugagggugaa

SEQ ID NO: 69874 - RNA, 21 nt, Artificial Sequence
  Oligomer
gcucagaaagcccaguagaaa

SEQ ID NO: 69875 - RNA, 21 nt, Artificial Sequence
  Oligomer
cugaccuagaagccuuacgaa

SEQ ID NO: 69876 - RNA, 21 nt, Artificial Sequence
  Oligomer
aagacucauaccagagggcca

SEQ ID NO: 69877 - RNA, 21 nt, Artificial Sequence
  Oligomer
caccuuacuuccacccuucag

SEQ ID NO: 69878 - RNA, 21 nt, Artificial Sequence
  Oligomer
uggaguccuucaaaugcagau

SEQ ID NO: 69879 - RNA, 21 nt, Artificial Sequence
  Oligomer
ccugauuggaguccuucaaau

SEQ ID NO: 69880 - RNA, 21 nt, Artificial Sequence
  Oligomer
cagacacugcccaacaugaga

SEQ ID NO: 69881 - RNA, 21 nt, Artificial Sequence
  Oligomer
ccaguuucaucugauggaaau

SEQ ID NO: 69882 - RNA, 21 nt, Artificial Sequence
  Oligomer
cuaccaguuucaucugaugga

SEQ ID NO: 69883 - RNA, 21 nt, Artificial Sequence
  Oligomer
gcuugaucgccucuauaagga

SEQ ID NO: 69884 - RNA, 21 nt, Artificial Sequence
  Oligomer
agaucagcgacaacagcaaca

SEQ ID NO: 69885 - RNA, 21 nt, Artificial Sequence
  Oligomer
gguccaagaugaugccgaugu

SEQ ID NO: 69886 - RNA, 21 nt, Artificial Sequence
  Oligomer
guuaguugguugucagugaac

SEQ ID NO: 69887 - RNA, 21 nt, Artificial Sequence
  Oligomer
aaccaguccuccugccagaaa

SEQ ID NO: 69888 - RNA, 21 nt, Artificial Sequence
  Oligomer
ugguguaaaaguuccugguga

SEQ ID NO: 69889 - RNA, 21 nt, Artificial Sequence
  Oligomer
agaaugucucuagaagagaau

SEQ ID NO: 69890 - RNA, 21 nt, Artificial Sequence
  Oligomer
cugggacuguacccaagaauu

SEQ ID NO: 69891 - RNA, 21 nt, Artificial Sequence
  Oligomer
ugcugggacuguacccaagaa

SEQ ID NO: 69892 - RNA, 21 nt, Artificial Sequence
  Oligomer
cuguguuugccaugaccuaca

SEQ ID NO: 69893 - RNA, 21 nt, Artificial Sequence
  Oligomer
ccauuacauugugcugccuca

SEQ ID NO: 69894 - RNA, 21 nt, Artificial Sequence
  Oligomer
gauggauggacuccauuacau

SEQ ID NO: 69895 - RNA, 21 nt, Artificial Sequence
  Oligomer
cguuaaguuccugguacaguu

SEQ ID NO: 69896 - RNA, 21 nt, Artificial Sequence
  Oligomer
acauguggagcccgaaaagga

SEQ ID NO: 69897 - RNA, 21 nt, Artificial Sequence
  Oligomer
ucauacccauccaagucagcu

SEQ ID NO: 69898 - RNA, 21 nt, Artificial Sequence
  Oligomer
guuugauguucuucaacgauu

SEQ ID NO: 69899 - RNA, 21 nt, Artificial Sequence
  Oligomer
agcuuuuauaucagaggacca

SEQ ID NO: 69900 - RNA, 21 nt, Artificial Sequence
  Oligomer
aguagaagaacugaccaggca

SEQ ID NO: 69901 - RNA, 21 nt, Artificial Sequence
  Oligomer
caauugcuggcaacuaaggaa

SEQ ID NO: 69902 - RNA, 21 nt, Artificial Sequence
  Oligomer
aucucaggauccaaguuuaaa

SEQ ID NO: 69903 - RNA, 21 nt, Artificial Sequence
  Oligomer
aagaaggagacugcaugacaa

SEQ ID NO: 69904 - RNA, 21 nt, Artificial Sequence
  Oligomer
gcuuugggauuaugaaccuca

SEQ ID NO: 69905 - RNA, 21 nt, Artificial Sequence
  Oligomer
agucauuuaugcgcuuuggga

SEQ ID NO: 69906 - RNA, 21 nt, Artificial Sequence
  Oligomer
cauugugcugccucauguaac

SEQ ID NO: 69907 - RNA, 21 nt, Artificial Sequence
  Oligomer
gagaauuugaccuuguacaga

SEQ ID NO: 69908 - RNA, 21 nt, Artificial Sequence
  Oligomer
acugcuagauucgucuuugga

SEQ ID NO: 69909 - RNA, 21 nt, Artificial Sequence
  Oligomer
uuuacauguggagcccgaaaa

SEQ ID NO: 69910 - RNA, 21 nt, Artificial Sequence
  Oligomer
aucauacccauccaagucagc

SEQ ID NO: 69911 - RNA, 21 nt, Artificial Sequence
  Oligomer
agaccaucucugucccaucau

SEQ ID NO: 69912 - RNA, 21 nt, Artificial Sequence
  Oligomer
caguugcggauaaugagcgaa

SEQ ID NO: 69913 - RNA, 21 nt, Artificial Sequence
  Oligomer
ccuccuguuccuacaaaacca

SEQ ID NO: 69914 - RNA, 21 nt, Artificial Sequence
  Oligomer
ugaugcaguagaccaguccaa

SEQ ID NO: 69915 - RNA, 21 nt, Artificial Sequence
  Oligomer
acuaaaggcucuaaaauccau

SEQ ID NO: 69916 - RNA, 21 nt, Artificial Sequence
  Oligomer
ccugaauugcuggugaagcca

SEQ ID NO: 69917 - RNA, 21 nt, Artificial Sequence
  Oligomer
acuccagaaacaauaugcaga

SEQ ID NO: 69918 - RNA, 21 nt, Artificial Sequence
  Oligomer
caagaugaugccgauguuucu

SEQ ID NO: 69919 - RNA, 21 nt, Artificial Sequence
  Oligomer
aacagagggaguguuugaaua

SEQ ID NO: 69920 - RNA, 21 nt, Artificial Sequence
  Oligomer
agaaguuccaguuacuccaga

SEQ ID NO: 69921 - RNA, 21 nt, Artificial Sequence
  Oligomer
aaggccacguggaacagaaga

SEQ ID NO: 69922 - RNA, 21 nt, Artificial Sequence
  Oligomer
gcuaaaagaaauagcugagaa

SEQ ID NO: 69923 - RNA, 21 nt, Artificial Sequence
  Oligomer
acaagaucagcgacaacagca

SEQ ID NO: 69924 - RNA, 21 nt, Artificial Sequence
  Oligomer
guuccuggugaauaucgaaga

SEQ ID NO: 69925 - RNA, 21 nt, Artificial Sequence
  Oligomer
ggccugaaacuuccacacaga

SEQ ID NO: 69926 - RNA, 21 nt, Artificial Sequence
  Oligomer
gcuuggccugaaacuuccaca

SEQ ID NO: 69927 - RNA, 21 nt, Artificial Sequence
  Oligomer
gagggauauguuccacguaac

SEQ ID NO: 69928 - RNA, 21 nt, Artificial Sequence
  Oligomer
gauuaugaaccucagaaugau

SEQ ID NO: 69929 - RNA, 21 nt, Artificial Sequence
  Oligomer
aguucaggagaagaugggcau

SEQ ID NO: 69930 - RNA, 21 nt, Artificial Sequence
  Oligomer
cacucagugcucccaauuucu

SEQ ID NO: 69931 - RNA, 21 nt, Artificial Sequence
  Oligomer
gucucucugccuccugguaaa

SEQ ID NO: 69932 - RNA, 21 nt, Artificial Sequence
  Oligomer
uauuuacauguggagcccgaa

SEQ ID NO: 69933 - RNA, 21 nt, Artificial Sequence
  Oligomer
caguagaaauccagaauccau

SEQ ID NO: 69934 - RNA, 21 nt, Artificial Sequence
  Oligomer
ggccacucagcccaacuaaau

SEQ ID NO: 69935 - RNA, 21 nt, Artificial Sequence
  Oligomer
ccaguugcggauaaugagcga

SEQ ID NO: 69936 - RNA, 21 nt, Artificial Sequence
  Oligomer
cuccagguucuaagcaagaaa

SEQ ID NO: 69937 - RNA, 21 nt, Artificial Sequence
  Oligomer
ccaugggaacuaaaccaaaac

SEQ ID NO: 69938 - RNA, 21 nt, Artificial Sequence
  Oligomer
ucagccaccuucagacauuaa

SEQ ID NO: 69939 - RNA, 21 nt, Artificial Sequence
  Oligomer
cuccuguuccuacaaaaccaa

SEQ ID NO: 69940 - RNA, 21 nt, Artificial Sequence
  Oligomer
guaccaccuccuguuccuaca

SEQ ID NO: 69941 - RNA, 21 nt, Artificial Sequence
  Oligomer
ggcuaaaguaccaccuccugu

SEQ ID NO: 69942 - RNA, 21 nt, Artificial Sequence
  Oligomer
cucaauguuugaugcaguaga

SEQ ID NO: 69943 - RNA, 21 nt, Artificial Sequence
  Oligomer
gucccuauauccagucgucua

SEQ ID NO: 69944 - RNA, 21 nt, Artificial Sequence
  Oligomer
gcaguaggucccuauauccag

SEQ ID NO: 69945 - RNA, 21 nt, Artificial Sequence
  Oligomer
ugcaguaggucccuauaucca

SEQ ID NO: 69946 - RNA, 21 nt, Artificial Sequence
  Oligomer
cagauugaagcccagcaacaa

SEQ ID NO: 69947 - RNA, 21 nt, Artificial Sequence
  Oligomer
uauugaaacuaagcuacggua

SEQ ID NO: 69948 - RNA, 21 nt, Artificial Sequence
  Oligomer
cuguuaguugguugucaguga

SEQ ID NO: 69949 - RNA, 21 nt, Artificial Sequence
  Oligomer
cuacaagaauccugucuagua

SEQ ID NO: 69950 - RNA, 21 nt, Artificial Sequence
  Oligomer
aaagaaggagacugcaugaca

SEQ ID NO: 69951 - RNA, 21 nt, Artificial Sequence
  Oligomer
uuaugaaccucagaaugauga

SEQ ID NO: 69952 - RNA, 21 nt, Artificial Sequence
  Oligomer
cauguaacaacguccaagugu

SEQ ID NO: 69953 - RNA, 21 nt, Artificial Sequence
  Oligomer
gacaaacuugcguaaaacugg

SEQ ID NO: 69954 - RNA, 21 nt, Artificial Sequence
  Oligomer
ugugcuugauguguaccugga

SEQ ID NO: 69955 - RNA, 21 nt, Artificial Sequence
  Oligomer
cuugauuaugagccugaggga

SEQ ID NO: 69956 - RNA, 21 nt, Artificial Sequence
  Oligomer
gccgauguuucuuaccgugua

SEQ ID NO: 69957 - RNA, 21 nt, Artificial Sequence
  Oligomer
cucugucccaucauacccauc

SEQ ID NO: 69958 - RNA, 21 nt, Artificial Sequence
  Oligomer
ggccaaauauucagaagcuuu

SEQ ID NO: 69959 - RNA, 21 nt, Artificial Sequence
  Oligomer
ccuaaugggccaaauauucag

SEQ ID NO: 69960 - RNA, 21 nt, Artificial Sequence
  Oligomer
uccaugggaacuaaaccaaaa

SEQ ID NO: 69961 - RNA, 21 nt, Artificial Sequence
  Oligomer
ccguccaugggaacuaaacca

SEQ ID NO: 69962 - RNA, 21 nt, Artificial Sequence
  Oligomer
gaggaagaaccagagcaguga

SEQ ID NO: 69963 - RNA, 21 nt, Artificial Sequence
  Oligomer
uuggaguccuucaaaugcaga

SEQ ID NO: 69964 - RNA, 21 nt, Artificial Sequence
  Oligomer
aagcguaauucagaaguggca

SEQ ID NO: 69965 - RNA, 21 nt, Artificial Sequence
  Oligomer
aaggcuaaaagaaauagcuga

SEQ ID NO: 69966 - RNA, 21 nt, Artificial Sequence
  Oligomer
aacaaguugcugagcaggaga

SEQ ID NO: 69967 - RNA, 21 nt, Artificial Sequence
  Oligomer
aaaccaguccuccugccagaa

SEQ ID NO: 69968 - RNA, 21 nt, Artificial Sequence
  Oligomer
guuuucagcagcugcuccuaa

SEQ ID NO: 69969 - RNA, 21 nt, Artificial Sequence
  Oligomer
uguaaaaguuccuggugaaua

SEQ ID NO: 69970 - RNA, 21 nt, Artificial Sequence
  Oligomer
gacaauguagcuugaaagcga

SEQ ID NO: 69971 - RNA, 21 nt, Artificial Sequence
  Oligomer
cauccacagggaagacgaaga

SEQ ID NO: 69972 - RNA, 21 nt, Artificial Sequence
  Oligomer
gagcugcccaugaaagaagga

SEQ ID NO: 69973 - RNA, 21 nt, Artificial Sequence
  Oligomer
augggcauaaugaauaaagga

SEQ ID NO: 69974 - RNA, 21 nt, Artificial Sequence
  Oligomer
ugauggauggacuccauuaca

SEQ ID NO: 69975 - RNA, 21 nt, Artificial Sequence
  Oligomer
cguaaaacuggcucagagcgu

SEQ ID NO: 69976 - RNA, 21 nt, Artificial Sequence
  Oligomer
ugauuaugagccugagggagu

SEQ ID NO: 69977 - RNA, 21 nt, Artificial Sequence
  Oligomer
auuuacauguggagcccgaaa

SEQ ID NO: 69978 - RNA, 21 nt, Artificial Sequence
  Oligomer
ccaguagaaauccagaaucca

SEQ ID NO: 69979 - RNA, 21 nt, Artificial Sequence
  Oligomer
ugaccaagacucauaccagag

SEQ ID NO: 69980 - RNA, 21 nt, Artificial Sequence
  Oligomer
uacuuccacccuucagaaaac

SEQ ID NO: 69981 - RNA, 21 nt, Artificial Sequence
  Oligomer
caguuguuccguccaugggaa

SEQ ID NO: 69982 - RNA, 21 nt, Artificial Sequence
  Oligomer
augcucagguugcaaauaaaa

SEQ ID NO: 69983 - RNA, 21 nt, Artificial Sequence
  Oligomer
gaugcaguagaccaguccaau

SEQ ID NO: 69984 - RNA, 21 nt, Artificial Sequence
  Oligomer
ugggaaugcucuggaucaagu

SEQ ID NO: 69985 - RNA, 21 nt, Artificial Sequence
  Oligomer
ccuauauccagucgucuacua

SEQ ID NO: 69986 - RNA, 21 nt, Artificial Sequence
  Oligomer
ccaugacaaucagucugcagu

SEQ ID NO: 69987 - RNA, 21 nt, Artificial Sequence
  Oligomer
acaacaagaucagcgacaaca

SEQ ID NO: 69988 - RNA, 21 nt, Artificial Sequence
  Oligomer
gcuacgguaccaguaauuaga

SEQ ID NO: 69989 - RNA, 21 nt, Artificial Sequence
  Oligomer
cacuuguauauugucagugaa

SEQ ID NO: 69990 - RNA, 21 nt, Artificial Sequence
  Oligomer
caucuacgucagcaggccaua

SEQ ID NO: 69991 - RNA, 21 nt, Artificial Sequence
  Oligomer
acuugcugggacuguacccaa

SEQ ID NO: 69992 - RNA, 21 nt, Artificial Sequence
  Oligomer
cugcagauaagugcgaggaaa

SEQ ID NO: 69993 - RNA, 21 nt, Artificial Sequence
  Oligomer
gaacgaaguucgcuucuuccu

SEQ ID NO: 69994 - RNA, 21 nt, Artificial Sequence
  Oligomer
acccauccaagucagcuucug

SEQ ID NO: 69995 - RNA, 21 nt, Artificial Sequence
  Oligomer
gggccaaauauucagaagcuu

SEQ ID NO: 69996 - RNA, 21 nt, Artificial Sequence
  Oligomer
aggguccuaaugggccaaaua

SEQ ID NO: 69997 - RNA, 21 nt, Artificial Sequence
  Oligomer
caaggccucuaaagaaacgua

SEQ ID NO: 69998 - RNA, 21 nt, Artificial Sequence
  Oligomer
cuaacgcaccaaggccucuaa

SEQ ID NO: 69999 - RNA, 21 nt, Artificial Sequence
  Oligomer
ccgaaaccagagugaugcuga

SEQ ID NO: 70000 - RNA, 21 nt, Artificial Sequence
  Oligomer
agauaucuugcgggaugcuca

SEQ ID NO: 70001 - RNA, 21 nt, Artificial Sequence
  Oligomer
aggaagaaccagagcagugaa

SEQ ID NO: 70002 - RNA, 21 nt, Artificial Sequence
  Oligomer
uccgcugagggagaaagagaa

SEQ ID NO: 70003 - RNA, 21 nt, Artificial Sequence
  Oligomer
gagcagaaugccaagcuacaa

SEQ ID NO: 70004 - RNA, 21 nt, Artificial Sequence
  Oligomer
ccaagaugaugccgauguuuc

SEQ ID NO: 70005 - RNA, 21 nt, Artificial Sequence
  Oligomer
cguccuggcugugucaaaagu

SEQ ID NO: 70006 - RNA, 21 nt, Artificial Sequence
  Oligomer
aaucaggaagcuaagcuaaaa

SEQ ID NO: 70007 - RNA, 21 nt, Artificial Sequence
  Oligomer
cuaaggaacagcgcuuaaagu

SEQ ID NO: 70008 - RNA, 21 nt, Artificial Sequence
  Oligomer
aguccuaggauggaucugacu

SEQ ID NO: 70009 - RNA, 21 nt, Artificial Sequence
  Oligomer
gaauucaccauuagaggacau

SEQ ID NO: 70010 - RNA, 21 nt, Artificial Sequence
  Oligomer
augaagaaugucucuagaaga

SEQ ID NO: 70011 - RNA, 21 nt, Artificial Sequence
  Oligomer
gcgaugaagaaugucucuaga

SEQ ID NO: 70012 - RNA, 21 nt, Artificial Sequence
  Oligomer
aagcgaugaagaaugucucua

SEQ ID NO: 70013 - RNA, 21 nt, Artificial Sequence
  Oligomer
gacaaaggagcuuggccugaa

SEQ ID NO: 70014 - RNA, 21 nt, Artificial Sequence
  Oligomer
acuguacccaagaauuaaacc

SEQ ID NO: 70015 - RNA, 21 nt, Artificial Sequence
  Oligomer
uuaugcgcuuugggauuauga

SEQ ID NO: 70016 - RNA, 21 nt, Artificial Sequence
  Oligomer
cauuuaugcgcuuugggauua

SEQ ID NO: 70017 - RNA, 21 nt, Artificial Sequence
  Oligomer
ugacaugcagacugcugcaga

SEQ ID NO: 70018 - RNA, 21 nt, Artificial Sequence
  Oligomer
uagugauggauggacuccauu

SEQ ID NO: 70019 - RNA, 21 nt, Artificial Sequence
  Oligomer
uguaaaugcugcugauaguga

SEQ ID NO: 70020 - RNA, 21 nt, Artificial Sequence
  Oligomer
uuuggaagucagaggaacgaa

SEQ ID NO: 70021 - RNA, 21 nt, Artificial Sequence
  Oligomer
ucaggagaaccaugaaaacga

SEQ ID NO: 70022 - RNA, 21 nt, Artificial Sequence
  Oligomer
gggaugcucagguugcaaaua

SEQ ID NO: 70023 - RNA, 21 nt, Artificial Sequence
  Oligomer
gaaacaaauugaaucaagagc

SEQ ID NO: 70024 - RNA, 21 nt, Artificial Sequence
  Oligomer
cuauaaggagcugcagcuaag

SEQ ID NO: 70025 - RNA, 21 nt, Artificial Sequence
  Oligomer
ugggaaacuuguggaggaaau

SEQ ID NO: 70026 - RNA, 21 nt, Artificial Sequence
  Oligomer
uaaggaacagcgcuuaaaguu

SEQ ID NO: 70027 - RNA, 21 nt, Artificial Sequence
  Oligomer
aaaggagaacgguguuaauag

SEQ ID NO: 70028 - RNA, 21 nt, Artificial Sequence
  Oligomer
cauagcugacuuuaaaaacag

SEQ ID NO: 70029 - RNA, 21 nt, Artificial Sequence
  Oligomer
guauauugucagugaagaacu

SEQ ID NO: 70030 - RNA, 21 nt, Artificial Sequence
  Oligomer
aaaggaccagugccgucacau

SEQ ID NO: 70031 - RNA, 21 nt, Artificial Sequence
  Oligomer
aaaucagcucucuguccuguu

SEQ ID NO: 70032 - RNA, 21 nt, Artificial Sequence
  Oligomer
acugcaugacaaucauccaca

SEQ ID NO: 70033 - RNA, 21 nt, Artificial Sequence
  Oligomer
gaguucaggagaagaugggca

SEQ ID NO: 70034 - RNA, 21 nt, Artificial Sequence
  Oligomer
auuucuuuauggaguucagga

SEQ ID NO: 70035 - RNA, 21 nt, Artificial Sequence
  Oligomer
ugauguguaccuggaggagua

SEQ ID NO: 70036 - RNA, 21 nt, Artificial Sequence
  Oligomer
cagaauaacccagaagaacca

SEQ ID NO: 70037 - RNA, 21 nt, Artificial Sequence
  Oligomer
acaacagcccaaaucuccaga

SEQ ID NO: 70038 - RNA, 21 nt, Artificial Sequence
  Oligomer
ccauccaagucagcuucugug

SEQ ID NO: 70039 - RNA, 21 nt, Artificial Sequence
  Oligomer
uuauaucagaggaccaccaua

SEQ ID NO: 70040 - RNA, 21 nt, Artificial Sequence
  Oligomer
cgaauguuugauguucuucaa

SEQ ID NO: 70041 - RNA, 21 nt, Artificial Sequence
  Oligomer
aguugcggauaaugagcgaau

SEQ ID NO: 70042 - RNA, 21 nt, Artificial Sequence
  Oligomer
cagagggccacacuuuucaag

SEQ ID NO: 70043 - RNA, 21 nt, Artificial Sequence
  Oligomer
ggaacuaaaccaaaaccagca

SEQ ID NO: 70044 - RNA, 21 nt, Artificial Sequence
  Oligomer
cagugaagauaucuugcggga

SEQ ID NO: 70045 - RNA, 21 nt, Artificial Sequence
  Oligomer
aaugggaaacuuguggaggaa

SEQ ID NO: 70046 - RNA, 21 nt, Artificial Sequence
  Oligomer
caauccuguuuucuacaagaa

SEQ ID NO: 70047 - RNA, 21 nt, Artificial Sequence
  Oligomer
aauuaaaccaagacaaaggag

SEQ ID NO: 70048 - RNA, 21 nt, Artificial Sequence
  Oligomer
augacaaucauccacagggaa

SEQ ID NO: 70049 - RNA, 21 nt, Artificial Sequence
  Oligomer
acaugcagacugcugcagaua

SEQ ID NO: 70050 - RNA, 21 nt, Artificial Sequence
  Oligomer
acauugugcugccucauguaa

SEQ ID NO: 70051 - RNA, 21 nt, Artificial Sequence
  Oligomer
agaauaacccagaagaaccaa

SEQ ID NO: 70052 - RNA, 21 nt, Artificial Sequence
  Oligomer
aggccuugauuaugagccuga

SEQ ID NO: 70053 - RNA, 21 nt, Artificial Sequence
  Oligomer
ugccaguacagagaacaguga

SEQ ID NO: 70054 - RNA, 21 nt, Artificial Sequence
  Oligomer
ccagaauccauauuuacaugu

SEQ ID NO: 70055 - RNA, 21 nt, Artificial Sequence
  Oligomer
aacagcaggcgccaggaaaaa

SEQ ID NO: 70056 - RNA, 21 nt, Artificial Sequence
  Oligomer
gaccguggcagcaaguucaau

SEQ ID NO: 70057 - RNA, 21 nt, Artificial Sequence
  Oligomer
gcuaaaguaccaccuccuguu

SEQ ID NO: 70058 - RNA, 21 nt, Artificial Sequence
  Oligomer
acugggaaugcucuggaucaa

SEQ ID NO: 70059 - RNA, 21 nt, Artificial Sequence
  Oligomer
uccaguuacuccagaaacaau

SEQ ID NO: 70060 - RNA, 21 nt, Artificial Sequence
  Oligomer
gcacuucacagaaguuccagu

SEQ ID NO: 70061 - RNA, 21 nt, Artificial Sequence
  Oligomer
ugucaaaaguagaagaacuga

SEQ ID NO: 70062 - RNA, 21 nt, Artificial Sequence
  Oligomer
guuccagcaaaaacagaggga

SEQ ID NO: 70063 - RNA, 21 nt, Artificial Sequence
  Oligomer
agauugaagcccagcaacaau

SEQ ID NO: 70064 - RNA, 21 nt, Artificial Sequence
  Oligomer
auggaucugacucuugcugaa

SEQ ID NO: 70065 - RNA, 21 nt, Artificial Sequence
  Oligomer
uaguugguugucagugaacaa

SEQ ID NO: 70066 - RNA, 21 nt, Artificial Sequence
  Oligomer
uguagcacucagauaaguaua

SEQ ID NO: 70067 - RNA, 21 nt, Artificial Sequence
  Oligomer
uagaagagaaugaaggauuga

SEQ ID NO: 70068 - RNA, 21 nt, Artificial Sequence
  Oligomer
uggcaaaaauuucacaagacu

SEQ ID NO: 70069 - RNA, 21 nt, Artificial Sequence
  Oligomer
uguuucuuaccguguaucuca

SEQ ID NO: 70070 - RNA, 21 nt, Artificial Sequence
  Oligomer
guaaaugcugcugauagugau

SEQ ID NO: 70071 - RNA, 21 nt, Artificial Sequence
  Oligomer
gccuccugguaaaaggacaaa

SEQ ID NO: 70072 - RNA, 21 nt, Artificial Sequence
  Oligomer
agacaacagcccaaaucucca

SEQ ID NO: 70073 - RNA, 21 nt, Artificial Sequence
  Oligomer
uaacgcaccaaggccucuaaa

SEQ ID NO: 70074 - RNA, 21 nt, Artificial Sequence
  Oligomer
auugcugcugcccagaaucaa

SEQ ID NO: 70075 - RNA, 21 nt, Artificial Sequence
  Oligomer
cuguaauugcugcugcccaga

SEQ ID NO: 70076 - RNA, 21 nt, Artificial Sequence
  Oligomer
uucuccagguucuaagcaaga

SEQ ID NO: 70077 - RNA, 21 nt, Artificial Sequence
  Oligomer
ugaugauggagagguuccgcu

SEQ ID NO: 70078 - RNA, 21 nt, Artificial Sequence
  Oligomer
cuggaucaaguugaugaugga

SEQ ID NO: 70079 - RNA, 21 nt, Artificial Sequence
  Oligomer
ugaaaauacagacacugccca

SEQ ID NO: 70080 - RNA, 21 nt, Artificial Sequence
  Oligomer
aagaaggcagcucuacagcaa

SEQ ID NO: 70081 - RNA, 21 nt, Artificial Sequence
  Oligomer
guccuggcugugucaaaagua

SEQ ID NO: 70082 - RNA, 21 nt, Artificial Sequence
  Oligomer
cuaaaaaaagugagagcacuu

SEQ ID NO: 70083 - RNA, 21 nt, Artificial Sequence
  Oligomer
gaucagcgacaacagcaacaa

SEQ ID NO: 70084 - RNA, 21 nt, Artificial Sequence
  Oligomer
aacuaaggaacagcgcuuaaa

SEQ ID NO: 70085 - RNA, 21 nt, Artificial Sequence
  Oligomer
cgccagcagcaacagauugaa

SEQ ID NO: 70086 - RNA, 21 nt, Artificial Sequence
  Oligomer
ucagcagcugcuccuaaacca

SEQ ID NO: 70087 - RNA, 21 nt, Artificial Sequence
  Oligomer
aagaaugucucuagaagagaa

SEQ ID NO: 70088 - RNA, 21 nt, Artificial Sequence
  Oligomer
aggagacugcaugacaaucau

SEQ ID NO: 70089 - RNA, 21 nt, Artificial Sequence
  Oligomer
gaguggaccaagaucucagga

SEQ ID NO: 70090 - RNA, 21 nt, Artificial Sequence
  Oligomer
auuugaccuuguacagagaau

SEQ ID NO: 70091 - RNA, 21 nt, Artificial Sequence
  Oligomer
aaguguauaugguaagccugu

SEQ ID NO: 70092 - RNA, 21 nt, Artificial Sequence
  Oligomer
agcgcguugaccaagacucau

SEQ ID NO: 70093 - RNA, 21 nt, Artificial Sequence
  Oligomer
ccaccuucagacauuaagcca

SEQ ID NO: 70094 - RNA, 21 nt, Artificial Sequence
  Oligomer
guaccucaaagcacugggaau

SEQ ID NO: 70095 - RNA, 21 nt, Artificial Sequence
  Oligomer
agccaaggcucugcuucugua

SEQ ID NO: 70096 - RNA, 21 nt, Artificial Sequence
  Oligomer
gcucuacagcaaaaagaaaau

SEQ ID NO: 70097 - RNA, 21 nt, Artificial Sequence
  Oligomer
uucagaaguggcagucaugga

SEQ ID NO: 70098 - RNA, 21 nt, Artificial Sequence
  Oligomer
aacaacagagggaguguuuga

SEQ ID NO: 70099 - RNA, 21 nt, Artificial Sequence
  Oligomer
caagagcagaaugccaagcua

SEQ ID NO: 70100 - RNA, 21 nt, Artificial Sequence
  Oligomer
agcacuuaaaggccacgugga

SEQ ID NO: 70101 - RNA, 21 nt, Artificial Sequence
  Oligomer
uugguugucagugaacaauaa

SEQ ID NO: 70102 - RNA, 21 nt, Artificial Sequence
  Oligomer
cuuguauauugucagugaaga

SEQ ID NO: 70103 - RNA, 21 nt, Artificial Sequence
  Oligomer
ugggcaguugggaaaucagcu

SEQ ID NO: 70104 - RNA, 21 nt, Artificial Sequence
  Oligomer
gucccguguagcacucagaua

SEQ ID NO: 70105 - RNA, 21 nt, Artificial Sequence
  Oligomer
acaauguagcuugaaagcgau

SEQ ID NO: 70106 - RNA, 21 nt, Artificial Sequence
  Oligomer
uugggauuaugaaccucagaa

SEQ ID NO: 70107 - RNA, 21 nt, Artificial Sequence
  Oligomer
uuugggauuaugaaccucaga

SEQ ID NO: 70108 - RNA, 21 nt, Artificial Sequence
  Oligomer
gagucauuuaugcgcuuuggg

SEQ ID NO: 70109 - RNA, 21 nt, Artificial Sequence
  Oligomer
uguaaauguaaaugcugcuga

SEQ ID NO: 70110 - RNA, 21 nt, Artificial Sequence
  Oligomer
agagcguaucgcucauggaau

SEQ ID NO: 70111 - RNA, 21 nt, Artificial Sequence
  Oligomer
uccacaugugcuugaugugua

SEQ ID NO: 70112 - RNA, 21 nt, Artificial Sequence
  Oligomer
gaauccauauuuacaugugga

SEQ ID NO: 70113 - RNA, 21 nt, Artificial Sequence
  Oligomer
guagaaauccagaauccauau

SEQ ID NO: 70114 - RNA, 21 nt, Artificial Sequence
  Oligomer
gaccaucucugucccaucaua

SEQ ID NO: 70115 - RNA, 21 nt, Artificial Sequence
  Oligomer
gaaagaaacugucuaacgcac

SEQ ID NO: 70116 - RNA, 21 nt, Artificial Sequence
  Oligomer
acguccaguugcggauaauga

SEQ ID NO: 70117 - RNA, 21 nt, Artificial Sequence
  Oligomer
ggccacacuuuucaaguguau

SEQ ID NO: 70118 - RNA, 21 nt, Artificial Sequence
  Oligomer
ggaaaaaacuuccagcaggcu

SEQ ID NO: 70119 - RNA, 21 nt, Artificial Sequence
  Oligomer
ccauguauacgcaacagcagg

SEQ ID NO: 70120 - RNA, 21 nt, Artificial Sequence
  Oligomer
agcauaccuucgguuggccaa

SEQ ID NO: 70121 - RNA, 21 nt, Artificial Sequence
  Oligomer
caccuuccuuugguacucuga

SEQ ID NO: 70122 - RNA, 21 nt, Artificial Sequence
  Oligomer
gguggaucugugcaaagaacc

SEQ ID NO: 70123 - RNA, 21 nt, Artificial Sequence
  Oligomer
cagcaaaaagaaaaucuacca

SEQ ID NO: 70124 - RNA, 21 nt, Artificial Sequence
  Oligomer
ggcuaaaagaaauagcugaga

SEQ ID NO: 70125 - RNA, 21 nt, Artificial Sequence
  Oligomer
ucgccagcagcaacagauuga

SEQ ID NO: 70126 - RNA, 21 nt, Artificial Sequence
  Oligomer
gcugaacuucaggaaauggca

SEQ ID NO: 70127 - RNA, 21 nt, Artificial Sequence
  Oligomer
uagaaacuugcuacagacuua

SEQ ID NO: 70128 - RNA, 21 nt, Artificial Sequence
  Oligomer
guaggcugaauuuuaaucugu

SEQ ID NO: 70129 - RNA, 21 nt, Artificial Sequence
  Oligomer
ugguugucagugaacaauaac

SEQ ID NO: 70130 - RNA, 21 nt, Artificial Sequence
  Oligomer
gucacaucgcugucucugauu

SEQ ID NO: 70131 - RNA, 21 nt, Artificial Sequence
  Oligomer
aaaguuccuggugaauaucga

SEQ ID NO: 70132 - RNA, 21 nt, Artificial Sequence
  Oligomer
uugcugggacuguacccaaga

SEQ ID NO: 70133 - RNA, 21 nt, Artificial Sequence
  Oligomer
ugacaaucauccacagggaag

SEQ ID NO: 70134 - RNA, 21 nt, Artificial Sequence
  Oligomer
ggauggacuccauuacauugu

SEQ ID NO: 70135 - RNA, 21 nt, Artificial Sequence
  Oligomer
gaggguccuaaugggccaaau

SEQ ID NO: 70136 - RNA, 21 nt, Artificial Sequence
  Oligomer
gaauguuugauguucuucaac

SEQ ID NO: 70137 - RNA, 21 nt, Artificial Sequence
  Oligomer
ugucaacaguuguuccgucca

SEQ ID NO: 70138 - RNA, 21 nt, Artificial Sequence
  Oligomer
uaaucagccaccuucagacau

SEQ ID NO: 70139 - RNA, 21 nt, Artificial Sequence
  Oligomer
agugauugccauuuggcugaa

SEQ ID NO: 70140 - RNA, 21 nt, Artificial Sequence
  Oligomer
guacucugaggaagaaccaga

SEQ ID NO: 70141 - RNA, 21 nt, Artificial Sequence
  Oligomer
gcccugauuggaguccuucaa

SEQ ID NO: 70142 - RNA, 21 nt, Artificial Sequence
  Oligomer
ccggaugguuccuuggucauu

SEQ ID NO: 70143 - RNA, 21 nt, Artificial Sequence
  Oligomer
gcaaaaagaaaaucuaccagu

SEQ ID NO: 70144 - RNA, 21 nt, Artificial Sequence
  Oligomer
acaacagcaacaaguugcuga

SEQ ID NO: 70145 - RNA, 21 nt, Artificial Sequence
  Oligomer
ccagcaacaauugcuggcaac

SEQ ID NO: 70146 - RNA, 21 nt, Artificial Sequence
  Oligomer
agaacgguguuaauaguccua

SEQ ID NO: 70147 - RNA, 21 nt, Artificial Sequence
  Oligomer
uccuguugaguguuuucagca

SEQ ID NO: 70148 - RNA, 21 nt, Artificial Sequence
  Oligomer
ucccguguagcacucagauaa

SEQ ID NO: 70149 - RNA, 21 nt, Artificial Sequence
  Oligomer
gcgugaugaaauaaagcaucu

SEQ ID NO: 70150 - RNA, 21 nt, Artificial Sequence
  Oligomer
gaagaauucaccauuagagga

SEQ ID NO: 70151 - RNA, 21 nt, Artificial Sequence
  Oligomer
gauaaggagggauauguucca

SEQ ID NO: 70152 - RNA, 21 nt, Artificial Sequence
  Oligomer
uaugaaccucagaaugaugau

SEQ ID NO: 70153 - RNA, 21 nt, Artificial Sequence
  Oligomer
ccaauuucuuuauggaguuca

SEQ ID NO: 70154 - RNA, 21 nt, Artificial Sequence
  Oligomer
gauaagugcgaggaaauggag

SEQ ID NO: 70155 - RNA, 21 nt, Artificial Sequence
  Oligomer
uucuagagacauucuucaucg

SEQ ID NO: 70156 - RNA, 21 nt, Artificial Sequence
  Oligomer
uuucugaaggguggaaguaag

SEQ ID NO: 70157 - RNA, 21 nt, Artificial Sequence
  Oligomer
uccuuugucuugguuuaauuc

SEQ ID NO: 70158 - RNA, 21 nt, Artificial Sequence
  Oligomer
ucuugguuuaauucuugggua

SEQ ID NO: 70159 - RNA, 21 nt, Artificial Sequence
  Oligomer
uuaauucuuggguacaguccc

SEQ ID NO: 70160 - RNA, 21 nt, Artificial Sequence
  Oligomer
uuucaugggcagcucaucauc

SEQ ID NO: 70161 - RNA, 21 nt, Artificial Sequence
  Oligomer
ugguaugagucuuggucaacg

SEQ ID NO: 70162 - RNA, 21 nt, Artificial Sequence
  Oligomer
uuugguucuucuggguuauuc

SEQ ID NO: 70163 - RNA, 21 nt, Artificial Sequence
  Oligomer
uuucguuuucaugguucuccu

SEQ ID NO: 70164 - RNA, 21 nt, Artificial Sequence
  Oligomer
uuggcauucugcucuugauuc

SEQ ID NO: 70165 - RNA, 21 nt, Artificial Sequence
  Oligomer
uugagcaucucuagcugccug

SEQ ID NO: 70166 - RNA, 21 nt, Artificial Sequence
  Oligomer
uuucuuuagaggccuuggugc

SEQ ID NO: 70167 - RNA, 21 nt, Artificial Sequence
  Oligomer
uuuucugaaggguggaaguaa

SEQ ID NO: 70168 - RNA, 21 nt, Artificial Sequence
  Oligomer
uucuguguggaaguuucaggc

SEQ ID NO: 70169 - RNA, 21 nt, Artificial Sequence
  Oligomer
uuuauuugcaaccugagcauc

SEQ ID NO: 70170 - RNA, 21 nt, Artificial Sequence
  Oligomer
uuauuugcaaccugagcaucc

SEQ ID NO: 70171 - RNA, 21 nt, Artificial Sequence
  Oligomer
uuacguggaacauaucccucc

SEQ ID NO: 70172 - RNA, 21 nt, Artificial Sequence
  Oligomer
ucauuaacacgcuuauccaug

SEQ ID NO: 70173 - RNA, 21 nt, Artificial Sequence
  Oligomer
cugacuuggauggguaugaug

SEQ ID NO: 70174 - RNA, 21 nt, Artificial Sequence
  Oligomer
uuggcuugggaaaagaucugc

SEQ ID NO: 70175 - RNA, 21 nt, Artificial Sequence
  Oligomer
ucugggugcugcuguugauuc

SEQ ID NO: 70176 - RNA, 21 nt, Artificial Sequence
  Oligomer
ucuucaauccuucauucucuu

SEQ ID NO: 70177 - RNA, 21 nt, Artificial Sequence
  Oligomer
ugguuuaauucuuggguacag

SEQ ID NO: 70178 - RNA, 21 nt, Artificial Sequence
  Oligomer
uuaucugcagcagucugcaug

SEQ ID NO: 70179 - RNA, 21 nt, Artificial Sequence
  Oligomer
uaagaaacaucggcaucaucu

SEQ ID NO: 70180 - RNA, 21 nt, Artificial Sequence
  Oligomer
uuuugcuguagagcugccuuc

SEQ ID NO: 70181 - RNA, 21 nt, Artificial Sequence
  Oligomer
uuucuuagcugcagcuccuua

SEQ ID NO: 70182 - RNA, 21 nt, Artificial Sequence
  Oligomer
auucuuggguacagucccagc

SEQ ID NO: 70183 - RNA, 21 nt, Artificial Sequence
  Oligomer
uuuacaccaaacuguaccagg

SEQ ID NO: 70184 - RNA, 21 nt, Artificial Sequence
  Oligomer
uucccaacugcccaauaaaug

SEQ ID NO: 70185 - RNA, 21 nt, Artificial Sequence
  Oligomer
uuuacuagacaggauucuugu

SEQ ID NO: 70186 - RNA, 21 nt, Artificial Sequence
  Oligomer
uggugaauucuucaauccuuc

SEQ ID NO: 70187 - RNA, 21 nt, Artificial Sequence
  Oligomer
aagcugacuuggauggguaug

SEQ ID NO: 70188 - RNA, 21 nt, Artificial Sequence
  Oligomer
uuuaguucccauggacggaac

SEQ ID NO: 70189 - RNA, 21 nt, Artificial Sequence
  Oligomer
uuuuguaggaacaggaggugg

SEQ ID NO: 70190 - RNA, 21 nt, Artificial Sequence
  Oligomer
uguagagcugccuucuucuuc

SEQ ID NO: 70191 - RNA, 21 nt, Artificial Sequence
  Oligomer
uuuugguuuuguaggaacagg

SEQ ID NO: 70192 - RNA, 21 nt, Artificial Sequence
  Oligomer
uuucuuuuugcuguagagcug

SEQ ID NO: 70193 - RNA, 21 nt, Artificial Sequence
  Oligomer
uugucaugguggcugucgauc

SEQ ID NO: 70194 - RNA, 21 nt, Artificial Sequence
  Oligomer
uuaagcgcuguuccuuaguug

SEQ ID NO: 70195 - RNA, 21 nt, Artificial Sequence
  Oligomer
ucuuuuuaaacuuggauccug

SEQ ID NO: 70196 - RNA, 21 nt, Artificial Sequence
  Oligomer
uuaaacuuggauccugagauc

SEQ ID NO: 70197 - RNA, 21 nt, Artificial Sequence
  Oligomer
uucaugggcagcucaucauca

SEQ ID NO: 70198 - RNA, 21 nt, Artificial Sequence
  Oligomer
ucauuaugcccaucuucuccu

SEQ ID NO: 70199 - RNA, 21 nt, Artificial Sequence
  Oligomer
ucacagaagcugacuuggaug

SEQ ID NO: 70200 - RNA, 21 nt, Artificial Sequence
  Oligomer
uaaggcuucuaggucagcauc

SEQ ID NO: 70201 - RNA, 21 nt, Artificial Sequence
  Oligomer
uuugaaggacuccaaucaggg

SEQ ID NO: 70202 - RNA, 21 nt, Artificial Sequence
  Oligomer
uuucccauugcuuagucucuu

SEQ ID NO: 70203 - RNA, 21 nt, Artificial Sequence
  Oligomer
ucugugaagugcugcucauug

SEQ ID NO: 70204 - RNA, 21 nt, Artificial Sequence
  Oligomer
uuccucgcacuuaucugcagc

SEQ ID NO: 70205 - RNA, 21 nt, Artificial Sequence
  Oligomer
uugggcagugucuguauuuuc

SEQ ID NO: 70206 - RNA, 21 nt, Artificial Sequence
  Oligomer
uugcuguugucgcugaucuug

SEQ ID NO: 70207 - RNA, 21 nt, Artificial Sequence
  Oligomer
ugucgcugaucuuguuguuuc

SEQ ID NO: 70208 - RNA, 21 nt, Artificial Sequence
  Oligomer
ucuuucaugggcagcucauca

SEQ ID NO: 70209 - RNA, 21 nt, Artificial Sequence
  Oligomer
uugaacuugcugccacggucu

SEQ ID NO: 70210 - RNA, 21 nt, Artificial Sequence
  Oligomer
uuugguuuaguucccauggac

SEQ ID NO: 70211 - RNA, 21 nt, Artificial Sequence
  Oligomer
uucuugagcaucucuagcugc

SEQ ID NO: 70212 - RNA, 21 nt, Artificial Sequence
  Oligomer
uauuguucacugacaaccaac

SEQ ID NO: 70213 - RNA, 21 nt, Artificial Sequence
  Oligomer
uguagcuuggcauucugcucu

SEQ ID NO: 70214 - RNA, 21 nt, Artificial Sequence
  Oligomer
uuccugauucucagcuauuuc

SEQ ID NO: 70215 - RNA, 21 nt, Artificial Sequence
  Oligomer
uuccgucuggcuuaaugucug

SEQ ID NO: 70216 - RNA, 21 nt, Artificial Sequence
  Oligomer
ucuccaucaucaacuugaucc

SEQ ID NO: 70217 - RNA, 21 nt, Artificial Sequence
  Oligomer
uacuuaucugagugcuacacg

SEQ ID NO: 70218 - RNA, 21 nt, Artificial Sequence
  Oligomer
ucgauuucaucuucgucuucc

SEQ ID NO: 70219 - RNA, 21 nt, Artificial Sequence
  Oligomer
uuggauccugagaucuugguc

SEQ ID NO: 70220 - RNA, 21 nt, Artificial Sequence
  Oligomer
ucuggauuugguucuucuggg

SEQ ID NO: 70221 - RNA, 21 nt, Artificial Sequence
  Oligomer
uauggauucuggauuucuacu

SEQ ID NO: 70222 - RNA, 21 nt, Artificial Sequence
  Oligomer
auuggaauaaauguucucugg

SEQ ID NO: 70223 - RNA, 21 nt, Artificial Sequence
  Oligomer
uugguuuaguucccauggacg

SEQ ID NO: 70224 - RNA, 21 nt, Artificial Sequence
  Oligomer
uuugucucuucgacgcucgug

SEQ ID NO: 70225 - RNA, 21 nt, Artificial Sequence
  Oligomer
ucaacuugauccagagcauuc

SEQ ID NO: 70226 - RNA, 21 nt, Artificial Sequence
  Oligomer
ucccucuguuguuguagcuug

SEQ ID NO: 70227 - RNA, 21 nt, Artificial Sequence
  Oligomer
uuuguuucuuagcugcagcuc

SEQ ID NO: 70228 - RNA, 21 nt, Artificial Sequence
  Oligomer
uuagcuuccugauucucagcu

SEQ ID NO: 70229 - RNA, 21 nt, Artificial Sequence
  Oligomer
auuuacuagacaggauucuug

SEQ ID NO: 70230 - RNA, 21 nt, Artificial Sequence
  Oligomer
ucuguuucagguucuggacug

SEQ ID NO: 70231 - RNA, 21 nt, Artificial Sequence
  Oligomer
uucugggcagcagcaauuaca

SEQ ID NO: 70232 - RNA, 21 nt, Artificial Sequence
  Oligomer
uuuuuuccuggcgccugcugu

SEQ ID NO: 70233 - RNA, 21 nt, Artificial Sequence
  Oligomer
uuauagaggcgaucaagcuca

SEQ ID NO: 70234 - RNA, 21 nt, Artificial Sequence
  Oligomer
ucagcaagagucagauccauc

SEQ ID NO: 70235 - RNA, 21 nt, Artificial Sequence
  Oligomer
uuaaagucagcuaugaucuug

SEQ ID NO: 70236 - RNA, 21 nt, Artificial Sequence
  Oligomer
uccauuuccucgcacuuaucu

SEQ ID NO: 70237 - RNA, 21 nt, Artificial Sequence
  Oligomer
acuuggauggguaugauggga

SEQ ID NO: 70238 - RNA, 21 nt, Artificial Sequence
  Oligomer
uacacuugaaaaguguggccc

SEQ ID NO: 70239 - RNA, 21 nt, Artificial Sequence
  Oligomer
uugcuuagaaccuggagaaag

SEQ ID NO: 70240 - RNA, 21 nt, Artificial Sequence
  Oligomer
uugagaacggacgcacuuucu

SEQ ID NO: 70241 - RNA, 21 nt, Artificial Sequence
  Oligomer
ucuucucuuucucccucagcg

SEQ ID NO: 70242 - RNA, 21 nt, Artificial Sequence
  Oligomer
uugagguacagaagcagagcc

SEQ ID NO: 70243 - RNA, 21 nt, Artificial Sequence
  Oligomer
uuuucuuuuugcuguagagcu

SEQ ID NO: 70244 - RNA, 21 nt, Artificial Sequence
  Oligomer
ucuuuuugcuguagagcugcc

SEQ ID NO: 70245 - RNA, 21 nt, Artificial Sequence
  Oligomer
uccuccacaaguuucccauug

SEQ ID NO: 70246 - RNA, 21 nt, Artificial Sequence
  Oligomer
cuuaguugccagcaauuguug

SEQ ID NO: 70247 - RNA, 21 nt, Artificial Sequence
  Oligomer
uuaguugccagcaauuguugc

SEQ ID NO: 70248 - RNA, 21 nt, Artificial Sequence
  Oligomer
uaggucauggcaaacacagcg

SEQ ID NO: 70249 - RNA, 21 nt, Artificial Sequence
  Oligomer
uucucuguacaaggucaaauu

SEQ ID NO: 70250 - RNA, 21 nt, Artificial Sequence
  Oligomer
ucaaauucucccuccaaagac

SEQ ID NO: 70251 - RNA, 21 nt, Artificial Sequence
  Oligomer
uuccaugagcgauacgcucug

SEQ ID NO: 70252 - RNA, 21 nt, Artificial Sequence
  Oligomer
aacuucguuccucugacuucc

SEQ ID NO: 70253 - RNA, 21 nt, Artificial Sequence
  Oligomer
agaagcugacuuggaugggua

SEQ ID NO: 70254 - RNA, 21 nt, Artificial Sequence
  Oligomer
uucguuuucaugguucuccug

SEQ ID NO: 70255 - RNA, 21 nt, Artificial Sequence
  Oligomer
uuggaauaaauguucucuggg

SEQ ID NO: 70256 - RNA, 21 nt, Artificial Sequence
  Oligomer
uucucugggugcugcuguuga

SEQ ID NO: 70257 - RNA, 21 nt, Artificial Sequence
  Oligomer
ucagccaaauggcaaucacuc

SEQ ID NO: 70258 - RNA, 21 nt, Artificial Sequence
  Oligomer
uuuuuauuugcaaccugagca

SEQ ID NO: 70259 - RNA, 21 nt, Artificial Sequence
  Oligomer
uuccacguggccuuuaagugc

SEQ ID NO: 70260 - RNA, 21 nt, Artificial Sequence
  Oligomer
uccuccagguacacaucaagc

SEQ ID NO: 70261 - RNA, 21 nt, Artificial Sequence
  Oligomer
uuucugagcuggcagucacag

SEQ ID NO: 70262 - RNA, 21 nt, Artificial Sequence
  Oligomer
uuucguaaggcuucuagguca

SEQ ID NO: 70263 - RNA, 21 nt, Artificial Sequence
  Oligomer
ucuaggucagcaucacucugg

SEQ ID NO: 70264 - RNA, 21 nt, Artificial Sequence
  Oligomer
uugucucuucgacgcucguga

SEQ ID NO: 70265 - RNA, 21 nt, Artificial Sequence
  Oligomer
ucuuugcacagauccaccacg

SEQ ID NO: 70266 - RNA, 21 nt, Artificial Sequence
  Oligomer
ugcauuugaaggacuccaauc

SEQ ID NO: 70267 - RNA, 21 nt, Artificial Sequence
  Oligomer
ucaauuuccuccacaaguuuc

SEQ ID NO: 70268 - RNA, 21 nt, Artificial Sequence
  Oligomer
uauuacggguaagucuguagc

SEQ ID NO: 70269 - RNA, 21 nt, Artificial Sequence
  Oligomer
aagucuugugaaauuuuugcc

SEQ ID NO: 70270 - RNA, 21 nt, Artificial Sequence
  Oligomer
uuaucauuaaggcgcgcccac

SEQ ID NO: 70271 - RNA, 21 nt, Artificial Sequence
  Oligomer
augggcagcucaucaucauuc

SEQ ID NO: 70272 - RNA, 21 nt, Artificial Sequence
  Oligomer
ugaaugaccaaggaaccaucc

SEQ ID NO: 70273 - RNA, 21 nt, Artificial Sequence
  Oligomer
uguugcugggcuucaaucugu

SEQ ID NO: 70274 - RNA, 21 nt, Artificial Sequence
  Oligomer
uagaaaacaggauugucgcug

SEQ ID NO: 70275 - RNA, 21 nt, Artificial Sequence
  Oligomer
auugucaugcagucuccuucu

SEQ ID NO: 70276 - RNA, 21 nt, Artificial Sequence
  Oligomer
uaauggaguccauccaucacu

SEQ ID NO: 70277 - RNA, 21 nt, Artificial Sequence
  Oligomer
ugcguuagacaguuucuuucg

SEQ ID NO: 70278 - RNA, 21 nt, Artificial Sequence
  Oligomer
uccugaacugaagaaacaggc

SEQ ID NO: 70279 - RNA, 21 nt, Artificial Sequence
  Oligomer
uaaggugucuuuggaaggcug

SEQ ID NO: 70280 - RNA, 21 nt, Artificial Sequence
  Oligomer
uggacuuucuugcuuagaacc

SEQ ID NO: 70281 - RNA, 21 nt, Artificial Sequence
  Oligomer
ugauccagagcauucccagug

SEQ ID NO: 70282 - RNA, 21 nt, Artificial Sequence
  Oligomer
uggauuuuagagccuuuaguu

SEQ ID NO: 70283 - RNA, 21 nt, Artificial Sequence
  Oligomer
uucuggaguaacuggaacuuc

SEQ ID NO: 70284 - RNA, 21 nt, Artificial Sequence
  Oligomer
uauagaggcgaucaagcucag

SEQ ID NO: 70285 - RNA, 21 nt, Artificial Sequence
  Oligomer
ucuugagcaucucuagcugcc

SEQ ID NO: 70286 - RNA, 21 nt, Artificial Sequence
  Oligomer
ucuagcugccuggucaguucu

SEQ ID NO: 70287 - RNA, 21 nt, Artificial Sequence
  Oligomer
ugaagugcugcucauuguuac

SEQ ID NO: 70288 - RNA, 21 nt, Artificial Sequence
  Oligomer
ucuucaucgcuuucaagcuac

SEQ ID NO: 70289 - RNA, 21 nt, Artificial Sequence
  Oligomer
ccuuugucuugguuuaauucu

SEQ ID NO: 70290 - RNA, 21 nt, Artificial Sequence
  Oligomer
uaauucuuggguacaguccca

SEQ ID NO: 70291 - RNA, 21 nt, Artificial Sequence
  Oligomer
uguagccuuccuccauuuccu

SEQ ID NO: 70292 - RNA, 21 nt, Artificial Sequence
  Oligomer
ucaagcacauguggagccucu

SEQ ID NO: 70293 - RNA, 21 nt, Artificial Sequence
  Oligomer
uucuacugggcuuucugagcu

SEQ ID NO: 70294 - RNA, 21 nt, Artificial Sequence
  Oligomer
uucuuuagaggccuuggugcg

SEQ ID NO: 70295 - RNA, 21 nt, Artificial Sequence
  Oligomer
auguucucugggugcugcugu

SEQ ID NO: 70296 - RNA, 21 nt, Artificial Sequence
  Oligomer
ucugaaggguggaaguaaggu

SEQ ID NO: 70297 - RNA, 21 nt, Artificial Sequence
  Oligomer
uucuuccucagaguaccaaag

SEQ ID NO: 70298 - RNA, 21 nt, Artificial Sequence
  Oligomer
auauagggaccuacugcagcc

SEQ ID NO: 70299 - RNA, 21 nt, Artificial Sequence
  Oligomer
uuuccaucagaugaaacuggu

SEQ ID NO: 70300 - RNA, 21 nt, Artificial Sequence
  Oligomer
uguucaauuuccuccacaagu

SEQ ID NO: 70301 - RNA, 21 nt, Artificial Sequence
  Oligomer
uccugcucagcaacuuguugc

SEQ ID NO: 70302 - RNA, 21 nt, Artificial Sequence
  Oligomer
uccugaaguucagcaagaguc

SEQ ID NO: 70303 - RNA, 21 nt, Artificial Sequence
  Oligomer
uccuuucuucgauauucacca

SEQ ID NO: 70304 - RNA, 21 nt, Artificial Sequence
  Oligomer
uucgauauucaccaggaacuu

SEQ ID NO: 70305 - RNA, 21 nt, Artificial Sequence
  Oligomer
uucuccugaacuccauaaaga

SEQ ID NO: 70306 - RNA, 21 nt, Artificial Sequence
  Oligomer
uuacacacuuggacguuguua

SEQ ID NO: 70307 - RNA, 21 nt, Artificial Sequence
  Oligomer
uucugaauauuuggcccauua

SEQ ID NO: 70308 - RNA, 21 nt, Artificial Sequence
  Oligomer
uuuggcccauuaggacccucu

SEQ ID NO: 70309 - RNA, 21 nt, Artificial Sequence
  Oligomer
uuucagguucuggacugccag

SEQ ID NO: 70310 - RNA, 21 nt, Artificial Sequence
  Oligomer
uuagaaccuggagaaaggguc

SEQ ID NO: 70311 - RNA, 21 nt, Artificial Sequence
  Oligomer
uuugguuuuguaggaacagga

SEQ ID NO: 70312 - RNA, 21 nt, Artificial Sequence
  Oligomer
ugucgauccugccguucuuga

SEQ ID NO: 70313 - RNA, 21 nt, Artificial Sequence
  Oligomer
uuuccuccacaaguuucccau

SEQ ID NO: 70314 - RNA, 21 nt, Artificial Sequence
  Oligomer
uucuguuccacguggccuuua

SEQ ID NO: 70315 - RNA, 21 nt, Artificial Sequence
  Oligomer
uuguagaaaacaggauugucg

SEQ ID NO: 70316 - RNA, 21 nt, Artificial Sequence
  Oligomer
ucucuucuagagacauucuuc

SEQ ID NO: 70317 - RNA, 21 nt, Artificial Sequence
  Oligomer
augcagucuccuucuuucaug

SEQ ID NO: 70318 - RNA, 21 nt, Artificial Sequence
  Oligomer
uuucacccucauuccaugagc

SEQ ID NO: 70319 - RNA, 21 nt, Artificial Sequence
  Oligomer
uuuucaugguucuccugaacu

SEQ ID NO: 70320 - RNA, 21 nt, Artificial Sequence
  Oligomer
ucugaagccugaaugaccaag

SEQ ID NO: 70321 - RNA, 21 nt, Artificial Sequence
  Oligomer
cugaaugaccaaggaaccauc

SEQ ID NO: 70322 - RNA, 21 nt, Artificial Sequence
  Oligomer
caucgcuuucaagcuacauug

SEQ ID NO: 70323 - RNA, 21 nt, Artificial Sequence
  Oligomer
uggaaguuucaggccaagcuc

SEQ ID NO: 70324 - RNA, 21 nt, Artificial Sequence
  Oligomer
uaucccuccuuaucauuaagg

SEQ ID NO: 70325 - RNA, 21 nt, Artificial Sequence
  Oligomer
uguaccaggaacuuaacgauu

SEQ ID NO: 70326 - RNA, 21 nt, Artificial Sequence
  Oligomer
uuucgguaaggauuagauaag

SEQ ID NO: 70327 - RNA, 21 nt, Artificial Sequence
  Oligomer
uguuucagguucuggacugcc

SEQ ID NO: 70328 - RNA, 21 nt, Artificial Sequence
  Oligomer
auuauccgcaacuggacguuc

SEQ ID NO: 70329 - RNA, 21 nt, Artificial Sequence
  Oligomer
ggguuuucugaaggguggaag

SEQ ID NO: 70330 - RNA, 21 nt, Artificial Sequence
  Oligomer
ugcuguagagcugccuucuuc

SEQ ID NO: 70331 - RNA, 21 nt, Artificial Sequence
  Oligomer
uguuguuguagcuuggcauuc

SEQ ID NO: 70332 - RNA, 21 nt, Artificial Sequence
  Oligomer
uuguuguagcuuggcauucug

SEQ ID NO: 70333 - RNA, 21 nt, Artificial Sequence
  Oligomer
uguuguagcuuggcauucugc

SEQ ID NO: 70334 - RNA, 21 nt, Artificial Sequence
  Oligomer
uucuuagcugcagcuccuuau

SEQ ID NO: 70335 - RNA, 21 nt, Artificial Sequence
  Oligomer
uuagcugcagcuccuuauaga

SEQ ID NO: 70336 - RNA, 21 nt, Artificial Sequence
  Oligomer
ucagccacugcagacugauug

SEQ ID NO: 70337 - RNA, 21 nt, Artificial Sequence
  Oligomer
ucuguuuuugcuggaacaaau

SEQ ID NO: 70338 - RNA, 21 nt, Artificial Sequence
  Oligomer
aguuauuguucacugacaacc

SEQ ID NO: 70339 - RNA, 21 nt, Artificial Sequence
  Oligomer
uucuucaucgcuuucaagcua

SEQ ID NO: 70340 - RNA, 21 nt, Artificial Sequence
  Oligomer
ugcagucuccuucuuucaugg

SEQ ID NO: 70341 - RNA, 21 nt, Artificial Sequence
  Oligomer
uugguccacucacaauguccc

SEQ ID NO: 70342 - RNA, 21 nt, Artificial Sequence
  Oligomer
auuuccucgcacuuaucugca

SEQ ID NO: 70343 - RNA, 21 nt, Artificial Sequence
  Oligomer
ucugcaugucacuguagguca

SEQ ID NO: 70344 - RNA, 21 nt, Artificial Sequence
  Oligomer
acauuuacaccaaacuguacc

SEQ ID NO: 70345 - RNA, 21 nt, Artificial Sequence
  Oligomer
aauauuuggcccauuaggacc

SEQ ID NO: 70346 - RNA, 21 nt, Artificial Sequence
  Oligomer
auauuuggcccauuaggaccc

SEQ ID NO: 70347 - RNA, 21 nt, Artificial Sequence
  Oligomer
uggcucuguaauagaacuacg

SEQ ID NO: 70348 - RNA, 21 nt, Artificial Sequence
  Oligomer
uuucaugguucuccugaacug

SEQ ID NO: 70349 - RNA, 21 nt, Artificial Sequence
  Oligomer
cucauuauccgcaacuggacg

SEQ ID NO: 70350 - RNA, 21 nt, Artificial Sequence
  Oligomer
ucugguaugagucuuggucaa

SEQ ID NO: 70351 - RNA, 21 nt, Artificial Sequence
  Oligomer
acuuucuucucuuucucccuc

SEQ ID NO: 70352 - RNA, 21 nt, Artificial Sequence
  Oligomer
uguuucuuagcugcagcuccu

SEQ ID NO: 70353 - RNA, 21 nt, Artificial Sequence
  Oligomer
uguuccacguggccuuuaagu

SEQ ID NO: 70354 - RNA, 21 nt, Artificial Sequence
  Oligomer
uuucccaacugcccaauaaau

SEQ ID NO: 70355 - RNA, 21 nt, Artificial Sequence
  Oligomer
auucuguguggaaguuucagg

SEQ ID NO: 70356 - RNA, 21 nt, Artificial Sequence
  Oligomer
uacguggaacauaucccuccu

SEQ ID NO: 70357 - RNA, 21 nt, Artificial Sequence
  Oligomer
auucgauuucaucuucgucuu

SEQ ID NO: 70358 - RNA, 21 nt, Artificial Sequence
  Oligomer
ucuugguccacucacaauguc

SEQ ID NO: 70359 - RNA, 21 nt, Artificial Sequence
  Oligomer
auugggagcacugaguguagc

SEQ ID NO: 70360 - RNA, 21 nt, Artificial Sequence
  Oligomer
ugaauuucacccucauuccau

SEQ ID NO: 70361 - RNA, 21 nt, Artificial Sequence
  Oligomer
uucaggaaccagagagaccac

SEQ ID NO: 70362 - RNA, 21 nt, Artificial Sequence
  Oligomer
uauacacuugaaaaguguggc

SEQ ID NO: 70363 - RNA, 21 nt, Artificial Sequence
  Oligomer
ucugaagguggcugauuaguu

SEQ ID NO: 70364 - RNA, 21 nt, Artificial Sequence
  Oligomer
uccgaggcauaguagacgacu

SEQ ID NO: 70365 - RNA, 21 nt, Artificial Sequence
  Oligomer
uccugauucucagcuauuucu

SEQ ID NO: 70366 - RNA, 21 nt, Artificial Sequence
  Oligomer
aauuguugcugggcuucaauc

SEQ ID NO: 70367 - RNA, 21 nt, Artificial Sequence
  Oligomer
cuccuuucuucgauauucacc

SEQ ID NO: 70368 - RNA, 21 nt, Artificial Sequence
  Oligomer
uucauaaucccaaagcgcaua

SEQ ID NO: 70369 - RNA, 21 nt, Artificial Sequence
  Oligomer
ucgcacuuaucugcagcaguc

SEQ ID NO: 70370 - RNA, 21 nt, Artificial Sequence
  Oligomer
uacacacuuggacguuguuac

SEQ ID NO: 70371 - RNA, 21 nt, Artificial Sequence
  Oligomer
auuuacaccaaacuguaccag

SEQ ID NO: 70372 - RNA, 21 nt, Artificial Sequence
  Oligomer
uugugaagagccgugaugccu

SEQ ID NO: 70373 - RNA, 21 nt, Artificial Sequence
  Oligomer
uucacccucauuccaugagcg

SEQ ID NO: 70374 - RNA, 21 nt, Artificial Sequence
  Oligomer
uuucuacugggcuuucugagc

SEQ ID NO: 70375 - RNA, 21 nt, Artificial Sequence
  Oligomer
uucguaaggcuucuaggucag

SEQ ID NO: 70376 - RNA, 21 nt, Artificial Sequence
  Oligomer
uggcccucugguaugagucuu

SEQ ID NO: 70377 - RNA, 21 nt, Artificial Sequence
  Oligomer
cugaaggguggaaguaaggug

SEQ ID NO: 70378 - RNA, 21 nt, Artificial Sequence
  Oligomer
aucugcauuugaaggacucca

SEQ ID NO: 70379 - RNA, 21 nt, Artificial Sequence
  Oligomer
auuugaaggacuccaaucagg

SEQ ID NO: 70380 - RNA, 21 nt, Artificial Sequence
  Oligomer
ucucauguugggcagugucug

SEQ ID NO: 70381 - RNA, 21 nt, Artificial Sequence
  Oligomer
auuuccaucagaugaaacugg

SEQ ID NO: 70382 - RNA, 21 nt, Artificial Sequence
  Oligomer
uccaucagaugaaacugguag

SEQ ID NO: 70383 - RNA, 21 nt, Artificial Sequence
  Oligomer
uccuuauagaggcgaucaagc

SEQ ID NO: 70384 - RNA, 21 nt, Artificial Sequence
  Oligomer
uguugcuguugucgcugaucu

SEQ ID NO: 70385 - RNA, 21 nt, Artificial Sequence
  Oligomer
acaucggcaucaucuuggacc

SEQ ID NO: 70386 - RNA, 21 nt, Artificial Sequence
  Oligomer
guucacugacaaccaacuaac

SEQ ID NO: 70387 - RNA, 21 nt, Artificial Sequence
  Oligomer
uuucuggcaggaggacugguu

SEQ ID NO: 70388 - RNA, 21 nt, Artificial Sequence
  Oligomer
ucaccaggaacuuuuacacca

SEQ ID NO: 70389 - RNA, 21 nt, Artificial Sequence
  Oligomer
auucucuucuagagacauucu

SEQ ID NO: 70390 - RNA, 21 nt, Artificial Sequence
  Oligomer
aauucuuggguacagucccag

SEQ ID NO: 70391 - RNA, 21 nt, Artificial Sequence
  Oligomer
uucuuggguacagucccagca

SEQ ID NO: 70392 - RNA, 21 nt, Artificial Sequence
  Oligomer
uguaggucauggcaaacacag

SEQ ID NO: 70393 - RNA, 21 nt, Artificial Sequence
  Oligomer
ugaggcagcacaauguaaugg

SEQ ID NO: 70394 - RNA, 21 nt, Artificial Sequence
  Oligomer
auguaauggaguccauccauc

SEQ ID NO: 70395 - RNA, 21 nt, Artificial Sequence
  Oligomer
aacuguaccaggaacuuaacg

SEQ ID NO: 70396 - RNA, 21 nt, Artificial Sequence
  Oligomer
uccuuuucgggcuccacaugu

SEQ ID NO: 70397 - RNA, 21 nt, Artificial Sequence
  Oligomer
agcugacuuggauggguauga

SEQ ID NO: 70398 - RNA, 21 nt, Artificial Sequence
  Oligomer
aaucguugaagaacaucaaac

SEQ ID NO: 70399 - RNA, 21 nt, Artificial Sequence
  Oligomer
ugguccucugauauaaaagcu

SEQ ID NO: 70400 - RNA, 21 nt, Artificial Sequence
  Oligomer
ugccuggucaguucuucuacu

SEQ ID NO: 70401 - RNA, 21 nt, Artificial Sequence
  Oligomer
uuccuuaguugccagcaauug

SEQ ID NO: 70402 - RNA, 21 nt, Artificial Sequence
  Oligomer
uuuaaacuuggauccugagau

SEQ ID NO: 70403 - RNA, 21 nt, Artificial Sequence
  Oligomer
uugucaugcagucuccuucuu

SEQ ID NO: 70404 - RNA, 21 nt, Artificial Sequence
  Oligomer
ugagguucauaaucccaaagc

SEQ ID NO: 70405 - RNA, 21 nt, Artificial Sequence
  Oligomer
ucccaaagcgcauaaaugacu

SEQ ID NO: 70406 - RNA, 21 nt, Artificial Sequence
  Oligomer
guuacaugaggcagcacaaug

SEQ ID NO: 70407 - RNA, 21 nt, Artificial Sequence
  Oligomer
ucuguacaaggucaaauucuc

SEQ ID NO: 70408 - RNA, 21 nt, Artificial Sequence
  Oligomer
uccaaagacgaaucuagcagu

SEQ ID NO: 70409 - RNA, 21 nt, Artificial Sequence
  Oligomer
uuuucgggcuccacauguaaa

SEQ ID NO: 70410 - RNA, 21 nt, Artificial Sequence
  Oligomer
gcugacuuggauggguaugau

SEQ ID NO: 70411 - RNA, 21 nt, Artificial Sequence
  Oligomer
augaugggacagagauggucu

SEQ ID NO: 70412 - RNA, 21 nt, Artificial Sequence
  Oligomer
uucgcucauuauccgcaacug

SEQ ID NO: 70413 - RNA, 21 nt, Artificial Sequence
  Oligomer
ugguuuuguaggaacaggagg

SEQ ID NO: 70414 - RNA, 21 nt, Artificial Sequence
  Oligomer
uuggacuggucuacugcauca

SEQ ID NO: 70415 - RNA, 21 nt, Artificial Sequence
  Oligomer
auggauuuuagagccuuuagu

SEQ ID NO: 70416 - RNA, 21 nt, Artificial Sequence
  Oligomer
uggcuucaccagcaauucagg

SEQ ID NO: 70417 - RNA, 21 nt, Artificial Sequence
  Oligomer
ucugcauauuguuucuggagu

SEQ ID NO: 70418 - RNA, 21 nt, Artificial Sequence
  Oligomer
agaaacaucggcaucaucuug

SEQ ID NO: 70419 - RNA, 21 nt, Artificial Sequence
  Oligomer
uauucaaacacucccucuguu

SEQ ID NO: 70420 - RNA, 21 nt, Artificial Sequence
  Oligomer
ucuggaguaacuggaacuucu

SEQ ID NO: 70421 - RNA, 21 nt, Artificial Sequence
  Oligomer
ucuucuguuccacguggccuu

SEQ ID NO: 70422 - RNA, 21 nt, Artificial Sequence
  Oligomer
uucucagcuauuucuuuuagc

SEQ ID NO: 70423 - RNA, 21 nt, Artificial Sequence
  Oligomer
ugcuguugucgcugaucuugu

SEQ ID NO: 70424 - RNA, 21 nt, Artificial Sequence
  Oligomer
ucuucgauauucaccaggaac

SEQ ID NO: 70425 - RNA, 21 nt, Artificial Sequence
  Oligomer
ucuguguggaaguuucaggcc

SEQ ID NO: 70426 - RNA, 21 nt, Artificial Sequence
  Oligomer
uguggaaguuucaggccaagc

SEQ ID NO: 70427 - RNA, 21 nt, Artificial Sequence
  Oligomer
guuacguggaacauaucccuc

SEQ ID NO: 70428 - RNA, 21 nt, Artificial Sequence
  Oligomer
aucauucugagguucauaauc

SEQ ID NO: 70429 - RNA, 21 nt, Artificial Sequence
  Oligomer
augcccaucuucuccugaacu

SEQ ID NO: 70430 - RNA, 21 nt, Artificial Sequence
  Oligomer
agaaauugggagcacugagug

SEQ ID NO: 70431 - RNA, 21 nt, Artificial Sequence
  Oligomer
uuuaccaggaggcagagagac

SEQ ID NO: 70432 - RNA, 21 nt, Artificial Sequence
  Oligomer
uucgggcuccacauguaaaua

SEQ ID NO: 70433 - RNA, 21 nt, Artificial Sequence
  Oligomer
auggauucuggauuucuacug

SEQ ID NO: 70434 - RNA, 21 nt, Artificial Sequence
  Oligomer
auuuaguugggcugaguggcc

SEQ ID NO: 70435 - RNA, 21 nt, Artificial Sequence
  Oligomer
ucgcucauuauccgcaacugg

SEQ ID NO: 70436 - RNA, 21 nt, Artificial Sequence
  Oligomer
uuucuugcuuagaaccuggag

SEQ ID NO: 70437 - RNA, 21 nt, Artificial Sequence
  Oligomer
guuuugguuuaguucccaugg

SEQ ID NO: 70438 - RNA, 21 nt, Artificial Sequence
  Oligomer
uuaaugucugaagguggcuga

SEQ ID NO: 70439 - RNA, 21 nt, Artificial Sequence
  Oligomer
uugguuuuguaggaacaggag

SEQ ID NO: 70440 - RNA, 21 nt, Artificial Sequence
  Oligomer
uguaggaacaggaggugguac

SEQ ID NO: 70441 - RNA, 21 nt, Artificial Sequence
  Oligomer
acaggaggugguacuuuagcc

SEQ ID NO: 70442 - RNA, 21 nt, Artificial Sequence
  Oligomer
ucuacugcaucaaacauugag

SEQ ID NO: 70443 - RNA, 21 nt, Artificial Sequence
  Oligomer
uagacgacuggauauagggac

SEQ ID NO: 70444 - RNA, 21 nt, Artificial Sequence
  Oligomer
cuggauauagggaccuacugc

SEQ ID NO: 70445 - RNA, 21 nt, Artificial Sequence
  Oligomer
uggauauagggaccuacugca

SEQ ID NO: 70446 - RNA, 21 nt, Artificial Sequence
  Oligomer
uuguugcugggcuucaaucug

SEQ ID NO: 70447 - RNA, 21 nt, Artificial Sequence
  Oligomer
uaccguagcuuaguuucaaua

SEQ ID NO: 70448 - RNA, 21 nt, Artificial Sequence
  Oligomer
ucacugacaaccaacuaacag

SEQ ID NO: 70449 - RNA, 21 nt, Artificial Sequence
  Oligomer
uacuagacaggauucuuguag

SEQ ID NO: 70450 - RNA, 21 nt, Artificial Sequence
  Oligomer
ugucaugcagucuccuucuuu

SEQ ID NO: 70451 - RNA, 21 nt, Artificial Sequence
  Oligomer
ucaucauucugagguucauaa

SEQ ID NO: 70452 - RNA, 21 nt, Artificial Sequence
  Oligomer
acacuuggacguuguuacaug

SEQ ID NO: 70453 - RNA, 21 nt, Artificial Sequence
  Oligomer
ccaguuuuacgcaaguuuguc

SEQ ID NO: 70454 - RNA, 21 nt, Artificial Sequence
  Oligomer
uccagguacacaucaagcaca

SEQ ID NO: 70455 - RNA, 21 nt, Artificial Sequence
  Oligomer
ucccucaggcucauaaucaag

SEQ ID NO: 70456 - RNA, 21 nt, Artificial Sequence
  Oligomer
uacacgguaagaaacaucggc

SEQ ID NO: 70457 - RNA, 21 nt, Artificial Sequence
  Oligomer
gauggguaugaugggacagag

SEQ ID NO: 70458 - RNA, 21 nt, Artificial Sequence
  Oligomer
aaagcuucugaauauuuggcc

SEQ ID NO: 70459 - RNA, 21 nt, Artificial Sequence
  Oligomer
cugaauauuuggcccauuagg

SEQ ID NO: 70460 - RNA, 21 nt, Artificial Sequence
  Oligomer
uuuugguuuaguucccaugga

SEQ ID NO: 70461 - RNA, 21 nt, Artificial Sequence
  Oligomer
ugguuuaguucccauggacgg

SEQ ID NO: 70462 - RNA, 21 nt, Artificial Sequence
  Oligomer
ucacugcucugguucuuccuc

SEQ ID NO: 70463 - RNA, 21 nt, Artificial Sequence
  Oligomer
ucugcauuugaaggacuccaa

SEQ ID NO: 70464 - RNA, 21 nt, Artificial Sequence
  Oligomer
ugccacuucugaauuacgcuu

SEQ ID NO: 70465 - RNA, 21 nt, Artificial Sequence
  Oligomer
ucagcuauuucuuuuagccuu

SEQ ID NO: 70466 - RNA, 21 nt, Artificial Sequence
  Oligomer
ucuccugcucagcaacuuguu

SEQ ID NO: 70467 - RNA, 21 nt, Artificial Sequence
  Oligomer
uucuggcaggaggacugguuu

SEQ ID NO: 70468 - RNA, 21 nt, Artificial Sequence
  Oligomer
uuaggagcagcugcugaaaac

SEQ ID NO: 70469 - RNA, 21 nt, Artificial Sequence
  Oligomer
uauucaccaggaacuuuuaca

SEQ ID NO: 70470 - RNA, 21 nt, Artificial Sequence
  Oligomer
ucgcuuucaagcuacauuguc

SEQ ID NO: 70471 - RNA, 21 nt, Artificial Sequence
  Oligomer
ucuucgucuucccuguggaug

SEQ ID NO: 70472 - RNA, 21 nt, Artificial Sequence
  Oligomer
uccuucuuucaugggcagcuc

SEQ ID NO: 70473 - RNA, 21 nt, Artificial Sequence
  Oligomer
uccuuuauucauuaugcccau

SEQ ID NO: 70474 - RNA, 21 nt, Artificial Sequence
  Oligomer
uguaauggaguccauccauca

SEQ ID NO: 70475 - RNA, 21 nt, Artificial Sequence
  Oligomer
acgcucugagccaguuuuacg

SEQ ID NO: 70476 - RNA, 21 nt, Artificial Sequence
  Oligomer
acucccucaggcucauaauca

SEQ ID NO: 70477 - RNA, 21 nt, Artificial Sequence
  Oligomer
uuucgggcuccacauguaaau

SEQ ID NO: 70478 - RNA, 21 nt, Artificial Sequence
  Oligomer
uggauucuggauuucuacugg

SEQ ID NO: 70479 - RNA, 21 nt, Artificial Sequence
  Oligomer
cucugguaugagucuugguca

SEQ ID NO: 70480 - RNA, 21 nt, Artificial Sequence
  Oligomer
guuuucugaaggguggaagua

SEQ ID NO: 70481 - RNA, 21 nt, Artificial Sequence
  Oligomer
uucccauggacggaacaacug

SEQ ID NO: 70482 - RNA, 21 nt, Artificial Sequence
  Oligomer
uuuuauuugcaaccugagcau

SEQ ID NO: 70483 - RNA, 21 nt, Artificial Sequence
  Oligomer
auuggacuggucuacugcauc

SEQ ID NO: 70484 - RNA, 21 nt, Artificial Sequence
  Oligomer
acuugauccagagcauuccca

SEQ ID NO: 70485 - RNA, 21 nt, Artificial Sequence
  Oligomer
uaguagacgacuggauauagg

SEQ ID NO: 70486 - RNA, 21 nt, Artificial Sequence
  Oligomer
acugcagacugauugucaugg

SEQ ID NO: 70487 - RNA, 21 nt, Artificial Sequence
  Oligomer
uguugucgcugaucuuguugu

SEQ ID NO: 70488 - RNA, 21 nt, Artificial Sequence
  Oligomer
ucuaauuacugguaccguagc

SEQ ID NO: 70489 - RNA, 21 nt, Artificial Sequence
  Oligomer
uucacugacaauauacaagug

SEQ ID NO: 70490 - RNA, 21 nt, Artificial Sequence
  Oligomer
uauggccugcugacguagaug

SEQ ID NO: 70491 - RNA, 21 nt, Artificial Sequence
  Oligomer
uuggguacagucccagcaagu

SEQ ID NO: 70492 - RNA, 21 nt, Artificial Sequence
  Oligomer
uuuccucgcacuuaucugcag

SEQ ID NO: 70493 - RNA, 21 nt, Artificial Sequence
  Oligomer
aggaagaagcgaacuucguuc

SEQ ID NO: 70494 - RNA, 21 nt, Artificial Sequence
  Oligomer
cagaagcugacuuggaugggu

SEQ ID NO: 70495 - RNA, 21 nt, Artificial Sequence
  Oligomer
aagcuucugaauauuuggccc

SEQ ID NO: 70496 - RNA, 21 nt, Artificial Sequence
  Oligomer
uauuuggcccauuaggacccu

SEQ ID NO: 70497 - RNA, 21 nt, Artificial Sequence
  Oligomer
uacguuucuuuagaggccuug

SEQ ID NO: 70498 - RNA, 21 nt, Artificial Sequence
  Oligomer
uuagaggccuuggugcguuag

SEQ ID NO: 70499 - RNA, 21 nt, Artificial Sequence
  Oligomer
ucagcaucacucugguuucgg

SEQ ID NO: 70500 - RNA, 21 nt, Artificial Sequence
  Oligomer
ugagcaucccgcaagauaucu

SEQ ID NO: 70501 - RNA, 21 nt, Artificial Sequence
  Oligomer
uucacugcucugguucuuccu

SEQ ID NO: 70502 - RNA, 21 nt, Artificial Sequence
  Oligomer
uucucuuucucccucagcgga

SEQ ID NO: 70503 - RNA, 21 nt, Artificial Sequence
  Oligomer
uuguagcuuggcauucugcuc

SEQ ID NO: 70504 - RNA, 21 nt, Artificial Sequence
  Oligomer
gaaacaucggcaucaucuugg

SEQ ID NO: 70505 - RNA, 21 nt, Artificial Sequence
  Oligomer
acuuuugacacagccaggacg

SEQ ID NO: 70506 - RNA, 21 nt, Artificial Sequence
  Oligomer
uuuuagcuuagcuuccugauu

SEQ ID NO: 70507 - RNA, 21 nt, Artificial Sequence
  Oligomer
acuuuaagcgcuguuccuuag

SEQ ID NO: 70508 - RNA, 21 nt, Artificial Sequence
  Oligomer
agucagauccauccuaggacu

SEQ ID NO: 70509 - RNA, 21 nt, Artificial Sequence
  Oligomer
auguccucuaauggugaauuc

SEQ ID NO: 70510 - RNA, 21 nt, Artificial Sequence
  Oligomer
ucuucuagagacauucuucau

SEQ ID NO: 70511 - RNA, 21 nt, Artificial Sequence
  Oligomer
ucuagagacauucuucaucgc

SEQ ID NO: 70512 - RNA, 21 nt, Artificial Sequence
  Oligomer
uagagacauucuucaucgcuu

SEQ ID NO: 70513 - RNA, 21 nt, Artificial Sequence
  Oligomer
uucaggccaagcuccuuuguc

SEQ ID NO: 70514 - RNA, 21 nt, Artificial Sequence
  Oligomer
gguuuaauucuuggguacagu

SEQ ID NO: 70515 - RNA, 21 nt, Artificial Sequence
  Oligomer
ucauaaucccaaagcgcauaa

SEQ ID NO: 70516 - RNA, 21 nt, Artificial Sequence
  Oligomer
uaaucccaaagcgcauaaaug

SEQ ID NO: 70517 - RNA, 21 nt, Artificial Sequence
  Oligomer
ucugcagcagucugcauguca

SEQ ID NO: 70518 - RNA, 21 nt, Artificial Sequence
  Oligomer
aauggaguccauccaucacua

SEQ ID NO: 70519 - RNA, 21 nt, Artificial Sequence
  Oligomer
ucacuaucagcagcauuuaca

SEQ ID NO: 70520 - RNA, 21 nt, Artificial Sequence
  Oligomer
uucguuccucugacuuccaaa

SEQ ID NO: 70521 - RNA, 21 nt, Artificial Sequence
  Oligomer
ucguuuucaugguucuccuga

SEQ ID NO: 70522 - RNA, 21 nt, Artificial Sequence
  Oligomer
uauuugcaaccugagcauccc

SEQ ID NO: 70523 - RNA, 21 nt, Artificial Sequence
  Oligomer
gcucuugauucaauuuguuuc

SEQ ID NO: 70524 - RNA, 21 nt, Artificial Sequence
  Oligomer
cuuagcugcagcuccuuauag

SEQ ID NO: 70525 - RNA, 21 nt, Artificial Sequence
  Oligomer
auuuccuccacaaguuuccca

SEQ ID NO: 70526 - RNA, 21 nt, Artificial Sequence
  Oligomer
aacuuuaagcgcuguuccuua

SEQ ID NO: 70527 - RNA, 21 nt, Artificial Sequence
  Oligomer
cuauuaacaccguucuccuuu

SEQ ID NO: 70528 - RNA, 21 nt, Artificial Sequence
  Oligomer
cuguuuuuaaagucagcuaug

SEQ ID NO: 70529 - RNA, 21 nt, Artificial Sequence
  Oligomer
aguucuucacugacaauauac

SEQ ID NO: 70530 - RNA, 21 nt, Artificial Sequence
  Oligomer
augugacggcacugguccuuu

SEQ ID NO: 70531 - RNA, 21 nt, Artificial Sequence
  Oligomer
aacaggacagagagcugauuu

SEQ ID NO: 70532 - RNA, 21 nt, Artificial Sequence
  Oligomer
uguggaugauugucaugcagu

SEQ ID NO: 70533 - RNA, 21 nt, Artificial Sequence
  Oligomer
ugcccaucuucuccugaacuc

SEQ ID NO: 70534 - RNA, 21 nt, Artificial Sequence
  Oligomer
uccugaacuccauaaagaaau

SEQ ID NO: 70535 - RNA, 21 nt, Artificial Sequence
  Oligomer
uacuccuccagguacacauca

SEQ ID NO: 70536 - RNA, 21 nt, Artificial Sequence
  Oligomer
ugguucuucuggguuauucug

SEQ ID NO: 70537 - RNA, 21 nt, Artificial Sequence
  Oligomer
ucuggagauuugggcuguugu

SEQ ID NO: 70538 - RNA, 21 nt, Artificial Sequence
  Oligomer
cacagaagcugacuuggaugg

SEQ ID NO: 70539 - RNA, 21 nt, Artificial Sequence
  Oligomer
uauggugguccucugauauaa

SEQ ID NO: 70540 - RNA, 21 nt, Artificial Sequence
  Oligomer
uugaagaacaucaaacauucg

SEQ ID NO: 70541 - RNA, 21 nt, Artificial Sequence
  Oligomer
auucgcucauuauccgcaacu

SEQ ID NO: 70542 - RNA, 21 nt, Artificial Sequence
  Oligomer
cuugaaaaguguggcccucug

SEQ ID NO: 70543 - RNA, 21 nt, Artificial Sequence
  Oligomer
ugcugguuuugguuuaguucc

SEQ ID NO: 70544 - RNA, 21 nt, Artificial Sequence
  Oligomer
ucccgcaagauaucuucacug

SEQ ID NO: 70545 - RNA, 21 nt, Artificial Sequence
  Oligomer
uuccuccacaaguuucccauu

SEQ ID NO: 70546 - RNA, 21 nt, Artificial Sequence
  Oligomer
uucuuguagaaaacaggauug

SEQ ID NO: 70547 - RNA, 21 nt, Artificial Sequence
  Oligomer
cuccuuugucuugguuuaauu

SEQ ID NO: 70548 - RNA, 21 nt, Artificial Sequence
  Oligomer
uucccuguggaugauugucau

SEQ ID NO: 70549 - RNA, 21 nt, Artificial Sequence
  Oligomer
uaucugcagcagucugcaugu

SEQ ID NO: 70550 - RNA, 21 nt, Artificial Sequence
  Oligomer
uuacaugaggcagcacaaugu

SEQ ID NO: 70551 - RNA, 21 nt, Artificial Sequence
  Oligomer
uugguucuucuggguuauucu

SEQ ID NO: 70552 - RNA, 21 nt, Artificial Sequence
  Oligomer
ucaggcucauaaucaaggccu

SEQ ID NO: 70553 - RNA, 21 nt, Artificial Sequence
  Oligomer
ucacuguucucuguacuggca

SEQ ID NO: 70554 - RNA, 21 nt, Artificial Sequence
  Oligomer
acauguaaauauggauucugg

SEQ ID NO: 70555 - RNA, 21 nt, Artificial Sequence
  Oligomer
uuuuuccuggcgccugcuguu

SEQ ID NO: 70556 - RNA, 21 nt, Artificial Sequence
  Oligomer
auugaacuugcugccacgguc

SEQ ID NO: 70557 - RNA, 21 nt, Artificial Sequence
  Oligomer
aacaggaggugguacuuuagc

SEQ ID NO: 70558 - RNA, 21 nt, Artificial Sequence
  Oligomer
uugauccagagcauucccagu

SEQ ID NO: 70559 - RNA, 21 nt, Artificial Sequence
  Oligomer
auuguuucuggaguaacugga

SEQ ID NO: 70560 - RNA, 21 nt, Artificial Sequence
  Oligomer
acuggaacuucugugaagugc

SEQ ID NO: 70561 - RNA, 21 nt, Artificial Sequence
  Oligomer
ucaguucuucuacuuuugaca

SEQ ID NO: 70562 - RNA, 21 nt, Artificial Sequence
  Oligomer
ucccucuguuuuugcuggaac

SEQ ID NO: 70563 - RNA, 21 nt, Artificial Sequence
  Oligomer
auuguugcugggcuucaaucu

SEQ ID NO: 70564 - RNA, 21 nt, Artificial Sequence
  Oligomer
uucagcaagagucagauccau

SEQ ID NO: 70565 - RNA, 21 nt, Artificial Sequence
  Oligomer
uuguucacugacaaccaacua

SEQ ID NO: 70566 - RNA, 21 nt, Artificial Sequence
  Oligomer
uauacuuaucugagugcuaca

SEQ ID NO: 70567 - RNA, 21 nt, Artificial Sequence
  Oligomer
ucaauccuucauucucuucua

SEQ ID NO: 70568 - RNA, 21 nt, Artificial Sequence
  Oligomer
agucuugugaaauuuuugcca

SEQ ID NO: 70569 - RNA, 21 nt, Artificial Sequence
  Oligomer
ugagauacacgguaagaaaca

SEQ ID NO: 70570 - RNA, 21 nt, Artificial Sequence
  Oligomer
aucacuaucagcagcauuuac

SEQ ID NO: 70571 - RNA, 21 nt, Artificial Sequence
  Oligomer
uuuguccuuuuaccaggaggc

SEQ ID NO: 70572 - RNA, 21 nt, Artificial Sequence
  Oligomer
uggagauuugggcuguugucu

SEQ ID NO: 70573 - RNA, 21 nt, Artificial Sequence
  Oligomer
uuuagaggccuuggugcguua

SEQ ID NO: 70574 - RNA, 21 nt, Artificial Sequence
  Oligomer
uugauucugggcagcagcaau

SEQ ID NO: 70575 - RNA, 21 nt, Artificial Sequence
  Oligomer
ucugggcagcagcaauuacag

SEQ ID NO: 70576 - RNA, 21 nt, Artificial Sequence
  Oligomer
ucuugcuuagaaccuggagaa

SEQ ID NO: 70577 - RNA, 21 nt, Artificial Sequence
  Oligomer
agcggaaccucuccaucauca

SEQ ID NO: 70578 - RNA, 21 nt, Artificial Sequence
  Oligomer
uccaucaucaacuugauccag

SEQ ID NO: 70579 - RNA, 21 nt, Artificial Sequence
  Oligomer
ugggcagugucuguauuuuca

SEQ ID NO: 70580 - RNA, 21 nt, Artificial Sequence
  Oligomer
uugcuguagagcugccuucuu

SEQ ID NO: 70581 - RNA, 21 nt, Artificial Sequence
  Oligomer
uacuuuugacacagccaggac

SEQ ID NO: 70582 - RNA, 21 nt, Artificial Sequence
  Oligomer
aagugcucucacuuuuuuuag

SEQ ID NO: 70583 - RNA, 21 nt, Artificial Sequence
  Oligomer
uuguugcuguugucgcugauc

SEQ ID NO: 70584 - RNA, 21 nt, Artificial Sequence
  Oligomer
uuuaagcgcuguuccuuaguu

SEQ ID NO: 70585 - RNA, 21 nt, Artificial Sequence
  Oligomer
uucaaucuguugcugcuggcg

SEQ ID NO: 70586 - RNA, 21 nt, Artificial Sequence
  Oligomer
ugguuuaggagcagcugcuga

SEQ ID NO: 70587 - RNA, 21 nt, Artificial Sequence
  Oligomer
uucucuucuagagacauucuu

SEQ ID NO: 70588 - RNA, 21 nt, Artificial Sequence
  Oligomer
augauugucaugcagucuccu

SEQ ID NO: 70589 - RNA, 21 nt, Artificial Sequence
  Oligomer
uccugagaucuugguccacuc

SEQ ID NO: 70590 - RNA, 21 nt, Artificial Sequence
  Oligomer
auucucuguacaaggucaaau

SEQ ID NO: 70591 - RNA, 21 nt, Artificial Sequence
  Oligomer
acaggcuuaccauauacacuu

SEQ ID NO: 70592 - RNA, 21 nt, Artificial Sequence
  Oligomer
augagucuuggucaacgcgcu

SEQ ID NO: 70593 - RNA, 21 nt, Artificial Sequence
  Oligomer
uggcuuaaugucugaaggugg

SEQ ID NO: 70594 - RNA, 21 nt, Artificial Sequence
  Oligomer
auucccagugcuuugagguac

SEQ ID NO: 70595 - RNA, 21 nt, Artificial Sequence
  Oligomer
uacagaagcagagccuuggcu

SEQ ID NO: 70596 - RNA, 21 nt, Artificial Sequence
  Oligomer
auuuucuuuuugcuguagagc

SEQ ID NO: 70597 - RNA, 21 nt, Artificial Sequence
  Oligomer
uccaugacugccacuucugaa

SEQ ID NO: 70598 - RNA, 21 nt, Artificial Sequence
  Oligomer
ucaaacacucccucuguuguu

SEQ ID NO: 70599 - RNA, 21 nt, Artificial Sequence
  Oligomer
uagcuuggcauucugcucuug

SEQ ID NO: 70600 - RNA, 21 nt, Artificial Sequence
  Oligomer
uccacguggccuuuaagugcu

SEQ ID NO: 70601 - RNA, 21 nt, Artificial Sequence
  Oligomer
uuauuguucacugacaaccaa

SEQ ID NO: 70602 - RNA, 21 nt, Artificial Sequence
  Oligomer
ucuucacugacaauauacaag

SEQ ID NO: 70603 - RNA, 21 nt, Artificial Sequence
  Oligomer
agcugauuucccaacugccca

SEQ ID NO: 70604 - RNA, 21 nt, Artificial Sequence
  Oligomer
uaucugagugcuacacgggac

SEQ ID NO: 70605 - RNA, 21 nt, Artificial Sequence
  Oligomer
aucgcuuucaagcuacauugu

SEQ ID NO: 70606 - RNA, 21 nt, Artificial Sequence
  Oligomer
uucugagguucauaaucccaa

SEQ ID NO: 70607 - RNA, 21 nt, Artificial Sequence
  Oligomer
ucugagguucauaaucccaaa

SEQ ID NO: 70608 - RNA, 21 nt, Artificial Sequence
  Oligomer
cccaaagcgcauaaaugacuc

SEQ ID NO: 70609 - RNA, 21 nt, Artificial Sequence
  Oligomer
ucagcagcauuuacauuuaca

SEQ ID NO: 70610 - RNA, 21 nt, Artificial Sequence
  Oligomer
auuccaugagcgauacgcucu

SEQ ID NO: 70611 - RNA, 21 nt, Artificial Sequence
  Oligomer
uacacaucaagcacaugugga

SEQ ID NO: 70612 - RNA, 21 nt, Artificial Sequence
  Oligomer
uccacauguaaauauggauuc

SEQ ID NO: 70613 - RNA, 21 nt, Artificial Sequence
  Oligomer
auauggauucuggauuucuac

SEQ ID NO: 70614 - RNA, 21 nt, Artificial Sequence
  Oligomer
uaugaugggacagagaugguc

SEQ ID NO: 70615 - RNA, 21 nt, Artificial Sequence
  Oligomer
gugcguuagacaguuucuuuc

SEQ ID NO: 70616 - RNA, 21 nt, Artificial Sequence
  Oligomer
ucauuauccgcaacuggacgu

SEQ ID NO: 70617 - RNA, 21 nt, Artificial Sequence
  Oligomer
auacacuugaaaaguguggcc

SEQ ID NO: 70618 - RNA, 21 nt, Artificial Sequence
  Oligomer
agccugcuggaaguuuuuucc

SEQ ID NO: 70619 - RNA, 21 nt, Artificial Sequence
  Oligomer
ccugcuguugcguauacaugg

SEQ ID NO: 70620 - RNA, 21 nt, Artificial Sequence
  Oligomer
uuggccaaccgaagguaugcu

SEQ ID NO: 70621 - RNA, 21 nt, Artificial Sequence
  Oligomer
ucagaguaccaaaggaaggug

SEQ ID NO: 70622 - RNA, 21 nt, Artificial Sequence
  Oligomer
gguucuuugcacagauccacc

SEQ ID NO: 70623 - RNA, 21 nt, Artificial Sequence
  Oligomer
ugguagauuuucuuuuugcug

SEQ ID NO: 70624 - RNA, 21 nt, Artificial Sequence
  Oligomer
ucucagcuauuucuuuuagcc

SEQ ID NO: 70625 - RNA, 21 nt, Artificial Sequence
  Oligomer
ucaaucuguugcugcuggcga

SEQ ID NO: 70626 - RNA, 21 nt, Artificial Sequence
  Oligomer
ugccauuuccugaaguucagc

SEQ ID NO: 70627 - RNA, 21 nt, Artificial Sequence
  Oligomer
uaagucuguagcaaguuucua

SEQ ID NO: 70628 - RNA, 21 nt, Artificial Sequence
  Oligomer
acagauuaaaauucagccuac

SEQ ID NO: 70629 - RNA, 21 nt, Artificial Sequence
  Oligomer
guuauuguucacugacaacca

SEQ ID NO: 70630 - RNA, 21 nt, Artificial Sequence
  Oligomer
aaucagagacagcgaugugac

SEQ ID NO: 70631 - RNA, 21 nt, Artificial Sequence
  Oligomer
ucgauauucaccaggaacuuu

SEQ ID NO: 70632 - RNA, 21 nt, Artificial Sequence
  Oligomer
ucuuggguacagucccagcaa

SEQ ID NO: 70633 - RNA, 21 nt, Artificial Sequence
  Oligomer
cuucccuguggaugauuguca

SEQ ID NO: 70634 - RNA, 21 nt, Artificial Sequence
  Oligomer
acaauguaauggaguccaucc

SEQ ID NO: 70635 - RNA, 21 nt, Artificial Sequence
  Oligomer
auuuggcccauuaggacccuc

SEQ ID NO: 70636 - RNA, 21 nt, Artificial Sequence
  Oligomer
guugaagaacaucaaacauuc

SEQ ID NO: 70637 - RNA, 21 nt, Artificial Sequence
  Oligomer
uggacggaacaacuguugaca

SEQ ID NO: 70638 - RNA, 21 nt, Artificial Sequence
  Oligomer
augucugaagguggcugauua

SEQ ID NO: 70639 - RNA, 21 nt, Artificial Sequence
  Oligomer
uucagccaaauggcaaucacu

SEQ ID NO: 70640 - RNA, 21 nt, Artificial Sequence
  Oligomer
ucugguucuuccucagaguac

SEQ ID NO: 70641 - RNA, 21 nt, Artificial Sequence
  Oligomer
uugaaggacuccaaucagggc

SEQ ID NO: 70642 - RNA, 21 nt, Artificial Sequence
  Oligomer
aaugaccaaggaaccauccgg

SEQ ID NO: 70643 - RNA, 21 nt, Artificial Sequence
  Oligomer
acugguagauuuucuuuuugc

SEQ ID NO: 70644 - RNA, 21 nt, Artificial Sequence
  Oligomer
ucagcaacuuguugcuguugu

SEQ ID NO: 70645 - RNA, 21 nt, Artificial Sequence
  Oligomer
guugccagcaauuguugcugg

SEQ ID NO: 70646 - RNA, 21 nt, Artificial Sequence
  Oligomer
uaggacuauuaacaccguucu

SEQ ID NO: 70647 - RNA, 21 nt, Artificial Sequence
  Oligomer
ugcugaaaacacucaacagga

SEQ ID NO: 70648 - RNA, 21 nt, Artificial Sequence
  Oligomer
uuaucugagugcuacacggga

SEQ ID NO: 70649 - RNA, 21 nt, Artificial Sequence
  Oligomer
agaugcuuuauuucaucacgc

SEQ ID NO: 70650 - RNA, 21 nt, Artificial Sequence
  Oligomer
uccucuaauggugaauucuuc

SEQ ID NO: 70651 - RNA, 21 nt, Artificial Sequence
  Oligomer
uggaacauaucccuccuuauc

SEQ ID NO: 70652 - RNA, 21 nt, Artificial Sequence
  Oligomer
aucaucauucugagguucaua

SEQ ID NO: 70653 - RNA, 21 nt, Artificial Sequence
  Oligomer
ugaacuccauaaagaaauugg

SEQ ID NO: 70654 - RNA, 21 nt, Artificial Sequence
  Oligomer
cuccauuuccucgcacuuauc

SEQ ID NO: 70655 - RNA, 23 nt, Artificial Sequence
  Oligomer
cuauaaggagcugcagcuaagaa

SEQ ID NO: 70656 - RNA, 23 nt, Artificial Sequence
  Oligomer
cguaguucuauuacagagccaga

SEQ ID NO: 70657 - RNA, 23 nt, Artificial Sequence
  Oligomer
cagaauaacccagaagaaccaaa

SEQ ID NO: 70658 - RNA, 23 nt, Artificial Sequence
  Oligomer
gaacguccaguugcggauaauga

SEQ ID NO: 70659 - RNA, 23 nt, Artificial Sequence
  Oligomer
cguguagcacucagauaaguaua

SEQ ID NO: 70660 - RNA, 23 nt, Artificial Sequence
  Oligomer
cagagaauuauuuaugagguuga

SEQ ID NO: 70661 - RNA, 23 nt, Artificial Sequence
  Oligomer
caauauauuccauguauacgcaa

SEQ ID NO: 70662 - RNA, 23 nt, Artificial Sequence
  Oligomer
caaacuugcguaaaacuggcuca

SEQ ID NO: 70663 - RNA, 23 nt, Artificial Sequence
  Oligomer
guaccaccuccuguuccuacaaa

SEQ ID NO: 70664 - RNA, 23 nt, Artificial Sequence
  Oligomer
ccauauuuacauguggagcccga

SEQ ID NO: 70665 - RNA, 23 nt, Artificial Sequence
  Oligomer
ccuguaauugcugcugcccagaa

SEQ ID NO: 70666 - RNA, 23 nt, Artificial Sequence
  Oligomer
gggccacacuuuucaaguguaua

SEQ ID NO: 70667 - RNA, 23 nt, Artificial Sequence
  Oligomer
caaacuaaucagccaccuucaga

SEQ ID NO: 70668 - RNA, 23 nt, Artificial Sequence
  Oligomer
gaagaacugaccaggcagcuaga

SEQ ID NO: 70669 - RNA, 23 nt, Artificial Sequence
  Oligomer
ccauuagaggacauuuagcguga

SEQ ID NO: 70670 - RNA, 23 nt, Artificial Sequence
  Oligomer
ccaccuucagacauuaagccaga

SEQ ID NO: 70671 - RNA, 23 nt, Artificial Sequence
  Oligomer
ugguaaaaggacaaacuugcgua

SEQ ID NO: 70672 - RNA, 23 nt, Artificial Sequence
  Oligomer
caacagcaggcgccaggaaaaaa

SEQ ID NO: 70673 - RNA, 23 nt, Artificial Sequence
  Oligomer
cacuuuucaaguguauaugguaa

SEQ ID NO: 70674 - RNA, 23 nt, Artificial Sequence
  Oligomer
ccucuauaaggagcugcagcuaa

SEQ ID NO: 70675 - RNA, 23 nt, Artificial Sequence
  Oligomer
gauaagugcgaggaaauggagga

SEQ ID NO: 70676 - RNA, 23 nt, Artificial Sequence
  Oligomer
cguaaaacuggcucagagcguau

SEQ ID NO: 70677 - RNA, 23 nt, Artificial Sequence
  Oligomer
caaagaacccggcgagagugauu

SEQ ID NO: 70678 - RNA, 23 nt, Artificial Sequence
  Oligomer
agaaguuccaguuacuccagaaa

SEQ ID NO: 70679 - RNA, 23 nt, Artificial Sequence
  Oligomer
gcuagagaugcucaagaacggca

SEQ ID NO: 70680 - RNA, 23 nt, Artificial Sequence
  Oligomer
gcaugacaaucauccacagggaa

SEQ ID NO: 70681 - RNA, 23 nt, Artificial Sequence
  Oligomer
cagcaacaaguugcugagcagga

SEQ ID NO: 70682 - RNA, 23 nt, Artificial Sequence
  Oligomer
guguuuucagcagcugcuccuaa

SEQ ID NO: 70683 - RNA, 23 nt, Artificial Sequence
  Oligomer
gaaguaauacgauuauuuuuggc

SEQ ID NO: 70684 - RNA, 23 nt, Artificial Sequence
  Oligomer
gucuaacgcaccaaggccucuaa

SEQ ID NO: 70685 - RNA, 23 nt, Artificial Sequence
  Oligomer
gagagugauugccauuuggcuga

SEQ ID NO: 70686 - RNA, 23 nt, Artificial Sequence
  Oligomer
agaacugaccaggcagcuagaga

SEQ ID NO: 70687 - RNA, 23 nt, Artificial Sequence
  Oligomer
aagaaauagcugagaaucaggaa

SEQ ID NO: 70688 - RNA, 23 nt, Artificial Sequence
  Oligomer
gagcuuggccugaaacuuccaca

SEQ ID NO: 70689 - RNA, 23 nt, Artificial Sequence
  Oligomer
gcuucacaaacuaaaggcucuaa

SEQ ID NO: 70690 - RNA, 23 nt, Artificial Sequence
  Oligomer
ccggaugguuccuuggucauuca

SEQ ID NO: 70691 - RNA, 23 nt, Artificial Sequence
  Oligomer
aaagaaauagcugagaaucagga

SEQ ID NO: 70692 - RNA, 23 nt, Artificial Sequence
  Oligomer
guagaaucuuguuuguaggcuga

SEQ ID NO: 70693 - RNA, 23 nt, Artificial Sequence
  Oligomer
uaaaccaguccuccugccagaaa

SEQ ID NO: 70694 - RNA, 23 nt, Artificial Sequence
  Oligomer
ucauuuauugggcaguugggaaa

SEQ ID NO: 70695 - RNA, 23 nt, Artificial Sequence
  Oligomer
caacagcagcacccagagaacau

SEQ ID NO: 70696 - RNA, 23 nt, Artificial Sequence
  Oligomer
ggccacacuuuucaaguguauau

SEQ ID NO: 70697 - RNA, 23 nt, Artificial Sequence
  Oligomer
ugaugauggagagguuccgcuga

SEQ ID NO: 70698 - RNA, 23 nt, Artificial Sequence
  Oligomer
cagacugcugcagauaagugcga

SEQ ID NO: 70699 - RNA, 23 nt, Artificial Sequence
  Oligomer
cauauuuacauguggagcccgaa

SEQ ID NO: 70700 - RNA, 23 nt, Artificial Sequence
  Oligomer
ccuguuucuucaguucaggagaa

SEQ ID NO: 70701 - RNA, 23 nt, Artificial Sequence
  Oligomer
aaucaacagcagcacccagagaa

SEQ ID NO: 70702 - RNA, 23 nt, Artificial Sequence
  Oligomer
uacuaugccucggaugcccucaa

SEQ ID NO: 70703 - RNA, 23 nt, Artificial Sequence
  Oligomer
cuccauuacauugugcugccuca

SEQ ID NO: 70704 - RNA, 23 nt, Artificial Sequence
  Oligomer
agaauaacccagaagaaccaaau

SEQ ID NO: 70705 - RNA, 23 nt, Artificial Sequence
  Oligomer
cauccaagucagcuucugugacu

SEQ ID NO: 70706 - RNA, 23 nt, Artificial Sequence
  Oligomer
gcgcuuugggauuaugaaccuca

SEQ ID NO: 70707 - RNA, 23 nt, Artificial Sequence
  Oligomer
gacucuugcugaacuucaggaaa

SEQ ID NO: 70708 - RNA, 23 nt, Artificial Sequence
  Oligomer
cuuuauggaguucaggagaagau

SEQ ID NO: 70709 - RNA, 23 nt, Artificial Sequence
  Oligomer
gaaagcccaguagaaauccagaa

SEQ ID NO: 70710 - RNA, 23 nt, Artificial Sequence
  Oligomer
gaaagaauuccucggccacucag

SEQ ID NO: 70711 - RNA, 23 nt, Artificial Sequence
  Oligomer
auuuauuccaauagccagggcaa

SEQ ID NO: 70712 - RNA, 23 nt, Artificial Sequence
  Oligomer
cagaaguuccaguuacuccagaa

SEQ ID NO: 70713 - RNA, 23 nt, Artificial Sequence
  Oligomer
caacaagaucagcgacaacagca

SEQ ID NO: 70714 - RNA, 23 nt, Artificial Sequence
  Oligomer
gaucauuuauugggcaguuggga

SEQ ID NO: 70715 - RNA, 23 nt, Artificial Sequence
  Oligomer
cuugaaagcgaugaagaaugucu

SEQ ID NO: 70716 - RNA, 23 nt, Artificial Sequence
  Oligomer
ggaguucaggagaagaugggcau

SEQ ID NO: 70717 - RNA, 23 nt, Artificial Sequence
  Oligomer
ccaaaucuccagaauaacccaga

SEQ ID NO: 70718 - RNA, 23 nt, Artificial Sequence
  Oligomer
aguuguuccguccaugggaacua

SEQ ID NO: 70719 - RNA, 23 nt, Artificial Sequence
  Oligomer
gacaaacuaaucagccaccuuca

SEQ ID NO: 70720 - RNA, 23 nt, Artificial Sequence
  Oligomer
acaauaugcagagacguggugga

SEQ ID NO: 70721 - RNA, 23 nt, Artificial Sequence
  Oligomer
gcuaagaaacaaauugaaucaag

SEQ ID NO: 70722 - RNA, 23 nt, Artificial Sequence
  Oligomer
cuguuaagaagaaguaauacgau

SEQ ID NO: 70723 - RNA, 23 nt, Artificial Sequence
  Oligomer
caaguguauaugguaagccugua

SEQ ID NO: 70724 - RNA, 23 nt, Artificial Sequence
  Oligomer
guuugaugcaguagaccagucca

SEQ ID NO: 70725 - RNA, 23 nt, Artificial Sequence
  Oligomer
caaggcucugcuucuguaccuca

SEQ ID NO: 70726 - RNA, 23 nt, Artificial Sequence
  Oligomer
acagaaguuccaguuacuccaga

SEQ ID NO: 70727 - RNA, 23 nt, Artificial Sequence
  Oligomer
ggcaacuaaggaacagcgcuuaa

SEQ ID NO: 70728 - RNA, 23 nt, Artificial Sequence
  Oligomer
ucagcagcugcuccuaaaccagu

SEQ ID NO: 70729 - RNA, 23 nt, Artificial Sequence
  Oligomer
gcuccuucuccaggccuugauua

SEQ ID NO: 70730 - RNA, 23 nt, Artificial Sequence
  Oligomer
gccuguuucuucaguucaggaga

SEQ ID NO: 70731 - RNA, 23 nt, Artificial Sequence
  Oligomer
aacaguuguuccguccaugggaa

SEQ ID NO: 70732 - RNA, 23 nt, Artificial Sequence
  Oligomer
cagacauuaagccagacggaagu

SEQ ID NO: 70733 - RNA, 23 nt, Artificial Sequence
  Oligomer
gacaaucagucugcaguggcuga

SEQ ID NO: 70734 - RNA, 23 nt, Artificial Sequence
  Oligomer
caguaauuagauguagaaucuug

SEQ ID NO: 70735 - RNA, 23 nt, Artificial Sequence
  Oligomer
ccgucacaucgcugucucugauu

SEQ ID NO: 70736 - RNA, 23 nt, Artificial Sequence
  Oligomer
guuucuuaccguguaucucagua

SEQ ID NO: 70737 - RNA, 23 nt, Artificial Sequence
  Oligomer
gaagcuuuuauaucagaggacca

SEQ ID NO: 70738 - RNA, 23 nt, Artificial Sequence
  Oligomer
gaugaaaauacagacacugccca

SEQ ID NO: 70739 - RNA, 23 nt, Artificial Sequence
  Oligomer
uguuugaauaagcguaauucaga

SEQ ID NO: 70740 - RNA, 23 nt, Artificial Sequence
  Oligomer
aaauggcaucucgccagcagcaa

SEQ ID NO: 70741 - RNA, 23 nt, Artificial Sequence
  Oligomer
aagcuacgguaccaguaauuaga

SEQ ID NO: 70742 - RNA, 23 nt, Artificial Sequence
  Oligomer
gcuuugggauuaugaaccucaga

SEQ ID NO: 70743 - RNA, 23 nt, Artificial Sequence
  Oligomer
cguuaaguuccugguacaguuug

SEQ ID NO: 70744 - RNA, 23 nt, Artificial Sequence
  Oligomer
gaugaaggcaucacggcucuuca

SEQ ID NO: 70745 - RNA, 23 nt, Artificial Sequence
  Oligomer
cuuucuuaucuaauccuuaccga

SEQ ID NO: 70746 - RNA, 23 nt, Artificial Sequence
  Oligomer
gagggccacacuuuucaagugua

SEQ ID NO: 70747 - RNA, 23 nt, Artificial Sequence
  Oligomer
aagacucauaccagagggccaca

SEQ ID NO: 70748 - RNA, 23 nt, Artificial Sequence
  Oligomer
guuguuccguccaugggaacuaa

SEQ ID NO: 70749 - RNA, 23 nt, Artificial Sequence
  Oligomer
cuggcaacuaaggaacagcgcuu

SEQ ID NO: 70750 - RNA, 23 nt, Artificial Sequence
  Oligomer
cauagcugacuuuaaaaacaguu

SEQ ID NO: 70751 - RNA, 23 nt, Artificial Sequence
  Oligomer
cugcugcagauaagugcgaggaa

SEQ ID NO: 70752 - RNA, 23 nt, Artificial Sequence
  Oligomer
gugugugcaggccacacagaaau

SEQ ID NO: 70753 - RNA, 23 nt, Artificial Sequence
  Oligomer
aaucagccaccuucagacauuaa

SEQ ID NO: 70754 - RNA, 23 nt, Artificial Sequence
  Oligomer
caauaugcagagacgugguggau

SEQ ID NO: 70755 - RNA, 23 nt, Artificial Sequence
  Oligomer
ccuauauccagucgucuacuaug

SEQ ID NO: 70756 - RNA, 23 nt, Artificial Sequence
  Oligomer
agcaaugggaaacuuguggagga

SEQ ID NO: 70757 - RNA, 23 nt, Artificial Sequence
  Oligomer
agagcacuuaaaggccacgugga

SEQ ID NO: 70758 - RNA, 23 nt, Artificial Sequence
  Oligomer
cauuuauugggcaguugggaaau

SEQ ID NO: 70759 - RNA, 23 nt, Artificial Sequence
  Oligomer
aucauuuauugggcaguugggaa

SEQ ID NO: 70760 - RNA, 23 nt, Artificial Sequence
  Oligomer
cagaaugaugaugagcugcccau

SEQ ID NO: 70761 - RNA, 23 nt, Artificial Sequence
  Oligomer
ucuuuauggaguucaggagaaga

SEQ ID NO: 70762 - RNA, 23 nt, Artificial Sequence
  Oligomer
cuguaauugcugcugcccagaau

SEQ ID NO: 70763 - RNA, 23 nt, Artificial Sequence
  Oligomer
ugguacucugaggaagaaccaga

SEQ ID NO: 70764 - RNA, 23 nt, Artificial Sequence
  Oligomer
cguaauauuugucaagaucauag

SEQ ID NO: 70765 - RNA, 23 nt, Artificial Sequence
  Oligomer
uguuuucagcagcugcuccuaaa

SEQ ID NO: 70766 - RNA, 23 nt, Artificial Sequence
  Oligomer
aauuaaaccaagacaaaggagcu

SEQ ID NO: 70767 - RNA, 23 nt, Artificial Sequence
  Oligomer
acuugcugggacuguacccaaga

SEQ ID NO: 70768 - RNA, 23 nt, Artificial Sequence
  Oligomer
uaacuugcugggacuguacccaa

SEQ ID NO: 70769 - RNA, 23 nt, Artificial Sequence
  Oligomer
cagaauccauauuuacaugugga

SEQ ID NO: 70770 - RNA, 23 nt, Artificial Sequence
  Oligomer
guaauugcugcugcccagaauca

SEQ ID NO: 70771 - RNA, 23 nt, Artificial Sequence
  Oligomer
ggaaaaaacuuccagcaggcugu

SEQ ID NO: 70772 - RNA, 23 nt, Artificial Sequence
  Oligomer
cagccuuccaaagacaccuuacu

SEQ ID NO: 70773 - RNA, 23 nt, Artificial Sequence
  Oligomer
uugaaucaagagcagaaugccaa

SEQ ID NO: 70774 - RNA, 23 nt, Artificial Sequence
  Oligomer
gcucucuguccuguugaguguuu

SEQ ID NO: 70775 - RNA, 23 nt, Artificial Sequence
  Oligomer
aaaucagcucucuguccuguuga

SEQ ID NO: 70776 - RNA, 23 nt, Artificial Sequence
  Oligomer
gugucccguguagcacucagaua

SEQ ID NO: 70777 - RNA, 23 nt, Artificial Sequence
  Oligomer
uauuuaugagguugaugacccaa

SEQ ID NO: 70778 - RNA, 23 nt, Artificial Sequence
  Oligomer
cauggagaccaucucugucccau

SEQ ID NO: 70779 - RNA, 23 nt, Artificial Sequence
  Oligomer
cuuuuauaucagaggaccaccau

SEQ ID NO: 70780 - RNA, 23 nt, Artificial Sequence
  Oligomer
caacaguuguuccguccauggga

SEQ ID NO: 70781 - RNA, 23 nt, Artificial Sequence
  Oligomer
cuucaaaugcagaucuuuuccca

SEQ ID NO: 70782 - RNA, 23 nt, Artificial Sequence
  Oligomer
ggaugguuccuuggucauucagg

SEQ ID NO: 70783 - RNA, 23 nt, Artificial Sequence
  Oligomer
ugcaguaggucccuauauccagu

SEQ ID NO: 70784 - RNA, 23 nt, Artificial Sequence
  Oligomer
cugacucuugcugaacuucagga

SEQ ID NO: 70785 - RNA, 23 nt, Artificial Sequence
  Oligomer
gaaagcgaugaagaaugucucua

SEQ ID NO: 70786 - RNA, 23 nt, Artificial Sequence
  Oligomer
ccuucuccaggccuugauuauga

SEQ ID NO: 70787 - RNA, 23 nt, Artificial Sequence
  Oligomer
agugauugccauuuggcugaagu

SEQ ID NO: 70788 - RNA, 23 nt, Artificial Sequence
  Oligomer
gaacugaccaggcagcuagagau

SEQ ID NO: 70789 - RNA, 23 nt, Artificial Sequence
  Oligomer
cuaagcaaugggaaacuugugga

SEQ ID NO: 70790 - RNA, 23 nt, Artificial Sequence
  Oligomer
gaagaauucaccauuagaggaca

SEQ ID NO: 70791 - RNA, 23 nt, Artificial Sequence
  Oligomer
ccaaguuuaaaaagaaauggugu

SEQ ID NO: 70792 - RNA, 23 nt, Artificial Sequence
  Oligomer
cgcuuugggauuaugaaccucag

SEQ ID NO: 70793 - RNA, 23 nt, Artificial Sequence
  Oligomer
uggaguucaggagaagaugggca

SEQ ID NO: 70794 - RNA, 23 nt, Artificial Sequence
  Oligomer
uuucuuuauggaguucaggagaa

SEQ ID NO: 70795 - RNA, 23 nt, Artificial Sequence
  Oligomer
ugugugugcaggccacacagaaa

SEQ ID NO: 70796 - RNA, 23 nt, Artificial Sequence
  Oligomer
cuugauguguaccuggaggagua

SEQ ID NO: 70797 - RNA, 23 nt, Artificial Sequence
  Oligomer
gcuugauguguaccuggaggagu

SEQ ID NO: 70798 - RNA, 23 nt, Artificial Sequence
  Oligomer
ccaaauccagaggcuccacaugu

SEQ ID NO: 70799 - RNA, 23 nt, Artificial Sequence
  Oligomer
agaagaacugaccaggcagcuag

SEQ ID NO: 70800 - RNA, 23 nt, Artificial Sequence
  Oligomer
cgacaacagcaacaaguugcuga

SEQ ID NO: 70801 - RNA, 23 nt, Artificial Sequence
  Oligomer
ugaaacuuccacacagaauuuua

SEQ ID NO: 70802 - RNA, 23 nt, Artificial Sequence
  Oligomer
ugucuaacgcaccaaggccucua

SEQ ID NO: 70803 - RNA, 23 nt, Artificial Sequence
  Oligomer
cgaaagaauuccucggccacuca

SEQ ID NO: 70804 - RNA, 23 nt, Artificial Sequence
  Oligomer
ucuucaguucaggagaaccauga

SEQ ID NO: 70805 - RNA, 23 nt, Artificial Sequence
  Oligomer
cccagccuuccaaagacaccuua

SEQ ID NO: 70806 - RNA, 23 nt, Artificial Sequence
  Oligomer
cagacccuuucuccagguucuaa

SEQ ID NO: 70807 - RNA, 23 nt, Artificial Sequence
  Oligomer
cucuauaaggagcugcagcuaag

SEQ ID NO: 70808 - RNA, 23 nt, Artificial Sequence
  Oligomer
gaacagaugaauaauuuguucca

SEQ ID NO: 70809 - RNA, 23 nt, Artificial Sequence
  Oligomer
caacagcaacaaguugcugagca

SEQ ID NO: 70810 - RNA, 23 nt, Artificial Sequence
  Oligomer
acgucagcaggccauacuguguu

SEQ ID NO: 70811 - RNA, 23 nt, Artificial Sequence
  Oligomer
gaaccaaauccagaggcuccaca

SEQ ID NO: 70812 - RNA, 23 nt, Artificial Sequence
  Oligomer
gcuuuuauaucagaggaccacca

SEQ ID NO: 70813 - RNA, 23 nt, Artificial Sequence
  Oligomer
agugaugcugaccuagaagccuu

SEQ ID NO: 70814 - RNA, 23 nt, Artificial Sequence
  Oligomer
guucaggagaaccaugaaaacga

SEQ ID NO: 70815 - RNA, 23 nt, Artificial Sequence
  Oligomer
gcgccaggaaaaaacuuccagca

SEQ ID NO: 70816 - RNA, 23 nt, Artificial Sequence
  Oligomer
cagguucuaagcaagaaagucca

SEQ ID NO: 70817 - RNA, 23 nt, Artificial Sequence
  Oligomer
agagugauugccauuuggcugaa

SEQ ID NO: 70818 - RNA, 23 nt, Artificial Sequence
  Oligomer
gaguguuuucagcagcugcuccu

SEQ ID NO: 70819 - RNA, 23 nt, Artificial Sequence
  Oligomer
ucuguuaagaagaaguaauacga

SEQ ID NO: 70820 - RNA, 23 nt, Artificial Sequence
  Oligomer
caagucagcuucugugacugcca

SEQ ID NO: 70821 - RNA, 23 nt, Artificial Sequence
  Oligomer
uggagaccaucucugucccauca

SEQ ID NO: 70822 - RNA, 23 nt, Artificial Sequence
  Oligomer
guuucuucaguucaggagaacca

SEQ ID NO: 70823 - RNA, 23 nt, Artificial Sequence
  Oligomer
gagccuguuucuucaguucagga

SEQ ID NO: 70824 - RNA, 23 nt, Artificial Sequence
  Oligomer
ucaacagcagcacccagagaaca

SEQ ID NO: 70825 - RNA, 23 nt, Artificial Sequence
  Oligomer
agagaugcucaagaacggcagga

SEQ ID NO: 70826 - RNA, 23 nt, Artificial Sequence
  Oligomer
cagcaaaaacagagggagcucgu

SEQ ID NO: 70827 - RNA, 23 nt, Artificial Sequence
  Oligomer
ggaaaucagcucucuguccuguu

SEQ ID NO: 70828 - RNA, 23 nt, Artificial Sequence
  Oligomer
gaaauaaagcaucuacgucagca

SEQ ID NO: 70829 - RNA, 23 nt, Artificial Sequence
  Oligomer
ggaacgaaguucgcuucuuccuu

SEQ ID NO: 70830 - RNA, 23 nt, Artificial Sequence
  Oligomer
cuucugugacugccagcucagaa

SEQ ID NO: 70831 - RNA, 23 nt, Artificial Sequence
  Oligomer
cucauaccagagggccacacuuu

SEQ ID NO: 70832 - RNA, 23 nt, Artificial Sequence
  Oligomer
acauuaagccagacggaaguucu

SEQ ID NO: 70833 - RNA, 23 nt, Artificial Sequence
  Oligomer
aagaaacaaauugaaucaagagc

SEQ ID NO: 70834 - RNA, 23 nt, Artificial Sequence
  Oligomer
aaaguagaagaacugaccaggca

SEQ ID NO: 70835 - RNA, 23 nt, Artificial Sequence
  Oligomer
gaucagcgacaacagcaacaagu

SEQ ID NO: 70836 - RNA, 23 nt, Artificial Sequence
  Oligomer
cagcagcaacagauugaagccca

SEQ ID NO: 70837 - RNA, 23 nt, Artificial Sequence
  Oligomer
uaauaguccuaggauggaucuga

SEQ ID NO: 70838 - RNA, 23 nt, Artificial Sequence
  Oligomer
auauugucagugaagaacuguua

SEQ ID NO: 70839 - RNA, 23 nt, Artificial Sequence
  Oligomer
gacaauccuguuuucuacaagaa

SEQ ID NO: 70840 - RNA, 23 nt, Artificial Sequence
  Oligomer
gaauucaccauuagaggacauuu

SEQ ID NO: 70841 - RNA, 23 nt, Artificial Sequence
  Oligomer
gaaacuuccacacagaauuuuag

SEQ ID NO: 70842 - RNA, 23 nt, Artificial Sequence
  Oligomer
auuucuuuauggaguucaggaga

SEQ ID NO: 70843 - RNA, 23 nt, Artificial Sequence
  Oligomer
agugacaugcagacugcugcaga

SEQ ID NO: 70844 - RNA, 23 nt, Artificial Sequence
  Oligomer
cagaaaucguuaaguuccuggua

SEQ ID NO: 70845 - RNA, 23 nt, Artificial Sequence
  Oligomer
gaaguucgcuucuuccuucguca

SEQ ID NO: 70846 - RNA, 23 nt, Artificial Sequence
  Oligomer
gcuuuacugcuagauucgucuuu

SEQ ID NO: 70847 - RNA, 23 nt, Artificial Sequence
  Oligomer
agggccacacuuuucaaguguau

SEQ ID NO: 70848 - RNA, 23 nt, Artificial Sequence
  Oligomer
ucaauauauuccauguauacgca

SEQ ID NO: 70849 - RNA, 23 nt, Artificial Sequence
  Oligomer
auaccuucgguuggccaagacca

SEQ ID NO: 70850 - RNA, 23 nt, Artificial Sequence
  Oligomer
cuucagacauuaagccagacgga

SEQ ID NO: 70851 - RNA, 23 nt, Artificial Sequence
  Oligomer
gaaagagaagaaagugcguccgu

SEQ ID NO: 70852 - RNA, 23 nt, Artificial Sequence
  Oligomer
ucuguaccucaaagcacugggaa

SEQ ID NO: 70853 - RNA, 23 nt, Artificial Sequence
  Oligomer
gggaaaucagcucucuguccugu

SEQ ID NO: 70854 - RNA, 23 nt, Artificial Sequence
  Oligomer
caguugggaaaucagcucucugu

SEQ ID NO: 70855 - RNA, 23 nt, Artificial Sequence
  Oligomer
guuuucuacaagaauccugucua

SEQ ID NO: 70856 - RNA, 23 nt, Artificial Sequence
  Oligomer
uucuuagcugcagcuccuuauag

SEQ ID NO: 70857 - RNA, 23 nt, Artificial Sequence
  Oligomer
ucuggcucuguaauagaacuacg

SEQ ID NO: 70858 - RNA, 23 nt, Artificial Sequence
  Oligomer
uuugguucuucuggguuauucug

SEQ ID NO: 70859 - RNA, 23 nt, Artificial Sequence
  Oligomer
ucauuauccgcaacuggacguuc

SEQ ID NO: 70860 - RNA, 23 nt, Artificial Sequence
  Oligomer
uauacuuaucugagugcuacacg

SEQ ID NO: 70861 - RNA, 23 nt, Artificial Sequence
  Oligomer
ucaaccucauaaauaauucucug

SEQ ID NO: 70862 - RNA, 23 nt, Artificial Sequence
  Oligomer
uugcguauacauggaauauauug

SEQ ID NO: 70863 - RNA, 23 nt, Artificial Sequence
  Oligomer
ugagccaguuuuacgcaaguuug

SEQ ID NO: 70864 - RNA, 23 nt, Artificial Sequence
  Oligomer
uuuguaggaacaggaggugguac

SEQ ID NO: 70865 - RNA, 23 nt, Artificial Sequence
  Oligomer
ucgggcuccacauguaaauaugg

SEQ ID NO: 70866 - RNA, 23 nt, Artificial Sequence
  Oligomer
uucugggcagcagcaauuacagg

SEQ ID NO: 70867 - RNA, 23 nt, Artificial Sequence
  Oligomer
uauacacuugaaaaguguggccc

SEQ ID NO: 70868 - RNA, 23 nt, Artificial Sequence
  Oligomer
ucugaagguggcugauuaguuug

SEQ ID NO: 70869 - RNA, 23 nt, Artificial Sequence
  Oligomer
ucuagcugccuggucaguucuuc

SEQ ID NO: 70870 - RNA, 23 nt, Artificial Sequence
  Oligomer
ucacgcuaaauguccucuaaugg

SEQ ID NO: 70871 - RNA, 23 nt, Artificial Sequence
  Oligomer
ucuggcuuaaugucugaaggugg

SEQ ID NO: 70872 - RNA, 23 nt, Artificial Sequence
  Oligomer
uacgcaaguuuguccuuuuacca

SEQ ID NO: 70873 - RNA, 23 nt, Artificial Sequence
  Oligomer
uuuuuuccuggcgccugcuguug

SEQ ID NO: 70874 - RNA, 23 nt, Artificial Sequence
  Oligomer
uuaccauauacacuugaaaagug

SEQ ID NO: 70875 - RNA, 23 nt, Artificial Sequence
  Oligomer
uuagcugcagcuccuuauagagg

SEQ ID NO: 70876 - RNA, 23 nt, Artificial Sequence
  Oligomer
uccuccauuuccucgcacuuauc

SEQ ID NO: 70877 - RNA, 23 nt, Artificial Sequence
  Oligomer
auacgcucugagccaguuuuacg

SEQ ID NO: 70878 - RNA, 23 nt, Artificial Sequence
  Oligomer
aaucacucucgccggguucuuug

SEQ ID NO: 70879 - RNA, 23 nt, Artificial Sequence
  Oligomer
uuucuggaguaacuggaacuucu

SEQ ID NO: 70880 - RNA, 23 nt, Artificial Sequence
  Oligomer
ugccguucuugagcaucucuagc

SEQ ID NO: 70881 - RNA, 23 nt, Artificial Sequence
  Oligomer
uucccuguggaugauugucaugc

SEQ ID NO: 70882 - RNA, 23 nt, Artificial Sequence
  Oligomer
uccugcucagcaacuuguugcug

SEQ ID NO: 70883 - RNA, 23 nt, Artificial Sequence
  Oligomer
uuaggagcagcugcugaaaacac

SEQ ID NO: 70884 - RNA, 23 nt, Artificial Sequence
  Oligomer
gccaaaaauaaucguauuacuuc

SEQ ID NO: 70885 - RNA, 23 nt, Artificial Sequence
  Oligomer
uuagaggccuuggugcguuagac

SEQ ID NO: 70886 - RNA, 23 nt, Artificial Sequence
  Oligomer
ucagccaaauggcaaucacucuc

SEQ ID NO: 70887 - RNA, 23 nt, Artificial Sequence
  Oligomer
ucucuagcugccuggucaguucu

SEQ ID NO: 70888 - RNA, 23 nt, Artificial Sequence
  Oligomer
uuccugauucucagcuauuucuu

SEQ ID NO: 70889 - RNA, 23 nt, Artificial Sequence
  Oligomer
uguggaaguuucaggccaagcuc

SEQ ID NO: 70890 - RNA, 23 nt, Artificial Sequence
  Oligomer
uuagagccuuuaguuugugaagc

SEQ ID NO: 70891 - RNA, 23 nt, Artificial Sequence
  Oligomer
ugaaugaccaaggaaccauccgg

SEQ ID NO: 70892 - RNA, 23 nt, Artificial Sequence
  Oligomer
uccugauucucagcuauuucuuu

SEQ ID NO: 70893 - RNA, 23 nt, Artificial Sequence
  Oligomer
ucagccuacaaacaagauucuac

SEQ ID NO: 70894 - RNA, 23 nt, Artificial Sequence
  Oligomer
uuucuggcaggaggacugguuua

SEQ ID NO: 70895 - RNA, 23 nt, Artificial Sequence
  Oligomer
uuucccaacugcccaauaaauga

SEQ ID NO: 70896 - RNA, 23 nt, Artificial Sequence
  Oligomer
auguucucugggugcugcuguug

SEQ ID NO: 70897 - RNA, 23 nt, Artificial Sequence
  Oligomer
auauacacuugaaaaguguggcc

SEQ ID NO: 70898 - RNA, 23 nt, Artificial Sequence
  Oligomer
ucagcggaaccucuccaucauca

SEQ ID NO: 70899 - RNA, 23 nt, Artificial Sequence
  Oligomer
ucgcacuuaucugcagcagucug

SEQ ID NO: 70900 - RNA, 23 nt, Artificial Sequence
  Oligomer
uucgggcuccacauguaaauaug

SEQ ID NO: 70901 - RNA, 23 nt, Artificial Sequence
  Oligomer
uucuccugaacugaagaaacagg

SEQ ID NO: 70902 - RNA, 23 nt, Artificial Sequence
  Oligomer
uucucugggugcugcuguugauu

SEQ ID NO: 70903 - RNA, 23 nt, Artificial Sequence
  Oligomer
uugagggcauccgaggcauagua

SEQ ID NO: 70904 - RNA, 23 nt, Artificial Sequence
  Oligomer
ugaggcagcacaauguaauggag

SEQ ID NO: 70905 - RNA, 23 nt, Artificial Sequence
  Oligomer
auuugguucuucuggguuauucu

SEQ ID NO: 70906 - RNA, 23 nt, Artificial Sequence
  Oligomer
agucacagaagcugacuuggaug

SEQ ID NO: 70907 - RNA, 23 nt, Artificial Sequence
  Oligomer
ugagguucauaaucccaaagcgc

SEQ ID NO: 70908 - RNA, 23 nt, Artificial Sequence
  Oligomer
uuuccugaaguucagcaagaguc

SEQ ID NO: 70909 - RNA, 23 nt, Artificial Sequence
  Oligomer
aucuucuccugaacuccauaaag

SEQ ID NO: 70910 - RNA, 23 nt, Artificial Sequence
  Oligomer
uucuggauuucuacugggcuuuc

SEQ ID NO: 70911 - RNA, 23 nt, Artificial Sequence
  Oligomer
cugaguggccgaggaauucuuuc

SEQ ID NO: 70912 - RNA, 23 nt, Artificial Sequence
  Oligomer
uugcccuggcuauuggaauaaau

SEQ ID NO: 70913 - RNA, 23 nt, Artificial Sequence
  Oligomer
uucuggaguaacuggaacuucug

SEQ ID NO: 70914 - RNA, 23 nt, Artificial Sequence
  Oligomer
ugcuguugucgcugaucuuguug

SEQ ID NO: 70915 - RNA, 23 nt, Artificial Sequence
  Oligomer
ucccaacugcccaauaaaugauc

SEQ ID NO: 70916 - RNA, 23 nt, Artificial Sequence
  Oligomer
agacauucuucaucgcuuucaag

SEQ ID NO: 70917 - RNA, 23 nt, Artificial Sequence
  Oligomer
augcccaucuucuccugaacucc

SEQ ID NO: 70918 - RNA, 23 nt, Artificial Sequence
  Oligomer
ucuggguuauucuggagauuugg

SEQ ID NO: 70919 - RNA, 23 nt, Artificial Sequence
  Oligomer
uaguucccauggacggaacaacu

SEQ ID NO: 70920 - RNA, 23 nt, Artificial Sequence
  Oligomer
ugaagguggcugauuaguuuguc

SEQ ID NO: 70921 - RNA, 23 nt, Artificial Sequence
  Oligomer
uccaccacgucucugcauauugu

SEQ ID NO: 70922 - RNA, 23 nt, Artificial Sequence
  Oligomer
cuugauucaauuuguuucuuagc

SEQ ID NO: 70923 - RNA, 23 nt, Artificial Sequence
  Oligomer
aucguauuacuucuucuuaacag

SEQ ID NO: 70924 - RNA, 23 nt, Artificial Sequence
  Oligomer
uacaggcuuaccauauacacuug

SEQ ID NO: 70925 - RNA, 23 nt, Artificial Sequence
  Oligomer
uggacuggucuacugcaucaaac

SEQ ID NO: 70926 - RNA, 23 nt, Artificial Sequence
  Oligomer
ugagguacagaagcagagccuug

SEQ ID NO: 70927 - RNA, 23 nt, Artificial Sequence
  Oligomer
ucuggaguaacuggaacuucugu

SEQ ID NO: 70928 - RNA, 23 nt, Artificial Sequence
  Oligomer
uuaagcgcuguuccuuaguugcc

SEQ ID NO: 70929 - RNA, 23 nt, Artificial Sequence
  Oligomer
acugguuuaggagcagcugcuga

SEQ ID NO: 70930 - RNA, 23 nt, Artificial Sequence
  Oligomer
uaaucaaggccuggagaaggagc

SEQ ID NO: 70931 - RNA, 23 nt, Artificial Sequence
  Oligomer
ucuccugaacugaagaaacaggc

SEQ ID NO: 70932 - RNA, 23 nt, Artificial Sequence
  Oligomer
uucccauggacggaacaacuguu

SEQ ID NO: 70933 - RNA, 23 nt, Artificial Sequence
  Oligomer
acuuccgucuggcuuaaugucug

SEQ ID NO: 70934 - RNA, 23 nt, Artificial Sequence
  Oligomer
ucagccacugcagacugauuguc

SEQ ID NO: 70935 - RNA, 23 nt, Artificial Sequence
  Oligomer
caagauucuacaucuaauuacug

SEQ ID NO: 70936 - RNA, 23 nt, Artificial Sequence
  Oligomer
aaucagagacagcgaugugacgg

SEQ ID NO: 70937 - RNA, 23 nt, Artificial Sequence
  Oligomer
uacugagauacacgguaagaaac

SEQ ID NO: 70938 - RNA, 23 nt, Artificial Sequence
  Oligomer
ugguccucugauauaaaagcuuc

SEQ ID NO: 70939 - RNA, 23 nt, Artificial Sequence
  Oligomer
ugggcagugucuguauuuucauc

SEQ ID NO: 70940 - RNA, 23 nt, Artificial Sequence
  Oligomer
ucugaauuacgcuuauucaaaca

SEQ ID NO: 70941 - RNA, 23 nt, Artificial Sequence
  Oligomer
uugcugcuggcgagaugccauuu

SEQ ID NO: 70942 - RNA, 23 nt, Artificial Sequence
  Oligomer
ucuaauuacugguaccguagcuu

SEQ ID NO: 70943 - RNA, 23 nt, Artificial Sequence
  Oligomer
ucugagguucauaaucccaaagc

SEQ ID NO: 70944 - RNA, 23 nt, Artificial Sequence
  Oligomer
caaacuguaccaggaacuuaacg

SEQ ID NO: 70945 - RNA, 23 nt, Artificial Sequence
  Oligomer
ugaagagccgugaugccuucauc

SEQ ID NO: 70946 - RNA, 23 nt, Artificial Sequence
  Oligomer
ucgguaaggauuagauaagaaag

SEQ ID NO: 70947 - RNA, 23 nt, Artificial Sequence
  Oligomer
uacacuugaaaaguguggcccuc

SEQ ID NO: 70948 - RNA, 23 nt, Artificial Sequence
  Oligomer
uguggcccucugguaugagucuu

SEQ ID NO: 70949 - RNA, 23 nt, Artificial Sequence
  Oligomer
uuaguucccauggacggaacaac

SEQ ID NO: 70950 - RNA, 23 nt, Artificial Sequence
  Oligomer
aagcgcuguuccuuaguugccag

SEQ ID NO: 70951 - RNA, 23 nt, Artificial Sequence
  Oligomer
aacuguuuuuaaagucagcuaug

SEQ ID NO: 70952 - RNA, 23 nt, Artificial Sequence
  Oligomer
uuccucgcacuuaucugcagcag

SEQ ID NO: 70953 - RNA, 23 nt, Artificial Sequence
  Oligomer
auuucuguguggccugcacacac

SEQ ID NO: 70954 - RNA, 23 nt, Artificial Sequence
  Oligomer
uuaaugucugaagguggcugauu

SEQ ID NO: 70955 - RNA, 23 nt, Artificial Sequence
  Oligomer
auccaccacgucucugcauauug

SEQ ID NO: 70956 - RNA, 23 nt, Artificial Sequence
  Oligomer
cauaguagacgacuggauauagg

SEQ ID NO: 70957 - RNA, 23 nt, Artificial Sequence
  Oligomer
uccuccacaaguuucccauugcu

SEQ ID NO: 70958 - RNA, 23 nt, Artificial Sequence
  Oligomer
uccacguggccuuuaagugcucu

SEQ ID NO: 70959 - RNA, 23 nt, Artificial Sequence
  Oligomer
auuucccaacugcccaauaaaug

SEQ ID NO: 70960 - RNA, 23 nt, Artificial Sequence
  Oligomer
uucccaacugcccaauaaaugau

SEQ ID NO: 70961 - RNA, 23 nt, Artificial Sequence
  Oligomer
augggcagcucaucaucauucug

SEQ ID NO: 70962 - RNA, 23 nt, Artificial Sequence
  Oligomer
ucuucuccugaacuccauaaaga

SEQ ID NO: 70963 - RNA, 23 nt, Artificial Sequence
  Oligomer
auucugggcagcagcaauuacag

SEQ ID NO: 70964 - RNA, 23 nt, Artificial Sequence
  Oligomer
ucugguucuuccucagaguacca

SEQ ID NO: 70965 - RNA, 23 nt, Artificial Sequence
  Oligomer
cuaugaucuugacaaauauuacg

SEQ ID NO: 70966 - RNA, 23 nt, Artificial Sequence
  Oligomer
uuuaggagcagcugcugaaaaca

SEQ ID NO: 70967 - RNA, 23 nt, Artificial Sequence
  Oligomer
agcuccuuugucuugguuuaauu

SEQ ID NO: 70968 - RNA, 23 nt, Artificial Sequence
  Oligomer
ucuuggguacagucccagcaagu

SEQ ID NO: 70969 - RNA, 23 nt, Artificial Sequence
  Oligomer
uuggguacagucccagcaaguua

SEQ ID NO: 70970 - RNA, 23 nt, Artificial Sequence
  Oligomer
uccacauguaaauauggauucug

SEQ ID NO: 70971 - RNA, 23 nt, Artificial Sequence
  Oligomer
ugauucugggcagcagcaauuac

SEQ ID NO: 70972 - RNA, 23 nt, Artificial Sequence
  Oligomer
acagccugcuggaaguuuuuucc

SEQ ID NO: 70973 - RNA, 23 nt, Artificial Sequence
  Oligomer
aguaaggugucuuuggaaggcug

SEQ ID NO: 70974 - RNA, 23 nt, Artificial Sequence
  Oligomer
uuggcauucugcucuugauucaa

SEQ ID NO: 70975 - RNA, 23 nt, Artificial Sequence
  Oligomer
aaacacucaacaggacagagagc

SEQ ID NO: 70976 - RNA, 23 nt, Artificial Sequence
  Oligomer
ucaacaggacagagagcugauuu

SEQ ID NO: 70977 - RNA, 23 nt, Artificial Sequence
  Oligomer
uaucugagugcuacacgggacac

SEQ ID NO: 70978 - RNA, 23 nt, Artificial Sequence
  Oligomer
uugggucaucaaccucauaaaua

SEQ ID NO: 70979 - RNA, 23 nt, Artificial Sequence
  Oligomer
augggacagagauggucuccaug

SEQ ID NO: 70980 - RNA, 23 nt, Artificial Sequence
  Oligomer
auggugguccucugauauaaaag

SEQ ID NO: 70981 - RNA, 23 nt, Artificial Sequence
  Oligomer
ucccauggacggaacaacuguug

SEQ ID NO: 70982 - RNA, 23 nt, Artificial Sequence
  Oligomer
ugggaaaagaucugcauuugaag

SEQ ID NO: 70983 - RNA, 23 nt, Artificial Sequence
  Oligomer
ccugaaugaccaaggaaccaucc

SEQ ID NO: 70984 - RNA, 23 nt, Artificial Sequence
  Oligomer
acuggauauagggaccuacugca

SEQ ID NO: 70985 - RNA, 23 nt, Artificial Sequence
  Oligomer
uccugaaguucagcaagagucag

SEQ ID NO: 70986 - RNA, 23 nt, Artificial Sequence
  Oligomer
uagagacauucuucaucgcuuuc

SEQ ID NO: 70987 - RNA, 23 nt, Artificial Sequence
  Oligomer
ucauaaucaaggccuggagaagg

SEQ ID NO: 70988 - RNA, 23 nt, Artificial Sequence
  Oligomer
acuucagccaaauggcaaucacu

SEQ ID NO: 70989 - RNA, 23 nt, Artificial Sequence
  Oligomer
aucucuagcugccuggucaguuc

SEQ ID NO: 70990 - RNA, 23 nt, Artificial Sequence
  Oligomer
uccacaaguuucccauugcuuag

SEQ ID NO: 70991 - RNA, 23 nt, Artificial Sequence
  Oligomer
uguccucuaauggugaauucuuc

SEQ ID NO: 70992 - RNA, 23 nt, Artificial Sequence
  Oligomer
acaccauuucuuuuuaaacuugg

SEQ ID NO: 70993 - RNA, 23 nt, Artificial Sequence
  Oligomer
cugagguucauaaucccaaagcg

SEQ ID NO: 70994 - RNA, 23 nt, Artificial Sequence
  Oligomer
ugcccaucuucuccugaacucca

SEQ ID NO: 70995 - RNA, 23 nt, Artificial Sequence
  Oligomer
uucuccugaacuccauaaagaaa

SEQ ID NO: 70996 - RNA, 23 nt, Artificial Sequence
  Oligomer
uuucuguguggccugcacacaca

SEQ ID NO: 70997 - RNA, 23 nt, Artificial Sequence
  Oligomer
uacuccuccagguacacaucaag

SEQ ID NO: 70998 - RNA, 23 nt, Artificial Sequence
  Oligomer
acuccuccagguacacaucaagc

SEQ ID NO: 70999 - RNA, 23 nt, Artificial Sequence
  Oligomer
acauguggagccucuggauuugg

SEQ ID NO: 71000 - RNA, 23 nt, Artificial Sequence
  Oligomer
cuagcugccuggucaguucuucu

SEQ ID NO: 71001 - RNA, 23 nt, Artificial Sequence
  Oligomer
ucagcaacuuguugcuguugucg

SEQ ID NO: 71002 - RNA, 23 nt, Artificial Sequence
  Oligomer
uaaaauucuguguggaaguuuca

SEQ ID NO: 71003 - RNA, 23 nt, Artificial Sequence
  Oligomer
uagaggccuuggugcguuagaca

SEQ ID NO: 71004 - RNA, 23 nt, Artificial Sequence
  Oligomer
ugaguggccgaggaauucuuucg

SEQ ID NO: 71005 - RNA, 23 nt, Artificial Sequence
  Oligomer
ucaugguucuccugaacugaaga

SEQ ID NO: 71006 - RNA, 23 nt, Artificial Sequence
  Oligomer
uaaggugucuuuggaaggcuggg

SEQ ID NO: 71007 - RNA, 23 nt, Artificial Sequence
  Oligomer
uuagaaccuggagaaagggucug

SEQ ID NO: 71008 - RNA, 23 nt, Artificial Sequence
  Oligomer
cuuagcugcagcuccuuauagag

SEQ ID NO: 71009 - RNA, 23 nt, Artificial Sequence
  Oligomer
uggaacaaauuauucaucuguuc

SEQ ID NO: 71010 - RNA, 23 nt, Artificial Sequence
  Oligomer
ugcucagcaacuuguugcuguug

SEQ ID NO: 71011 - RNA, 23 nt, Artificial Sequence
  Oligomer
aacacaguauggccugcugacgu

SEQ ID NO: 71012 - RNA, 23 nt, Artificial Sequence
  Oligomer
uguggagccucuggauuugguuc

SEQ ID NO: 71013 - RNA, 23 nt, Artificial Sequence
  Oligomer
uggugguccucugauauaaaagc

SEQ ID NO: 71014 - RNA, 23 nt, Artificial Sequence
  Oligomer
aaggcuucuaggucagcaucacu

SEQ ID NO: 71015 - RNA, 23 nt, Artificial Sequence
  Oligomer
ucguuuucaugguucuccugaac

SEQ ID NO: 71016 - RNA, 23 nt, Artificial Sequence
  Oligomer
ugcuggaaguuuuuuccuggcgc

SEQ ID NO: 71017 - RNA, 23 nt, Artificial Sequence
  Oligomer
uggacuuucuugcuuagaaccug

SEQ ID NO: 71018 - RNA, 23 nt, Artificial Sequence
  Oligomer
uucagccaaauggcaaucacucu

SEQ ID NO: 71019 - RNA, 23 nt, Artificial Sequence
  Oligomer
aggagcagcugcugaaaacacuc

SEQ ID NO: 71020 - RNA, 23 nt, Artificial Sequence
  Oligomer
ucguauuacuucuucuuaacaga

SEQ ID NO: 71021 - RNA, 23 nt, Artificial Sequence
  Oligomer
uggcagucacagaagcugacuug

SEQ ID NO: 71022 - RNA, 23 nt, Artificial Sequence
  Oligomer
ugaugggacagagauggucucca

SEQ ID NO: 71023 - RNA, 23 nt, Artificial Sequence
  Oligomer
ugguucuccugaacugaagaaac

SEQ ID NO: 71024 - RNA, 23 nt, Artificial Sequence
  Oligomer
uccugaacugaagaaacaggcuc

SEQ ID NO: 71025 - RNA, 23 nt, Artificial Sequence
  Oligomer
uguucucugggugcugcuguuga

SEQ ID NO: 71026 - RNA, 23 nt, Artificial Sequence
  Oligomer
uccugccguucuugagcaucucu

SEQ ID NO: 71027 - RNA, 23 nt, Artificial Sequence
  Oligomer
acgagcucccucuguuuuugcug

SEQ ID NO: 71028 - RNA, 23 nt, Artificial Sequence
  Oligomer
aacaggacagagagcugauuucc

SEQ ID NO: 71029 - RNA, 23 nt, Artificial Sequence
  Oligomer
ugcugacguagaugcuuuauuuc

SEQ ID NO: 71030 - RNA, 23 nt, Artificial Sequence
  Oligomer
aaggaagaagcgaacuucguucc

SEQ ID NO: 71031 - RNA, 23 nt, Artificial Sequence
  Oligomer
uucugagcuggcagucacagaag

SEQ ID NO: 71032 - RNA, 23 nt, Artificial Sequence
  Oligomer
aaaguguggcccucugguaugag

SEQ ID NO: 71033 - RNA, 23 nt, Artificial Sequence
  Oligomer
agaacuuccgucuggcuuaaugu

SEQ ID NO: 71034 - RNA, 23 nt, Artificial Sequence
  Oligomer
gcucuugauucaauuuguuucuu

SEQ ID NO: 71035 - RNA, 23 nt, Artificial Sequence
  Oligomer
ugccuggucaguucuucuacuuu

SEQ ID NO: 71036 - RNA, 23 nt, Artificial Sequence
  Oligomer
acuuguugcuguugucgcugauc

SEQ ID NO: 71037 - RNA, 23 nt, Artificial Sequence
  Oligomer
ugggcuucaaucuguugcugcug

SEQ ID NO: 71038 - RNA, 23 nt, Artificial Sequence
  Oligomer
ucagauccauccuaggacuauua

SEQ ID NO: 71039 - RNA, 23 nt, Artificial Sequence
  Oligomer
uaacaguucuucacugacaauau

SEQ ID NO: 71040 - RNA, 23 nt, Artificial Sequence
  Oligomer
uucuuguagaaaacaggauuguc

SEQ ID NO: 71041 - RNA, 23 nt, Artificial Sequence
  Oligomer
aaauguccucuaauggugaauuc

SEQ ID NO: 71042 - RNA, 23 nt, Artificial Sequence
  Oligomer
cuaaaauucuguguggaaguuuc

SEQ ID NO: 71043 - RNA, 23 nt, Artificial Sequence
  Oligomer
ucuccugaacuccauaaagaaau

SEQ ID NO: 71044 - RNA, 23 nt, Artificial Sequence
  Oligomer
ucugcagcagucugcaugucacu

SEQ ID NO: 71045 - RNA, 23 nt, Artificial Sequence
  Oligomer
uaccaggaacuuaacgauuucug

SEQ ID NO: 71046 - RNA, 23 nt, Artificial Sequence
  Oligomer
ugacgaaggaagaagcgaacuuc

SEQ ID NO: 71047 - RNA, 23 nt, Artificial Sequence
  Oligomer
aaagacgaaucuagcaguaaagc

SEQ ID NO: 71048 - RNA, 23 nt, Artificial Sequence
  Oligomer
auacacuugaaaaguguggcccu

SEQ ID NO: 71049 - RNA, 23 nt, Artificial Sequence
  Oligomer
ugcguauacauggaauauauuga

SEQ ID NO: 71050 - RNA, 23 nt, Artificial Sequence
  Oligomer
uggucuuggccaaccgaagguau

SEQ ID NO: 71051 - RNA, 23 nt, Artificial Sequence
  Oligomer
uccgucuggcuuaaugucugaag

SEQ ID NO: 71052 - RNA, 23 nt, Artificial Sequence
  Oligomer
acggacgcacuuucuucucuuuc

SEQ ID NO: 71053 - RNA, 23 nt, Artificial Sequence
  Oligomer
uucccagugcuuugagguacaga

SEQ ID NO: 71054 - RNA, 23 nt, Artificial Sequence
  Oligomer
acaggacagagagcugauuuccc

SEQ ID NO: 71055 - RNA, 23 nt, Artificial Sequence
  Oligomer
acagagagcugauuucccaacug

SEQ ID NO: 71056 - RNA, 23 nt, Artificial Sequence
  Oligomer
uagacaggauucuuguagaaaac

SEQ ID NO: 71057 - RNA, 23 nt, Artificial Sequence
  Oligomer
ccaucauacccauccaagucagc

SEQ ID NO: 71058 - RNA, 23 nt, Artificial Sequence
  Oligomer
gagugaugcugaccuagaagccu

SEQ ID NO: 71059 - RNA, 23 nt, Artificial Sequence
  Oligomer
agagugaugcugaccuagaagcc

SEQ ID NO: 71060 - RNA, 23 nt, Artificial Sequence
  Oligomer
cagagugaugcugaccuagaagc

SEQ ID NO: 71061 - RNA, 23 nt, Artificial Sequence
  Oligomer
ccagagugaugcugaccuagaag

SEQ ID NO: 71062 - RNA, 23 nt, Artificial Sequence
  Oligomer
accagagugaugcugaccuagaa

SEQ ID NO: 71063 - RNA, 23 nt, Artificial Sequence
  Oligomer
ugguugucagugaacaauaacuu

SEQ ID NO: 71064 - RNA, 23 nt, Artificial Sequence
  Oligomer
uugguugucagugaacaauaacu

SEQ ID NO: 71065 - RNA, 23 nt, Artificial Sequence
  Oligomer
guugguugucagugaacaauaac

SEQ ID NO: 71066 - RNA, 23 nt, Artificial Sequence
  Oligomer
aguugguugucagugaacaauaa

SEQ ID NO: 71067 - RNA, 23 nt, Artificial Sequence
  Oligomer
gaaggagacugcaugacaaucau

SEQ ID NO: 71068 - RNA, 23 nt, Artificial Sequence
  Oligomer
agaaggagacugcaugacaauca

SEQ ID NO: 71069 - RNA, 23 nt, Artificial Sequence
  Oligomer
aagaaggagacugcaugacaauc

SEQ ID NO: 71070 - RNA, 23 nt, Artificial Sequence
  Oligomer
aaagaaggagacugcaugacaau

SEQ ID NO: 71071 - RNA, 23 nt, Artificial Sequence
  Oligomer
gaaagaaggagacugcaugacaa

SEQ ID NO: 71072 - RNA, 23 nt, Artificial Sequence
  Oligomer
gcugggacuguacccaagaauua

SEQ ID NO: 71073 - RNA, 23 nt, Artificial Sequence
  Oligomer
gaauuaaaccaagacaaaggagc

SEQ ID NO: 71074 - RNA, 23 nt, Artificial Sequence
  Oligomer
agaauuaaaccaagacaaaggag

SEQ ID NO: 71075 - RNA, 23 nt, Artificial Sequence
  Oligomer
aagaauuaaaccaagacaaagga

SEQ ID NO: 71076 - RNA, 23 nt, Artificial Sequence
  Oligomer
aagacgaagaugaaaucgaaugg

SEQ ID NO: 71077 - RNA, 23 nt, Artificial Sequence
  Oligomer
gaagacgaagaugaaaucgaaug

SEQ ID NO: 71078 - RNA, 23 nt, Artificial Sequence
  Oligomer
ggaagacgaagaugaaaucgaau

SEQ ID NO: 71079 - RNA, 23 nt, Artificial Sequence
  Oligomer
ggauccaaguuuaaaaagaaaug

SEQ ID NO: 71080 - RNA, 23 nt, Artificial Sequence
  Oligomer
aggauccaaguuuaaaaagaaau

SEQ ID NO: 71081 - RNA, 23 nt, Artificial Sequence
  Oligomer
caggauccaaguuuaaaaagaaa

SEQ ID NO: 71082 - RNA, 23 nt, Artificial Sequence
  Oligomer
uccaugggaacuaaaccaaaacc

SEQ ID NO: 71083 - RNA, 23 nt, Artificial Sequence
  Oligomer
guccaugggaacuaaaccaaaac

SEQ ID NO: 71084 - RNA, 23 nt, Artificial Sequence
  Oligomer
cguccaugggaacuaaaccaaaa

SEQ ID NO: 71085 - RNA, 23 nt, Artificial Sequence
  Oligomer
ccguccaugggaacuaaaccaaa

SEQ ID NO: 71086 - RNA, 23 nt, Artificial Sequence
  Oligomer
cauugugaguggaccaagaucuc

SEQ ID NO: 71087 - RNA, 23 nt, Artificial Sequence
  Oligomer
acauugugaguggaccaagaucu

SEQ ID NO: 71088 - RNA, 23 nt, Artificial Sequence
  Oligomer
cuacaagaauccugucuaguaaa

SEQ ID NO: 71089 - RNA, 23 nt, Artificial Sequence
  Oligomer
ucuacaagaauccugucuaguaa

SEQ ID NO: 71090 - RNA, 23 nt, Artificial Sequence
  Oligomer
acuuccacccuucagaaaacccc

SEQ ID NO: 71091 - RNA, 23 nt, Artificial Sequence
  Oligomer
uacuuccacccuucagaaaaccc

SEQ ID NO: 71092 - RNA, 23 nt, Artificial Sequence
  Oligomer
uuacuuccacccuucagaaaacc

SEQ ID NO: 71093 - RNA, 23 nt, Artificial Sequence
  Oligomer
cuuacuuccacccuucagaaaac

SEQ ID NO: 71094 - RNA, 23 nt, Artificial Sequence
  Oligomer
ccuuacuuccacccuucagaaaa

SEQ ID NO: 71095 - RNA, 23 nt, Artificial Sequence
  Oligomer
aacuuguggaggaaauugaacag

SEQ ID NO: 71096 - RNA, 23 nt, Artificial Sequence
  Oligomer
aaacuuguggaggaaauugaaca

SEQ ID NO: 71097 - RNA, 23 nt, Artificial Sequence
  Oligomer
gaaacuuguggaggaaauugaac

SEQ ID NO: 71098 - RNA, 23 nt, Artificial Sequence
  Oligomer
ggaaacuuguggaggaaauugaa

SEQ ID NO: 71099 - RNA, 23 nt, Artificial Sequence
  Oligomer
accuuacuuccacccuucagaaa

SEQ ID NO: 71100 - RNA, 23 nt, Artificial Sequence
  Oligomer
cgagcgucgaagagacaaagccg

SEQ ID NO: 71101 - RNA, 23 nt, Artificial Sequence
  Oligomer
acgagcgucgaagagacaaagcc

SEQ ID NO: 71102 - RNA, 23 nt, Artificial Sequence
  Oligomer
cacgagcgucgaagagacaaagc

SEQ ID NO: 71103 - RNA, 23 nt, Artificial Sequence
  Oligomer
ucacgagcgucgaagagacaaag

SEQ ID NO: 71104 - RNA, 23 nt, Artificial Sequence
  Oligomer
gucacgagcgucgaagagacaaa

SEQ ID NO: 71105 - RNA, 23 nt, Artificial Sequence
  Oligomer
aguuccuggugaauaucgaagaa

SEQ ID NO: 71106 - RNA, 23 nt, Artificial Sequence
  Oligomer
gcuugaaagcgaugaagaauguc

SEQ ID NO: 71107 - RNA, 23 nt, Artificial Sequence
  Oligomer
agcuugaaagcgaugaagaaugu

SEQ ID NO: 71108 - RNA, 23 nt, Artificial Sequence
  Oligomer
uagcuugaaagcgaugaagaaug

SEQ ID NO: 71109 - RNA, 23 nt, Artificial Sequence
  Oligomer
guagcuugaaagcgaugaagaau

SEQ ID NO: 71110 - RNA, 23 nt, Artificial Sequence
  Oligomer
uguagcuugaaagcgaugaagaa

SEQ ID NO: 71111 - RNA, 23 nt, Artificial Sequence
  Oligomer
gaagaagaaggcagcucuacagc

SEQ ID NO: 71112 - RNA, 23 nt, Artificial Sequence
  Oligomer
augaugagcugcccaugaaagaa

SEQ ID NO: 71113 - RNA, 23 nt, Artificial Sequence
  Oligomer
gaugaugagcugcccaugaaaga

SEQ ID NO: 71114 - RNA, 23 nt, Artificial Sequence
  Oligomer
ugaugaugagcugcccaugaaag

SEQ ID NO: 71115 - RNA, 23 nt, Artificial Sequence
  Oligomer
augaugaugagcugcccaugaaa

SEQ ID NO: 71116 - RNA, 23 nt, Artificial Sequence
  Oligomer
ugguacaguuugguguaaaugua

SEQ ID NO: 71117 - RNA, 23 nt, Artificial Sequence
  Oligomer
cugguacaguuugguguaaaugu

SEQ ID NO: 71118 - RNA, 23 nt, Artificial Sequence
  Oligomer
ccugguacaguuugguguaaaug

SEQ ID NO: 71119 - RNA, 23 nt, Artificial Sequence
  Oligomer
uccugguacaguuugguguaaau

SEQ ID NO: 71120 - RNA, 23 nt, Artificial Sequence
  Oligomer
ccagagaacauuuauuccaauag

SEQ ID NO: 71121 - RNA, 23 nt, Artificial Sequence
  Oligomer
cccagagaacauuuauuccaaua

SEQ ID NO: 71122 - RNA, 23 nt, Artificial Sequence
  Oligomer
cuggaucaaguugaugauggaga

SEQ ID NO: 71123 - RNA, 23 nt, Artificial Sequence
  Oligomer
ucuggaucaaguugaugauggag

SEQ ID NO: 71124 - RNA, 23 nt, Artificial Sequence
  Oligomer
cucuggaucaaguugaugaugga

SEQ ID NO: 71125 - RNA, 23 nt, Artificial Sequence
  Oligomer
gaucauagcugacuuuaaaaaca

SEQ ID NO: 71126 - RNA, 23 nt, Artificial Sequence
  Oligomer
agaucauagcugacuuuaaaaac

SEQ ID NO: 71127 - RNA, 23 nt, Artificial Sequence
  Oligomer
aagaucauagcugacuuuaaaaa

SEQ ID NO: 71128 - RNA, 23 nt, Artificial Sequence
  Oligomer
caagaucauagcugacuuuaaaa

SEQ ID NO: 71129 - RNA, 23 nt, Artificial Sequence
  Oligomer
ucaagaucauagcugacuuuaaa

SEQ ID NO: 71130 - RNA, 23 nt, Artificial Sequence
  Oligomer
gaaacuugcuacagacuuacccg

SEQ ID NO: 71131 - RNA, 23 nt, Artificial Sequence
  Oligomer
ccaaggcucugcuucuguaccuc

SEQ ID NO: 71132 - RNA, 23 nt, Artificial Sequence
  Oligomer
gccaaggcucugcuucuguaccu

SEQ ID NO: 71133 - RNA, 23 nt, Artificial Sequence
  Oligomer
agccaaggcucugcuucuguacc

SEQ ID NO: 71134 - RNA, 23 nt, Artificial Sequence
  Oligomer
aagccaaggcucugcuucuguac

SEQ ID NO: 71135 - RNA, 23 nt, Artificial Sequence
  Oligomer
caagccaaggcucugcuucugua

SEQ ID NO: 71136 - RNA, 23 nt, Artificial Sequence
  Oligomer
gucaagaucauagcugacuuuaa

SEQ ID NO: 71137 - RNA, 23 nt, Artificial Sequence
  Oligomer
gaugaagaaugucucuagaagag

SEQ ID NO: 71138 - RNA, 23 nt, Artificial Sequence
  Oligomer
cgaugaagaaugucucuagaaga

SEQ ID NO: 71139 - RNA, 23 nt, Artificial Sequence
  Oligomer
gcgaugaagaaugucucuagaag

SEQ ID NO: 71140 - RNA, 23 nt, Artificial Sequence
  Oligomer
agcgaugaagaaugucucuagaa

SEQ ID NO: 71141 - RNA, 23 nt, Artificial Sequence
  Oligomer
aagcgaugaagaaugucucuaga

SEQ ID NO: 71142 - RNA, 23 nt, Artificial Sequence
  Oligomer
guaaaaggacaaacuugcguaaa

SEQ ID NO: 71143 - RNA, 23 nt, Artificial Sequence
  Oligomer
gguaaaaggacaaacuugcguaa

SEQ ID NO: 71144 - RNA, 23 nt, Artificial Sequence
  Oligomer
caaacuaaaggcucuaaaaucca

SEQ ID NO: 71145 - RNA, 23 nt, Artificial Sequence
  Oligomer
acaaacuaaaggcucuaaaaucc

SEQ ID NO: 71146 - RNA, 23 nt, Artificial Sequence
  Oligomer
cacaaacuaaaggcucuaaaauc

SEQ ID NO: 71147 - RNA, 23 nt, Artificial Sequence
  Oligomer
ucacaaacuaaaggcucuaaaau

SEQ ID NO: 71148 - RNA, 23 nt, Artificial Sequence
  Oligomer
uucacaaacuaaaggcucuaaaa

SEQ ID NO: 71149 - RNA, 23 nt, Artificial Sequence
  Oligomer
ggcagcuagagaugcucaagaac

SEQ ID NO: 71150 - RNA, 23 nt, Artificial Sequence
  Oligomer
aggcagcuagagaugcucaagaa

SEQ ID NO: 71151 - RNA, 23 nt, Artificial Sequence
  Oligomer
caggcagcuagagaugcucaaga

SEQ ID NO: 71152 - RNA, 23 nt, Artificial Sequence
  Oligomer
ccaggcagcuagagaugcucaag

SEQ ID NO: 71153 - RNA, 23 nt, Artificial Sequence
  Oligomer
accaggcagcuagagaugcucaa

SEQ ID NO: 71154 - RNA, 23 nt, Artificial Sequence
  Oligomer
guauauugucagugaagaacugu

SEQ ID NO: 71155 - RNA, 23 nt, Artificial Sequence
  Oligomer
uguauauugucagugaagaacug

SEQ ID NO: 71156 - RNA, 23 nt, Artificial Sequence
  Oligomer
uuguauauugucagugaagaacu

SEQ ID NO: 71157 - RNA, 23 nt, Artificial Sequence
  Oligomer
ccguguagcacucagauaaguau

SEQ ID NO: 71158 - RNA, 23 nt, Artificial Sequence
  Oligomer
cccguguagcacucagauaagua

SEQ ID NO: 71159 - RNA, 23 nt, Artificial Sequence
  Oligomer
ucccguguagcacucagauaagu

SEQ ID NO: 71160 - RNA, 23 nt, Artificial Sequence
  Oligomer
gucccguguagcacucagauaag

SEQ ID NO: 71161 - RNA, 23 nt, Artificial Sequence
  Oligomer
ugucccguguagcacucagauaa

SEQ ID NO: 71162 - RNA, 23 nt, Artificial Sequence
  Oligomer
ccagaauaacccagaagaaccaa

SEQ ID NO: 71163 - RNA, 23 nt, Artificial Sequence
  Oligomer
uccagaauaacccagaagaacca

SEQ ID NO: 71164 - RNA, 23 nt, Artificial Sequence
  Oligomer
cuccagaauaacccagaagaacc

SEQ ID NO: 71165 - RNA, 23 nt, Artificial Sequence
  Oligomer
ucuccagaauaacccagaagaac

SEQ ID NO: 71166 - RNA, 23 nt, Artificial Sequence
  Oligomer
aucuccagaauaacccagaagaa

SEQ ID NO: 71167 - RNA, 23 nt, Artificial Sequence
  Oligomer
gggaugcucagguugcaaauaaa

SEQ ID NO: 71168 - RNA, 23 nt, Artificial Sequence
  Oligomer
ccaagaucucaggauccaaguuu

SEQ ID NO: 71169 - RNA, 23 nt, Artificial Sequence
  Oligomer
accaagaucucaggauccaaguu

SEQ ID NO: 71170 - RNA, 23 nt, Artificial Sequence
  Oligomer
gaccaagaucucaggauccaagu

SEQ ID NO: 71171 - RNA, 23 nt, Artificial Sequence
  Oligomer
ggaccaagaucucaggauccaag

SEQ ID NO: 71172 - RNA, 23 nt, Artificial Sequence
  Oligomer
uggaccaagaucucaggauccaa

SEQ ID NO: 71173 - RNA, 23 nt, Artificial Sequence
  Oligomer
cauugugcugccucauguaacaa

SEQ ID NO: 71174 - RNA, 23 nt, Artificial Sequence
  Oligomer
acauugugcugccucauguaaca

SEQ ID NO: 71175 - RNA, 23 nt, Artificial Sequence
  Oligomer
uacauugugcugccucauguaac

SEQ ID NO: 71176 - RNA, 23 nt, Artificial Sequence
  Oligomer
uuacauugugcugccucauguaa

SEQ ID NO: 71177 - RNA, 23 nt, Artificial Sequence
  Oligomer
auuacauugugcugccucaugua

SEQ ID NO: 71178 - RNA, 23 nt, Artificial Sequence
  Oligomer
ggauaaugagcgaauguuugaug

SEQ ID NO: 71179 - RNA, 23 nt, Artificial Sequence
  Oligomer
aggagaacgguguuaauaguccu

SEQ ID NO: 71180 - RNA, 23 nt, Artificial Sequence
  Oligomer
aaggagaacgguguuaauagucc

SEQ ID NO: 71181 - RNA, 23 nt, Artificial Sequence
  Oligomer
aaaggagaacgguguuaauaguc

SEQ ID NO: 71182 - RNA, 23 nt, Artificial Sequence
  Oligomer
gaaaggagaacgguguuaauagu

SEQ ID NO: 71183 - RNA, 23 nt, Artificial Sequence
  Oligomer
aaguuccuggugaauaucgaaga

SEQ ID NO: 71184 - RNA, 23 nt, Artificial Sequence
  Oligomer
aaaguuccuggugaauaucgaag

SEQ ID NO: 71185 - RNA, 23 nt, Artificial Sequence
  Oligomer
aaaaguuccuggugaauaucgaa

SEQ ID NO: 71186 - RNA, 23 nt, Artificial Sequence
  Oligomer
gaagaaugucucuagaagagaau

SEQ ID NO: 71187 - RNA, 23 nt, Artificial Sequence
  Oligomer
ugaagaaugucucuagaagagaa

SEQ ID NO: 71188 - RNA, 23 nt, Artificial Sequence
  Oligomer
augaagaaugucucuagaagaga

SEQ ID NO: 71189 - RNA, 23 nt, Artificial Sequence
  Oligomer
caauguagcuugaaagcgaugaa

SEQ ID NO: 71190 - RNA, 23 nt, Artificial Sequence
  Oligomer
acaauguagcuugaaagcgauga

SEQ ID NO: 71191 - RNA, 23 nt, Artificial Sequence
  Oligomer
gacaauguagcuugaaagcgaug

SEQ ID NO: 71192 - RNA, 23 nt, Artificial Sequence
  Oligomer
aucauacccauccaagucagcuu

SEQ ID NO: 71193 - RNA, 23 nt, Artificial Sequence
  Oligomer
caucauacccauccaagucagcu

SEQ ID NO: 71194 - RNA, 23 nt, Artificial Sequence
  Oligomer
cuuccacccuucagaaaacccca

SEQ ID NO: 71195 - RNA, 23 nt, Artificial Sequence
  Oligomer
ugcugcuaucucccagcauaccu

SEQ ID NO: 71196 - RNA, 23 nt, Artificial Sequence
  Oligomer
gugcugcuaucucccagcauacc

SEQ ID NO: 71197 - RNA, 23 nt, Artificial Sequence
  Oligomer
agugcugcuaucucccagcauac

SEQ ID NO: 71198 - RNA, 23 nt, Artificial Sequence
  Oligomer
gagugcugcuaucucccagcaua

SEQ ID NO: 71199 - RNA, 23 nt, Artificial Sequence
  Oligomer
ccaagaugaugccgauguuucuu

SEQ ID NO: 71200 - RNA, 23 nt, Artificial Sequence
  Oligomer
uccaagaugaugccgauguuucu

SEQ ID NO: 71201 - RNA, 23 nt, Artificial Sequence
  Oligomer
guccaagaugaugccgauguuuc

SEQ ID NO: 71202 - RNA, 23 nt, Artificial Sequence
  Oligomer
cgggaugcucagguugcaaauaa

SEQ ID NO: 71203 - RNA, 23 nt, Artificial Sequence
  Oligomer
gcgggaugcucagguugcaaaua

SEQ ID NO: 71204 - RNA, 23 nt, Artificial Sequence
  Oligomer
ugcgggaugcucagguugcaaau

SEQ ID NO: 71205 - RNA, 23 nt, Artificial Sequence
  Oligomer
aagaaggcagcucuacagcaaaa

SEQ ID NO: 71206 - RNA, 23 nt, Artificial Sequence
  Oligomer
gaagaaggcagcucuacagcaaa

SEQ ID NO: 71207 - RNA, 23 nt, Artificial Sequence
  Oligomer
agaagaaggcagcucuacagcaa

SEQ ID NO: 71208 - RNA, 23 nt, Artificial Sequence
  Oligomer
gaguuuuuguagcaucuuaagaa

SEQ ID NO: 71209 - RNA, 23 nt, Artificial Sequence
  Oligomer
ugaguuuuuguagcaucuuaaga

SEQ ID NO: 71210 - RNA, 23 nt, Artificial Sequence
  Oligomer
augaguuuuuguagcaucuuaag

SEQ ID NO: 71211 - RNA, 23 nt, Artificial Sequence
  Oligomer
uaugaguuuuuguagcaucuuaa

SEQ ID NO: 71212 - RNA, 23 nt, Artificial Sequence
  Oligomer
auaugaguuuuuguagcaucuua

SEQ ID NO: 71213 - RNA, 23 nt, Artificial Sequence
  Oligomer
gaaugucucuagaagagaaugaa

SEQ ID NO: 71214 - RNA, 23 nt, Artificial Sequence
  Oligomer
agaaugucucuagaagagaauga

SEQ ID NO: 71215 - RNA, 23 nt, Artificial Sequence
  Oligomer
aagaaugucucuagaagagaaug

SEQ ID NO: 71216 - RNA, 23 nt, Artificial Sequence
  Oligomer
aagacaaaggagcuuggccugaa

SEQ ID NO: 71217 - RNA, 23 nt, Artificial Sequence
  Oligomer
ugcugggacuguacccaagaauu

SEQ ID NO: 71218 - RNA, 23 nt, Artificial Sequence
  Oligomer
gagacugcaugacaaucauccac

SEQ ID NO: 71219 - RNA, 23 nt, Artificial Sequence
  Oligomer
ggagacugcaugacaaucaucca

SEQ ID NO: 71220 - RNA, 23 nt, Artificial Sequence
  Oligomer
aggagacugcaugacaaucaucc

SEQ ID NO: 71221 - RNA, 23 nt, Artificial Sequence
  Oligomer
aaggagacugcaugacaaucauc

SEQ ID NO: 71222 - RNA, 23 nt, Artificial Sequence
  Oligomer
ugcgcuuugggauuaugaaccuc

SEQ ID NO: 71223 - RNA, 23 nt, Artificial Sequence
  Oligomer
augcgcuuugggauuaugaaccu

SEQ ID NO: 71224 - RNA, 23 nt, Artificial Sequence
  Oligomer
uaugcgcuuugggauuaugaacc

SEQ ID NO: 71225 - RNA, 23 nt, Artificial Sequence
  Oligomer
guuuguaggcugaauuuuaaucu

SEQ ID NO: 71226 - RNA, 23 nt, Artificial Sequence
  Oligomer
uguuuguaggcugaauuuuaauc

SEQ ID NO: 71227 - RNA, 23 nt, Artificial Sequence
  Oligomer
uuguuuguaggcugaauuuuaau

SEQ ID NO: 71228 - RNA, 23 nt, Artificial Sequence
  Oligomer
gggcgcgccuuaaugauaaggag

SEQ ID NO: 71229 - RNA, 23 nt, Artificial Sequence
  Oligomer
ugggcgcgccuuaaugauaagga

SEQ ID NO: 71230 - RNA, 23 nt, Artificial Sequence
  Oligomer
gugggcgcgccuuaaugauaagg

SEQ ID NO: 71231 - RNA, 23 nt, Artificial Sequence
  Oligomer
ggugggcgcgccuuaaugauaag

SEQ ID NO: 71232 - RNA, 23 nt, Artificial Sequence
  Oligomer
uggugggcgcgccuuaaugauaa

SEQ ID NO: 71233 - RNA, 23 nt, Artificial Sequence
  Oligomer
ugcugcagauaagugcgaggaaa

SEQ ID NO: 71234 - RNA, 23 nt, Artificial Sequence
  Oligomer
guggucucucugguuccugaauc

SEQ ID NO: 71235 - RNA, 23 nt, Artificial Sequence
  Oligomer
gguggucucucugguuccugaau

SEQ ID NO: 71236 - RNA, 23 nt, Artificial Sequence
  Oligomer
agguggucucucugguuccugaa

SEQ ID NO: 71237 - RNA, 23 nt, Artificial Sequence
  Oligomer
gccacucagcccaacuaaauuac

SEQ ID NO: 71238 - RNA, 23 nt, Artificial Sequence
  Oligomer
ggccacucagcccaacuaaauua

SEQ ID NO: 71239 - RNA, 23 nt, Artificial Sequence
  Oligomer
cggccacucagcccaacuaaauu

SEQ ID NO: 71240 - RNA, 23 nt, Artificial Sequence
  Oligomer
ucggccacucagcccaacuaaau

SEQ ID NO: 71241 - RNA, 23 nt, Artificial Sequence
  Oligomer
cucggccacucagcccaacuaaa

SEQ ID NO: 71242 - RNA, 23 nt, Artificial Sequence
  Oligomer
ccagguucuaagcaagaaagucc

SEQ ID NO: 71243 - RNA, 23 nt, Artificial Sequence
  Oligomer
uccagguucuaagcaagaaaguc

SEQ ID NO: 71244 - RNA, 23 nt, Artificial Sequence
  Oligomer
cuccagguucuaagcaagaaagu

SEQ ID NO: 71245 - RNA, 23 nt, Artificial Sequence
  Oligomer
ucuccagguucuaagcaagaaag

SEQ ID NO: 71246 - RNA, 23 nt, Artificial Sequence
  Oligomer
gcugcaguaggucccuauaucca

SEQ ID NO: 71247 - RNA, 23 nt, Artificial Sequence
  Oligomer
ggcugcaguaggucccuauaucc

SEQ ID NO: 71248 - RNA, 23 nt, Artificial Sequence
  Oligomer
uggcugcaguaggucccuauauc

SEQ ID NO: 71249 - RNA, 23 nt, Artificial Sequence
  Oligomer
guggcugcaguaggucccuauau

SEQ ID NO: 71250 - RNA, 23 nt, Artificial Sequence
  Oligomer
uguggcugcaguaggucccuaua

SEQ ID NO: 71251 - RNA, 23 nt, Artificial Sequence
  Oligomer
agagcagaaugccaagcuacaac

SEQ ID NO: 71252 - RNA, 23 nt, Artificial Sequence
  Oligomer
aagagcagaaugccaagcuacaa

SEQ ID NO: 71253 - RNA, 23 nt, Artificial Sequence
  Oligomer
caagagcagaaugccaagcuaca

SEQ ID NO: 71254 - RNA, 23 nt, Artificial Sequence
  Oligomer
ucaagagcagaaugccaagcuac

SEQ ID NO: 71255 - RNA, 23 nt, Artificial Sequence
  Oligomer
aucaagagcagaaugccaagcua

SEQ ID NO: 71256 - RNA, 23 nt, Artificial Sequence
  Oligomer
aaaggccacguggaacagaagag

SEQ ID NO: 71257 - RNA, 23 nt, Artificial Sequence
  Oligomer
uaaaggccacguggaacagaaga

SEQ ID NO: 71258 - RNA, 23 nt, Artificial Sequence
  Oligomer
uuaaaggccacguggaacagaag

SEQ ID NO: 71259 - RNA, 23 nt, Artificial Sequence
  Oligomer
cuuaaaggccacguggaacagaa

SEQ ID NO: 71260 - RNA, 23 nt, Artificial Sequence
  Oligomer
agaucagcgacaacagcaacaag

SEQ ID NO: 71261 - RNA, 23 nt, Artificial Sequence
  Oligomer
aagaucagcgacaacagcaacaa

SEQ ID NO: 71262 - RNA, 23 nt, Artificial Sequence
  Oligomer
caagaucagcgacaacagcaaca

SEQ ID NO: 71263 - RNA, 23 nt, Artificial Sequence
  Oligomer
acaagaucagcgacaacagcaac

SEQ ID NO: 71264 - RNA, 23 nt, Artificial Sequence
  Oligomer
aacaagaucagcgacaacagcaa

SEQ ID NO: 71265 - RNA, 23 nt, Artificial Sequence
  Oligomer
caugcagacugcugcagauaagu

SEQ ID NO: 71266 - RNA, 23 nt, Artificial Sequence
  Oligomer
acaugcagacugcugcagauaag

SEQ ID NO: 71267 - RNA, 23 nt, Artificial Sequence
  Oligomer
gacaugcagacugcugcagauaa

SEQ ID NO: 71268 - RNA, 23 nt, Artificial Sequence
  Oligomer
ugacaugcagacugcugcagaua

SEQ ID NO: 71269 - RNA, 23 nt, Artificial Sequence
  Oligomer
gugacaugcagacugcugcagau

SEQ ID NO: 71270 - RNA, 23 nt, Artificial Sequence
  Oligomer
acuuaaaggccacguggaacaga

SEQ ID NO: 71271 - RNA, 23 nt, Artificial Sequence
  Oligomer
cacuuaaaggccacguggaacag

SEQ ID NO: 71272 - RNA, 23 nt, Artificial Sequence
  Oligomer
gcacuuaaaggccacguggaaca

SEQ ID NO: 71273 - RNA, 23 nt, Artificial Sequence
  Oligomer
agcacuuaaaggccacguggaac

SEQ ID NO: 71274 - RNA, 23 nt, Artificial Sequence
  Oligomer
gagcacuuaaaggccacguggaa

SEQ ID NO: 71275 - RNA, 23 nt, Artificial Sequence
  Oligomer
aaaagugagagcacuuaaaggcc

SEQ ID NO: 71276 - RNA, 23 nt, Artificial Sequence
  Oligomer
aaaaagugagagcacuuaaaggc

SEQ ID NO: 71277 - RNA, 23 nt, Artificial Sequence
  Oligomer
aaaaaagugagagcacuuaaagg

SEQ ID NO: 71278 - RNA, 23 nt, Artificial Sequence
  Oligomer
aaaaaaagugagagcacuuaaag

SEQ ID NO: 71279 - RNA, 23 nt, Artificial Sequence
  Oligomer
uaaaaaaagugagagcacuuaaa

SEQ ID NO: 71280 - RNA, 23 nt, Artificial Sequence
  Oligomer
ggcaguccagaaccugaaacaga

SEQ ID NO: 71281 - RNA, 23 nt, Artificial Sequence
  Oligomer
uggcaguccagaaccugaaacag

SEQ ID NO: 71282 - RNA, 23 nt, Artificial Sequence
  Oligomer
cuggcaguccagaaccugaaaca

SEQ ID NO: 71283 - RNA, 23 nt, Artificial Sequence
  Oligomer
ccuggcaguccagaaccugaaac

SEQ ID NO: 71284 - RNA, 23 nt, Artificial Sequence
  Oligomer
gccuggcaguccagaaccugaaa

SEQ ID NO: 71285 - RNA, 23 nt, Artificial Sequence
  Oligomer
aagaagaaggcagcucuacagca

SEQ ID NO: 71286 - RNA, 23 nt, Artificial Sequence
  Oligomer
aaggagcugcagcuaagaaacaa

SEQ ID NO: 71287 - RNA, 23 nt, Artificial Sequence
  Oligomer
uaaggagcugcagcuaagaaaca

SEQ ID NO: 71288 - RNA, 23 nt, Artificial Sequence
  Oligomer
auaaggagcugcagcuaagaaac

SEQ ID NO: 71289 - RNA, 23 nt, Artificial Sequence
  Oligomer
uauaaggagcugcagcuaagaaa

SEQ ID NO: 71290 - RNA, 23 nt, Artificial Sequence
  Oligomer
gguucggguccaagaugaugccg

SEQ ID NO: 71291 - RNA, 23 nt, Artificial Sequence
  Oligomer
cgguucggguccaagaugaugcc

SEQ ID NO: 71292 - RNA, 23 nt, Artificial Sequence
  Oligomer
gcgguucggguccaagaugaugc

SEQ ID NO: 71293 - RNA, 23 nt, Artificial Sequence
  Oligomer
ugcgguucggguccaagaugaug

SEQ ID NO: 71294 - RNA, 23 nt, Artificial Sequence
  Oligomer
augcgguucggguccaagaugau

SEQ ID NO: 71295 - RNA, 23 nt, Artificial Sequence
  Oligomer
augccgauguuucuuaccgugua

SEQ ID NO: 71296 - RNA, 23 nt, Artificial Sequence
  Oligomer
aucauccacagggaagacgaaga

SEQ ID NO: 71297 - RNA, 23 nt, Artificial Sequence
  Oligomer
aaucauccacagggaagacgaag

SEQ ID NO: 71298 - RNA, 23 nt, Artificial Sequence
  Oligomer
caaucauccacagggaagacgaa

SEQ ID NO: 71299 - RNA, 23 nt, Artificial Sequence
  Oligomer
gcagggacauugugaguggacca

SEQ ID NO: 71300 - RNA, 23 nt, Artificial Sequence
  Oligomer
gcaucacggcucuucacaaugcu

SEQ ID NO: 71301 - RNA, 23 nt, Artificial Sequence
  Oligomer
ggcaucacggcucuucacaaugc

SEQ ID NO: 71302 - RNA, 23 nt, Artificial Sequence
  Oligomer
aggcaucacggcucuucacaaug

SEQ ID NO: 71303 - RNA, 23 nt, Artificial Sequence
  Oligomer
aaggcaucacggcucuucacaau

SEQ ID NO: 71304 - RNA, 23 nt, Artificial Sequence
  Oligomer
gaaggcaucacggcucuucacaa

SEQ ID NO: 71305 - RNA, 23 nt, Artificial Sequence
  Oligomer
cucucugccuccugguaaaagga

SEQ ID NO: 71306 - RNA, 23 nt, Artificial Sequence
  Oligomer
ucucucugccuccugguaaaagg

SEQ ID NO: 71307 - RNA, 23 nt, Artificial Sequence
  Oligomer
gucucucugccuccugguaaaag

SEQ ID NO: 71308 - RNA, 23 nt, Artificial Sequence
  Oligomer
ggucucucugccuccugguaaaa

SEQ ID NO: 71309 - RNA, 23 nt, Artificial Sequence
  Oligomer
aggucucucugccuccugguaaa

SEQ ID NO: 71310 - RNA, 23 nt, Artificial Sequence
  Oligomer
gugacugccagcucagaaagccc

SEQ ID NO: 71311 - RNA, 23 nt, Artificial Sequence
  Oligomer
ugugacugccagcucagaaagcc

SEQ ID NO: 71312 - RNA, 23 nt, Artificial Sequence
  Oligomer
cugugacugccagcucagaaagc

SEQ ID NO: 71313 - RNA, 23 nt, Artificial Sequence
  Oligomer
ucugugacugccagcucagaaag

SEQ ID NO: 71314 - RNA, 23 nt, Artificial Sequence
  Oligomer
uucugugacugccagcucagaaa

SEQ ID NO: 71315 - RNA, 23 nt, Artificial Sequence
  Oligomer
aacgcaccaaggccucuaaagaa

SEQ ID NO: 71316 - RNA, 23 nt, Artificial Sequence
  Oligomer
uaacgcaccaaggccucuaaaga

SEQ ID NO: 71317 - RNA, 23 nt, Artificial Sequence
  Oligomer
uugcgggaugcucagguugcaaa

SEQ ID NO: 71318 - RNA, 23 nt, Artificial Sequence
  Oligomer
gcuacagacuuacccguaauauu

SEQ ID NO: 71319 - RNA, 23 nt, Artificial Sequence
  Oligomer
ugcuacagacuuacccguaauau

SEQ ID NO: 71320 - RNA, 23 nt, Artificial Sequence
  Oligomer
uugcuacagacuuacccguaaua

SEQ ID NO: 71321 - RNA, 23 nt, Artificial Sequence
  Oligomer
cuugcuacagacuuacccguaau

SEQ ID NO: 71322 - RNA, 23 nt, Artificial Sequence
  Oligomer
acuugcuacagacuuacccguaa

SEQ ID NO: 71323 - RNA, 23 nt, Artificial Sequence
  Oligomer
augaaggauugaagaauucacca

SEQ ID NO: 71324 - RNA, 23 nt, Artificial Sequence
  Oligomer
aaugaaggauugaagaauucacc

SEQ ID NO: 71325 - RNA, 23 nt, Artificial Sequence
  Oligomer
cuguguuugccaugaccuacagu

SEQ ID NO: 71326 - RNA, 23 nt, Artificial Sequence
  Oligomer
gcuguguuugccaugaccuacag

SEQ ID NO: 71327 - RNA, 23 nt, Artificial Sequence
  Oligomer
cgcuguguuugccaugaccuaca

SEQ ID NO: 71328 - RNA, 23 nt, Artificial Sequence
  Oligomer
ccgcuguguuugccaugaccuac

SEQ ID NO: 71329 - RNA, 23 nt, Artificial Sequence
  Oligomer
gccgcuguguuugccaugaccua

SEQ ID NO: 71330 - RNA, 23 nt, Artificial Sequence
  Oligomer
cuucuuccuucgucaugaacgcc

SEQ ID NO: 71331 - RNA, 23 nt, Artificial Sequence
  Oligomer
gcuucuuccuucgucaugaacgc

SEQ ID NO: 71332 - RNA, 23 nt, Artificial Sequence
  Oligomer
cgcuucuuccuucgucaugaacg

SEQ ID NO: 71333 - RNA, 23 nt, Artificial Sequence
  Oligomer
ucgcuucuuccuucgucaugaac

SEQ ID NO: 71334 - RNA, 23 nt, Artificial Sequence
  Oligomer
uucgcuucuuccuucgucaugaa

SEQ ID NO: 71335 - RNA, 23 nt, Artificial Sequence
  Oligomer
gccuccugguaaaaggacaaacu

SEQ ID NO: 71336 - RNA, 23 nt, Artificial Sequence
  Oligomer
ugccuccugguaaaaggacaaac

SEQ ID NO: 71337 - RNA, 23 nt, Artificial Sequence
  Oligomer
cugccuccugguaaaaggacaaa

SEQ ID NO: 71338 - RNA, 23 nt, Artificial Sequence
  Oligomer
ucugccuccugguaaaaggacaa

SEQ ID NO: 71339 - RNA, 23 nt, Artificial Sequence
  Oligomer
aguucucagcaguugucaacagu

SEQ ID NO: 71340 - RNA, 23 nt, Artificial Sequence
  Oligomer
aaguucucagcaguugucaacag

SEQ ID NO: 71341 - RNA, 23 nt, Artificial Sequence
  Oligomer
gaaguucucagcaguugucaaca

SEQ ID NO: 71342 - RNA, 23 nt, Artificial Sequence
  Oligomer
ggaaguucucagcaguugucaac

SEQ ID NO: 71343 - RNA, 23 nt, Artificial Sequence
  Oligomer
cugaggaagaaccagagcaguga

SEQ ID NO: 71344 - RNA, 23 nt, Artificial Sequence
  Oligomer
uaaaaguuccuggugaauaucga

SEQ ID NO: 71345 - RNA, 23 nt, Artificial Sequence
  Oligomer
guaacuugcugggacuguaccca

SEQ ID NO: 71346 - RNA, 23 nt, Artificial Sequence
  Oligomer
cguaacuugcugggacuguaccc

SEQ ID NO: 71347 - RNA, 23 nt, Artificial Sequence
  Oligomer
acguaacuugcugggacuguacc

SEQ ID NO: 71348 - RNA, 23 nt, Artificial Sequence
  Oligomer
cagaagaaccaaauccagaggcu

SEQ ID NO: 71349 - RNA, 23 nt, Artificial Sequence
  Oligomer
ccagaagaaccaaauccagaggc

SEQ ID NO: 71350 - RNA, 23 nt, Artificial Sequence
  Oligomer
gauuuggaagucagaggaacgaa

SEQ ID NO: 71351 - RNA, 23 nt, Artificial Sequence
  Oligomer
aaccagagugaugcugaccuaga

SEQ ID NO: 71352 - RNA, 23 nt, Artificial Sequence
  Oligomer
aaaccagagugaugcugaccuag

SEQ ID NO: 71353 - RNA, 23 nt, Artificial Sequence
  Oligomer
gaaaccagagugaugcugaccua

SEQ ID NO: 71354 - RNA, 23 nt, Artificial Sequence
  Oligomer
ucuuuggagggagaauuugaccu

SEQ ID NO: 71355 - RNA, 23 nt, Artificial Sequence
  Oligomer
guucuucaacgauuuggaaguca

SEQ ID NO: 71356 - RNA, 23 nt, Artificial Sequence
  Oligomer
uguucuucaacgauuuggaaguc

SEQ ID NO: 71357 - RNA, 23 nt, Artificial Sequence
  Oligomer
auguucuucaacgauuuggaagu

SEQ ID NO: 71358 - RNA, 23 nt, Artificial Sequence
  Oligomer
gauguucuucaacgauuuggaag

SEQ ID NO: 71359 - RNA, 23 nt, Artificial Sequence
  Oligomer
ugauguucuucaacgauuuggaa

SEQ ID NO: 71360 - RNA, 23 nt, Artificial Sequence
  Oligomer
gguccuaaugggccaaauauuca

SEQ ID NO: 71361 - RNA, 23 nt, Artificial Sequence
  Oligomer
ggguccuaaugggccaaauauuc

SEQ ID NO: 71362 - RNA, 23 nt, Artificial Sequence
  Oligomer
aggguccuaaugggccaaauauu

SEQ ID NO: 71363 - RNA, 23 nt, Artificial Sequence
  Oligomer
gaggguccuaaugggccaaauau

SEQ ID NO: 71364 - RNA, 23 nt, Artificial Sequence
  Oligomer
agaggguccuaaugggccaaaua

SEQ ID NO: 71365 - RNA, 23 nt, Artificial Sequence
  Oligomer
ccuguuccuacaaaaccaaaaca

SEQ ID NO: 71366 - RNA, 23 nt, Artificial Sequence
  Oligomer
uccuguuccuacaaaaccaaaac

SEQ ID NO: 71367 - RNA, 23 nt, Artificial Sequence
  Oligomer
cuccuguuccuacaaaaccaaaa

SEQ ID NO: 71368 - RNA, 23 nt, Artificial Sequence
  Oligomer
ccuccuguuccuacaaaaccaaa

SEQ ID NO: 71369 - RNA, 23 nt, Artificial Sequence
  Oligomer
accuccuguuccuacaaaaccaa

SEQ ID NO: 71370 - RNA, 23 nt, Artificial Sequence
  Oligomer
gggaaacuuguggaggaaauuga

SEQ ID NO: 71371 - RNA, 23 nt, Artificial Sequence
  Oligomer
aacaaugagcagcacuucacaga

SEQ ID NO: 71372 - RNA, 23 nt, Artificial Sequence
  Oligomer
uaacaaugagcagcacuucacag

SEQ ID NO: 71373 - RNA, 23 nt, Artificial Sequence
  Oligomer
auguagcuugaaagcgaugaaga

SEQ ID NO: 71374 - RNA, 23 nt, Artificial Sequence
  Oligomer
aauguagcuugaaagcgaugaag

SEQ ID NO: 71375 - RNA, 23 nt, Artificial Sequence
  Oligomer
uuuuaaugacaauguagcuugaa

SEQ ID NO: 71376 - RNA, 23 nt, Artificial Sequence
  Oligomer
auuuuaaugacaauguagcuuga

SEQ ID NO: 71377 - RNA, 23 nt, Artificial Sequence
  Oligomer
aauugaaucaagagcagaaugcc

SEQ ID NO: 71378 - RNA, 23 nt, Artificial Sequence
  Oligomer
aaauugaaucaagagcagaaugc

SEQ ID NO: 71379 - RNA, 23 nt, Artificial Sequence
  Oligomer
ccaugacaaucagucugcagugg

SEQ ID NO: 71380 - RNA, 23 nt, Artificial Sequence
  Oligomer
accaugacaaucagucugcagug

SEQ ID NO: 71381 - RNA, 23 nt, Artificial Sequence
  Oligomer
caccaugacaaucagucugcagu

SEQ ID NO: 71382 - RNA, 23 nt, Artificial Sequence
  Oligomer
ccaccaugacaaucagucugcag

SEQ ID NO: 71383 - RNA, 23 nt, Artificial Sequence
  Oligomer
gccaccaugacaaucagucugca

SEQ ID NO: 71384 - RNA, 23 nt, Artificial Sequence
  Oligomer
caaguugcugagcaggagaaacu

SEQ ID NO: 71385 - RNA, 23 nt, Artificial Sequence
  Oligomer
acaaguugcugagcaggagaaac

SEQ ID NO: 71386 - RNA, 23 nt, Artificial Sequence
  Oligomer
aacaaguugcugagcaggagaaa

SEQ ID NO: 71387 - RNA, 23 nt, Artificial Sequence
  Oligomer
caacaaguugcugagcaggagaa

SEQ ID NO: 71388 - RNA, 23 nt, Artificial Sequence
  Oligomer
gcaacaaguugcugagcaggaga

SEQ ID NO: 71389 - RNA, 23 nt, Artificial Sequence
  Oligomer
gauugaagcccagcaacaauugc

SEQ ID NO: 71390 - RNA, 23 nt, Artificial Sequence
  Oligomer
agauugaagcccagcaacaauug

SEQ ID NO: 71391 - RNA, 23 nt, Artificial Sequence
  Oligomer
cagauugaagcccagcaacaauu

SEQ ID NO: 71392 - RNA, 23 nt, Artificial Sequence
  Oligomer
ccugaaacuuccacacagaauuu

SEQ ID NO: 71393 - RNA, 23 nt, Artificial Sequence
  Oligomer
gccugaaacuuccacacagaauu

SEQ ID NO: 71394 - RNA, 23 nt, Artificial Sequence
  Oligomer
ggccugaaacuuccacacagaau

SEQ ID NO: 71395 - RNA, 23 nt, Artificial Sequence
  Oligomer
uggccugaaacuuccacacagaa

SEQ ID NO: 71396 - RNA, 23 nt, Artificial Sequence
  Oligomer
uuggccugaaacuuccacacaga

SEQ ID NO: 71397 - RNA, 23 nt, Artificial Sequence
  Oligomer
agagaacagugacaugccagcuc

SEQ ID NO: 71398 - RNA, 23 nt, Artificial Sequence
  Oligomer
cagagaacagugacaugccagcu

SEQ ID NO: 71399 - RNA, 23 nt, Artificial Sequence
  Oligomer
acagagaacagugacaugccagc

SEQ ID NO: 71400 - RNA, 23 nt, Artificial Sequence
  Oligomer
uacagagaacagugacaugccag

SEQ ID NO: 71401 - RNA, 23 nt, Artificial Sequence
  Oligomer
guacagagaacagugacaugcca

SEQ ID NO: 71402 - RNA, 23 nt, Artificial Sequence
  Oligomer
gaccuagaagccuuacgaaagaa

SEQ ID NO: 71403 - RNA, 23 nt, Artificial Sequence
  Oligomer
ugaccuagaagccuuacgaaaga

SEQ ID NO: 71404 - RNA, 23 nt, Artificial Sequence
  Oligomer
ccauguauacgcaacagcaggcg

SEQ ID NO: 71405 - RNA, 23 nt, Artificial Sequence
  Oligomer
uccauguauacgcaacagcaggc

SEQ ID NO: 71406 - RNA, 23 nt, Artificial Sequence
  Oligomer
uuccauguauacgcaacagcagg

SEQ ID NO: 71407 - RNA, 23 nt, Artificial Sequence
  Oligomer
auuccauguauacgcaacagcag

SEQ ID NO: 71408 - RNA, 23 nt, Artificial Sequence
  Oligomer
uauuccauguauacgcaacagca

SEQ ID NO: 71409 - RNA, 23 nt, Artificial Sequence
  Oligomer
agaaagugcguccguucucaaug

SEQ ID NO: 71410 - RNA, 23 nt, Artificial Sequence
  Oligomer
aagaaagugcguccguucucaau

SEQ ID NO: 71411 - RNA, 23 nt, Artificial Sequence
  Oligomer
gaagaaagugcguccguucucaa

SEQ ID NO: 71412 - RNA, 23 nt, Artificial Sequence
  Oligomer
agaucuuuucccaagccaaggcu

SEQ ID NO: 71413 - RNA, 23 nt, Artificial Sequence
  Oligomer
cagaucuuuucccaagccaaggc

SEQ ID NO: 71414 - RNA, 23 nt, Artificial Sequence
  Oligomer
gcagaucuuuucccaagccaagg

SEQ ID NO: 71415 - RNA, 23 nt, Artificial Sequence
  Oligomer
ugcagaucuuuucccaagccaag

SEQ ID NO: 71416 - RNA, 23 nt, Artificial Sequence
  Oligomer
augcagaucuuuucccaagccaa

SEQ ID NO: 71417 - RNA, 23 nt, Artificial Sequence
  Oligomer
agcugagaaucaggaagcuaagc

SEQ ID NO: 71418 - RNA, 23 nt, Artificial Sequence
  Oligomer
uagcugagaaucaggaagcuaag

SEQ ID NO: 71419 - RNA, 23 nt, Artificial Sequence
  Oligomer
auagcugagaaucaggaagcuaa

SEQ ID NO: 71420 - RNA, 23 nt, Artificial Sequence
  Oligomer
aacuguuaguugguugucaguga

SEQ ID NO: 71421 - RNA, 23 nt, Artificial Sequence
  Oligomer
gaggaaggcuacacucagugcuc

SEQ ID NO: 71422 - RNA, 23 nt, Artificial Sequence
  Oligomer
ggaggaaggcuacacucagugcu

SEQ ID NO: 71423 - RNA, 23 nt, Artificial Sequence
  Oligomer
uggaggaaggcuacacucagugc

SEQ ID NO: 71424 - RNA, 23 nt, Artificial Sequence
  Oligomer
auggaggaaggcuacacucagug

SEQ ID NO: 71425 - RNA, 23 nt, Artificial Sequence
  Oligomer
aauggaggaaggcuacacucagu

SEQ ID NO: 71426 - RNA, 23 nt, Artificial Sequence
  Oligomer
ggcagggacauugugaguggacc

SEQ ID NO: 71427 - RNA, 23 nt, Artificial Sequence
  Oligomer
uggcagggacauugugaguggac

SEQ ID NO: 71428 - RNA, 23 nt, Artificial Sequence
  Oligomer
cuggcagggacauugugagugga

SEQ ID NO: 71429 - RNA, 23 nt, Artificial Sequence
  Oligomer
gagcguaucgcucauggaaugag

SEQ ID NO: 71430 - RNA, 23 nt, Artificial Sequence
  Oligomer
agagcguaucgcucauggaauga

SEQ ID NO: 71431 - RNA, 23 nt, Artificial Sequence
  Oligomer
cagagcguaucgcucauggaaug

SEQ ID NO: 71432 - RNA, 23 nt, Artificial Sequence
  Oligomer
ucagagcguaucgcucauggaau

SEQ ID NO: 71433 - RNA, 23 nt, Artificial Sequence
  Oligomer
cucagagcguaucgcucauggaa

SEQ ID NO: 71434 - RNA, 23 nt, Artificial Sequence
  Oligomer
gacaaacuugcguaaaacuggcu

SEQ ID NO: 71435 - RNA, 23 nt, Artificial Sequence
  Oligomer
ggaagucagaggaacgaaguucg

SEQ ID NO: 71436 - RNA, 23 nt, Artificial Sequence
  Oligomer
uggaagucagaggaacgaaguuc

SEQ ID NO: 71437 - RNA, 23 nt, Artificial Sequence
  Oligomer
uuggaagucagaggaacgaaguu

SEQ ID NO: 71438 - RNA, 23 nt, Artificial Sequence
  Oligomer
uuuggaagucagaggaacgaagu

SEQ ID NO: 71439 - RNA, 23 nt, Artificial Sequence
  Oligomer
auuuggaagucagaggaacgaag

SEQ ID NO: 71440 - RNA, 23 nt, Artificial Sequence
  Oligomer
guuugauguucuucaacgauuug

SEQ ID NO: 71441 - RNA, 23 nt, Artificial Sequence
  Oligomer
uguuugauguucuucaacgauuu

SEQ ID NO: 71442 - RNA, 23 nt, Artificial Sequence
  Oligomer
auguuugauguucuucaacgauu

SEQ ID NO: 71443 - RNA, 23 nt, Artificial Sequence
  Oligomer
aauguuugauguucuucaacgau

SEQ ID NO: 71444 - RNA, 23 nt, Artificial Sequence
  Oligomer
gaauguuugauguucuucaacga

SEQ ID NO: 71445 - RNA, 23 nt, Artificial Sequence
  Oligomer
cagaagcuuuuauaucagaggac

SEQ ID NO: 71446 - RNA, 23 nt, Artificial Sequence
  Oligomer
ucagaagcuuuuauaucagagga

SEQ ID NO: 71447 - RNA, 23 nt, Artificial Sequence
  Oligomer
uucagaagcuuuuauaucagagg

SEQ ID NO: 71448 - RNA, 23 nt, Artificial Sequence
  Oligomer
auucagaagcuuuuauaucagag

SEQ ID NO: 71449 - RNA, 23 nt, Artificial Sequence
  Oligomer
uauucagaagcuuuuauaucaga

SEQ ID NO: 71450 - RNA, 23 nt, Artificial Sequence
  Oligomer
aauucagaaguggcagucaugga

SEQ ID NO: 71451 - RNA, 23 nt, Artificial Sequence
  Oligomer
uugcugaacuucaggaaauggca

SEQ ID NO: 71452 - RNA, 23 nt, Artificial Sequence
  Oligomer
uaguugguugucagugaacaaua

SEQ ID NO: 71453 - RNA, 23 nt, Artificial Sequence
  Oligomer
agaugaugccgauguuucuuacc

SEQ ID NO: 71454 - RNA, 23 nt, Artificial Sequence
  Oligomer
aagaugaugccgauguuucuuac

SEQ ID NO: 71455 - RNA, 23 nt, Artificial Sequence
  Oligomer
caagaugaugccgauguuucuua

SEQ ID NO: 71456 - RNA, 23 nt, Artificial Sequence
  Oligomer
ccagaccguggcagcaaguucaa

SEQ ID NO: 71457 - RNA, 23 nt, Artificial Sequence
  Oligomer
gcagaaugccaagcuacaacaac

SEQ ID NO: 71458 - RNA, 23 nt, Artificial Sequence
  Oligomer
agcagaaugccaagcuacaacaa

SEQ ID NO: 71459 - RNA, 23 nt, Artificial Sequence
  Oligomer
gagcagaaugccaagcuacaaca

SEQ ID NO: 71460 - RNA, 23 nt, Artificial Sequence
  Oligomer
aaguugcugagcaggagaaacuu

SEQ ID NO: 71461 - RNA, 23 nt, Artificial Sequence
  Oligomer
caccauuagaggacauuuagcgu

SEQ ID NO: 71462 - RNA, 23 nt, Artificial Sequence
  Oligomer
ucaccauuagaggacauuuagcg

SEQ ID NO: 71463 - RNA, 23 nt, Artificial Sequence
  Oligomer
uucaccauuagaggacauuuagc

SEQ ID NO: 71464 - RNA, 23 nt, Artificial Sequence
  Oligomer
auucaccauuagaggacauuuag

SEQ ID NO: 71465 - RNA, 23 nt, Artificial Sequence
  Oligomer
aauucaccauuagaggacauuua

SEQ ID NO: 71466 - RNA, 23 nt, Artificial Sequence
  Oligomer
uggcaaaaauuucacaagacuua

SEQ ID NO: 71467 - RNA, 23 nt, Artificial Sequence
  Oligomer
uuggcaaaaauuucacaagacuu

SEQ ID NO: 71468 - RNA, 23 nt, Artificial Sequence
  Oligomer
uuuggcaaaaauuucacaagacu

SEQ ID NO: 71469 - RNA, 23 nt, Artificial Sequence
  Oligomer
uuuuggcaaaaauuucacaagac

SEQ ID NO: 71470 - RNA, 23 nt, Artificial Sequence
  Oligomer
uuuuuggcaaaaauuucacaaga

SEQ ID NO: 71471 - RNA, 23 nt, Artificial Sequence
  Oligomer
cucugccuccugguaaaaggaca

SEQ ID NO: 71472 - RNA, 23 nt, Artificial Sequence
  Oligomer
aguucaggagaaccaugaaaacg

SEQ ID NO: 71473 - RNA, 23 nt, Artificial Sequence
  Oligomer
caguucaggagaaccaugaaaac

SEQ ID NO: 71474 - RNA, 23 nt, Artificial Sequence
  Oligomer
ucaguucaggagaaccaugaaaa

SEQ ID NO: 71475 - RNA, 23 nt, Artificial Sequence
  Oligomer
uucaguucaggagaaccaugaaa

SEQ ID NO: 71476 - RNA, 23 nt, Artificial Sequence
  Oligomer
cuucaguucaggagaaccaugaa

SEQ ID NO: 71477 - RNA, 23 nt, Artificial Sequence
  Oligomer
cgacagccaccaugacaaucagu

SEQ ID NO: 71478 - RNA, 23 nt, Artificial Sequence
  Oligomer
ucgacagccaccaugacaaucag

SEQ ID NO: 71479 - RNA, 23 nt, Artificial Sequence
  Oligomer
aucgacagccaccaugacaauca

SEQ ID NO: 71480 - RNA, 23 nt, Artificial Sequence
  Oligomer
gaucgacagccaccaugacaauc

SEQ ID NO: 71481 - RNA, 23 nt, Artificial Sequence
  Oligomer
ggaucgacagccaccaugacaau

SEQ ID NO: 71482 - RNA, 23 nt, Artificial Sequence
  Oligomer
agcuagagaugcucaagaacggc

SEQ ID NO: 71483 - RNA, 23 nt, Artificial Sequence
  Oligomer
cagcuagagaugcucaagaacgg

SEQ ID NO: 71484 - RNA, 23 nt, Artificial Sequence
  Oligomer
gcagcuagagaugcucaagaacg

SEQ ID NO: 71485 - RNA, 23 nt, Artificial Sequence
  Oligomer
cuaaaaaaagugagagcacuuaa

SEQ ID NO: 71486 - RNA, 23 nt, Artificial Sequence
  Oligomer
uugcugggacuguacccaagaau

SEQ ID NO: 71487 - RNA, 23 nt, Artificial Sequence
  Oligomer
cuugcugggacuguacccaagaa

SEQ ID NO: 71488 - RNA, 23 nt, Artificial Sequence
  Oligomer
gagggauauguuccacguaacuu

SEQ ID NO: 71489 - RNA, 23 nt, Artificial Sequence
  Oligomer
ggagggauauguuccacguaacu

SEQ ID NO: 71490 - RNA, 23 nt, Artificial Sequence
  Oligomer
aggagggauauguuccacguaac

SEQ ID NO: 71491 - RNA, 23 nt, Artificial Sequence
  Oligomer
aaggagggauauguuccacguaa

SEQ ID NO: 71492 - RNA, 23 nt, Artificial Sequence
  Oligomer
uaaggagggauauguuccacgua

SEQ ID NO: 71493 - RNA, 23 nt, Artificial Sequence
  Oligomer
guucgcuucuuccuucgucauga

SEQ ID NO: 71494 - RNA, 23 nt, Artificial Sequence
  Oligomer
ugauuaugagccugagggagucc

SEQ ID NO: 71495 - RNA, 23 nt, Artificial Sequence
  Oligomer
uugauuaugagccugagggaguc

SEQ ID NO: 71496 - RNA, 23 nt, Artificial Sequence
  Oligomer
cuugauuaugagccugagggagu

SEQ ID NO: 71497 - RNA, 23 nt, Artificial Sequence
  Oligomer
caguagaaauccagaauccauau

SEQ ID NO: 71498 - RNA, 23 nt, Artificial Sequence
  Oligomer
cugaccuagaagccuuacgaaag

SEQ ID NO: 71499 - RNA, 23 nt, Artificial Sequence
  Oligomer
gcugaccuagaagccuuacgaaa

SEQ ID NO: 71500 - RNA, 23 nt, Artificial Sequence
  Oligomer
ugcugaccuagaagccuuacgaa

SEQ ID NO: 71501 - RNA, 23 nt, Artificial Sequence
  Oligomer
uggcccugauuggaguccuucaa

SEQ ID NO: 71502 - RNA, 23 nt, Artificial Sequence
  Oligomer
cccuauauccagucgucuacuau

SEQ ID NO: 71503 - RNA, 23 nt, Artificial Sequence
  Oligomer
ucccuauauccagucgucuacua

SEQ ID NO: 71504 - RNA, 23 nt, Artificial Sequence
  Oligomer
gucccuauauccagucgucuacu

SEQ ID NO: 71505 - RNA, 23 nt, Artificial Sequence
  Oligomer
ggucccuauauccagucgucuac

SEQ ID NO: 71506 - RNA, 23 nt, Artificial Sequence
  Oligomer
aggucccuauauccagucgucua

SEQ ID NO: 71507 - RNA, 23 nt, Artificial Sequence
  Oligomer
gagcuugaucgccucuauaagga

SEQ ID NO: 71508 - RNA, 23 nt, Artificial Sequence
  Oligomer
ugagcuugaucgccucuauaagg

SEQ ID NO: 71509 - RNA, 23 nt, Artificial Sequence
  Oligomer
cugagcuugaucgccucuauaag

SEQ ID NO: 71510 - RNA, 23 nt, Artificial Sequence
  Oligomer
gcugagcuugaucgccucuauaa

SEQ ID NO: 71511 - RNA, 23 nt, Artificial Sequence
  Oligomer
ggcugagcuugaucgccucuaua

SEQ ID NO: 71512 - RNA, 23 nt, Artificial Sequence
  Oligomer
cagcaacaauugcuggcaacuaa

SEQ ID NO: 71513 - RNA, 23 nt, Artificial Sequence
  Oligomer
ccagcaacaauugcuggcaacua

SEQ ID NO: 71514 - RNA, 23 nt, Artificial Sequence
  Oligomer
cccagcaacaauugcuggcaacu

SEQ ID NO: 71515 - RNA, 23 nt, Artificial Sequence
  Oligomer
gcccagcaacaauugcuggcaac

SEQ ID NO: 71516 - RNA, 23 nt, Artificial Sequence
  Oligomer
agcccagcaacaauugcuggcaa

SEQ ID NO: 71517 - RNA, 23 nt, Artificial Sequence
  Oligomer
uaagcuacgguaccaguaauuag

SEQ ID NO: 71518 - RNA, 23 nt, Artificial Sequence
  Oligomer
gcgccuuaaugauaaggagggau

SEQ ID NO: 71519 - RNA, 23 nt, Artificial Sequence
  Oligomer
cgcgccuuaaugauaaggaggga

SEQ ID NO: 71520 - RNA, 23 nt, Artificial Sequence
  Oligomer
gcgcgccuuaaugauaaggaggg

SEQ ID NO: 71521 - RNA, 23 nt, Artificial Sequence
  Oligomer
ggcgcgccuuaaugauaaggagg

SEQ ID NO: 71522 - RNA, 23 nt, Artificial Sequence
  Oligomer
gaaucaacagcagcacccagaga

SEQ ID NO: 71523 - RNA, 23 nt, Artificial Sequence
  Oligomer
agaaucaacagcagcacccagag

SEQ ID NO: 71524 - RNA, 23 nt, Artificial Sequence
  Oligomer
cagaaucaacagcagcacccaga

SEQ ID NO: 71525 - RNA, 23 nt, Artificial Sequence
  Oligomer
ggucauucaggcuucagaggggc

SEQ ID NO: 71526 - RNA, 23 nt, Artificial Sequence
  Oligomer
ucuaccaguuucaucugauggaa

SEQ ID NO: 71527 - RNA, 23 nt, Artificial Sequence
  Oligomer
aaagcgaugaagaaugucucuag

SEQ ID NO: 71528 - RNA, 23 nt, Artificial Sequence
  Oligomer
gcaaaaauuucacaagacuuauu

SEQ ID NO: 71529 - RNA, 23 nt, Artificial Sequence
  Oligomer
ggcaaaaauuucacaagacuuau

SEQ ID NO: 71530 - RNA, 23 nt, Artificial Sequence
  Oligomer
agggauauguuccacguaacuug

SEQ ID NO: 71531 - RNA, 23 nt, Artificial Sequence
  Oligomer
auaaggagggauauguuccacgu

SEQ ID NO: 71532 - RNA, 23 nt, Artificial Sequence
  Oligomer
ugaaagaaggagacugcaugaca

SEQ ID NO: 71533 - RNA, 23 nt, Artificial Sequence
  Oligomer
auggauggacuccauuacauugu

SEQ ID NO: 71534 - RNA, 23 nt, Artificial Sequence
  Oligomer
gauggauggacuccauuacauug

SEQ ID NO: 71535 - RNA, 23 nt, Artificial Sequence
  Oligomer
ugauggauggacuccauuacauu

SEQ ID NO: 71536 - RNA, 23 nt, Artificial Sequence
  Oligomer
auaccagagggccacacuuuuca

SEQ ID NO: 71537 - RNA, 23 nt, Artificial Sequence
  Oligomer
agaccagacccuuucuccagguu

SEQ ID NO: 71538 - RNA, 23 nt, Artificial Sequence
  Oligomer
aagaccagacccuuucuccaggu

SEQ ID NO: 71539 - RNA, 23 nt, Artificial Sequence
  Oligomer
caagaccagacccuuucuccagg

SEQ ID NO: 71540 - RNA, 23 nt, Artificial Sequence
  Oligomer
cauaccuucgguuggccaagacc

SEQ ID NO: 71541 - RNA, 23 nt, Artificial Sequence
  Oligomer
gcauaccuucgguuggccaagac

SEQ ID NO: 71542 - RNA, 23 nt, Artificial Sequence
  Oligomer
agcauaccuucgguuggccaaga

SEQ ID NO: 71543 - RNA, 23 nt, Artificial Sequence
  Oligomer
cagcauaccuucgguuggccaag

SEQ ID NO: 71544 - RNA, 23 nt, Artificial Sequence
  Oligomer
ccagcauaccuucgguuggccaa

SEQ ID NO: 71545 - RNA, 23 nt, Artificial Sequence
  Oligomer
aaugcagaucuuuucccaagcca

SEQ ID NO: 71546 - RNA, 23 nt, Artificial Sequence
  Oligomer
aaaugcagaucuuuucccaagcc

SEQ ID NO: 71547 - RNA, 23 nt, Artificial Sequence
  Oligomer
caaaugcagaucuuuucccaagc

SEQ ID NO: 71548 - RNA, 23 nt, Artificial Sequence
  Oligomer
ucaaaugcagaucuuuucccaag

SEQ ID NO: 71549 - RNA, 23 nt, Artificial Sequence
  Oligomer
uucaaaugcagaucuuuucccaa

SEQ ID NO: 71550 - RNA, 23 nt, Artificial Sequence
  Oligomer
guggcagucauggauaagcgugu

SEQ ID NO: 71551 - RNA, 23 nt, Artificial Sequence
  Oligomer
aguggcagucauggauaagcgug

SEQ ID NO: 71552 - RNA, 23 nt, Artificial Sequence
  Oligomer
gccucuauaaggagcugcagcua

SEQ ID NO: 71553 - RNA, 23 nt, Artificial Sequence
  Oligomer
cgccucuauaaggagcugcagcu

SEQ ID NO: 71554 - RNA, 23 nt, Artificial Sequence
  Oligomer
ucgccucuauaaggagcugcagc

SEQ ID NO: 71555 - RNA, 23 nt, Artificial Sequence
  Oligomer
aucgccucuauaaggagcugcag

SEQ ID NO: 71556 - RNA, 23 nt, Artificial Sequence
  Oligomer
gaucgccucuauaaggagcugca

SEQ ID NO: 71557 - RNA, 23 nt, Artificial Sequence
  Oligomer
aacaauugcuggcaacuaaggaa

SEQ ID NO: 71558 - RNA, 23 nt, Artificial Sequence
  Oligomer
caacaauugcuggcaacuaagga

SEQ ID NO: 71559 - RNA, 23 nt, Artificial Sequence
  Oligomer
gcaacaauugcuggcaacuaagg

SEQ ID NO: 71560 - RNA, 23 nt, Artificial Sequence
  Oligomer
agcaacaauugcuggcaacuaag

SEQ ID NO: 71561 - RNA, 23 nt, Artificial Sequence
  Oligomer
auugggcaguugggaaaucagcu

SEQ ID NO: 71562 - RNA, 23 nt, Artificial Sequence
  Oligomer
augaaagaaggagacugcaugac

SEQ ID NO: 71563 - RNA, 23 nt, Artificial Sequence
  Oligomer
caugaaagaaggagacugcauga

SEQ ID NO: 71564 - RNA, 23 nt, Artificial Sequence
  Oligomer
gucauuuaugcgcuuugggauua

SEQ ID NO: 71565 - RNA, 23 nt, Artificial Sequence
  Oligomer
agucauuuaugcgcuuugggauu

SEQ ID NO: 71566 - RNA, 23 nt, Artificial Sequence
  Oligomer
ccauggagaccaucucuguccca

SEQ ID NO: 71567 - RNA, 23 nt, Artificial Sequence
  Oligomer
gccauggagaccaucucuguccc

SEQ ID NO: 71568 - RNA, 23 nt, Artificial Sequence
  Oligomer
ggccauggagaccaucucugucc

SEQ ID NO: 71569 - RNA, 23 nt, Artificial Sequence
  Oligomer
cggccauggagaccaucucuguc

SEQ ID NO: 71570 - RNA, 23 nt, Artificial Sequence
  Oligomer
gcggccauggagaccaucucugu

SEQ ID NO: 71571 - RNA, 23 nt, Artificial Sequence
  Oligomer
cuaacgcaccaaggccucuaaag

SEQ ID NO: 71572 - RNA, 23 nt, Artificial Sequence
  Oligomer
ucuaacgcaccaaggccucuaaa

SEQ ID NO: 71573 - RNA, 23 nt, Artificial Sequence
  Oligomer
augcugaccuagaagccuuacga

SEQ ID NO: 71574 - RNA, 23 nt, Artificial Sequence
  Oligomer
gaugcugaccuagaagccuuacg

SEQ ID NO: 71575 - RNA, 23 nt, Artificial Sequence
  Oligomer
ugaugcugaccuagaagccuuac

SEQ ID NO: 71576 - RNA, 23 nt, Artificial Sequence
  Oligomer
gugaugcugaccuagaagccuua

SEQ ID NO: 71577 - RNA, 23 nt, Artificial Sequence
  Oligomer
cuuaucuaauccuuaccgaaacc

SEQ ID NO: 71578 - RNA, 23 nt, Artificial Sequence
  Oligomer
ucuuaucuaauccuuaccgaaac

SEQ ID NO: 71579 - RNA, 23 nt, Artificial Sequence
  Oligomer
uucuuaucuaauccuuaccgaaa

SEQ ID NO: 71580 - RNA, 23 nt, Artificial Sequence
  Oligomer
uuucuuaucuaauccuuaccgaa

SEQ ID NO: 71581 - RNA, 23 nt, Artificial Sequence
  Oligomer
caacuaaauuacugccuuucuua

SEQ ID NO: 71582 - RNA, 23 nt, Artificial Sequence
  Oligomer
caccuccuguuccuacaaaacca

SEQ ID NO: 71583 - RNA, 23 nt, Artificial Sequence
  Oligomer
ccaccuccuguuccuacaaaacc

SEQ ID NO: 71584 - RNA, 23 nt, Artificial Sequence
  Oligomer
accaccuccuguuccuacaaaac

SEQ ID NO: 71585 - RNA, 23 nt, Artificial Sequence
  Oligomer
uaccaccuccuguuccuacaaaa

SEQ ID NO: 71586 - RNA, 23 nt, Artificial Sequence
  Oligomer
uuggcccugauuggaguccuuca

SEQ ID NO: 71587 - RNA, 23 nt, Artificial Sequence
  Oligomer
cuucacaaacuaaaggcucuaaa

SEQ ID NO: 71588 - RNA, 23 nt, Artificial Sequence
  Oligomer
ugucucuagaagagaaugaagga

SEQ ID NO: 71589 - RNA, 23 nt, Artificial Sequence
  Oligomer
gugauggauggacuccauuacau

SEQ ID NO: 71590 - RNA, 23 nt, Artificial Sequence
  Oligomer
agugauggauggacuccauuaca

SEQ ID NO: 71591 - RNA, 23 nt, Artificial Sequence
  Oligomer
uagugauggauggacuccauuac

SEQ ID NO: 71592 - RNA, 23 nt, Artificial Sequence
  Oligomer
auagugauggauggacuccauua

SEQ ID NO: 71593 - RNA, 23 nt, Artificial Sequence
  Oligomer
gagaagacucggugagcaugcgc

SEQ ID NO: 71594 - RNA, 23 nt, Artificial Sequence
  Oligomer
ggagaagacucggugagcaugcg

SEQ ID NO: 71595 - RNA, 23 nt, Artificial Sequence
  Oligomer
cggagaagacucggugagcaugc

SEQ ID NO: 71596 - RNA, 23 nt, Artificial Sequence
  Oligomer
ccggagaagacucggugagcaug

SEQ ID NO: 71597 - RNA, 23 nt, Artificial Sequence
  Oligomer
cccggagaagacucggugagcau

SEQ ID NO: 71598 - RNA, 23 nt, Artificial Sequence
  Oligomer
agacaacagcccaaaucuccaga

SEQ ID NO: 71599 - RNA, 23 nt, Artificial Sequence
  Oligomer
cagacaacagcccaaaucuccag

SEQ ID NO: 71600 - RNA, 23 nt, Artificial Sequence
  Oligomer
ccagacaacagcccaaaucucca

SEQ ID NO: 71601 - RNA, 23 nt, Artificial Sequence
  Oligomer
accuuccuuugguacucugagga

SEQ ID NO: 71602 - RNA, 23 nt, Artificial Sequence
  Oligomer
caccuuccuuugguacucugagg

SEQ ID NO: 71603 - RNA, 23 nt, Artificial Sequence
  Oligomer
ccaccuuccuuugguacucugag

SEQ ID NO: 71604 - RNA, 23 nt, Artificial Sequence
  Oligomer
cccaccuuccuuugguacucuga

SEQ ID NO: 71605 - RNA, 23 nt, Artificial Sequence
  Oligomer
cagaaugccaagcuacaacaaca

SEQ ID NO: 71606 - RNA, 23 nt, Artificial Sequence
  Oligomer
aggaucgacagccaccaugacaa

SEQ ID NO: 71607 - RNA, 23 nt, Artificial Sequence
  Oligomer
ugaagaauucaccauuagaggac

SEQ ID NO: 71608 - RNA, 23 nt, Artificial Sequence
  Oligomer
uugaagaauucaccauuagagga

SEQ ID NO: 71609 - RNA, 23 nt, Artificial Sequence
  Oligomer
auugaagaauucaccauuagagg

SEQ ID NO: 71610 - RNA, 23 nt, Artificial Sequence
  Oligomer
agaucucaggauccaaguuuaaa

SEQ ID NO: 71611 - RNA, 23 nt, Artificial Sequence
  Oligomer
aagaucucaggauccaaguuuaa

SEQ ID NO: 71612 - RNA, 23 nt, Artificial Sequence
  Oligomer
caagaucucaggauccaaguuua

SEQ ID NO: 71613 - RNA, 23 nt, Artificial Sequence
  Oligomer
cuuugggauuaugaaccucagaa

SEQ ID NO: 71614 - RNA, 23 nt, Artificial Sequence
  Oligomer
gagguggucucucugguuccuga

SEQ ID NO: 71615 - RNA, 23 nt, Artificial Sequence
  Oligomer
cagaggguccuaaugggccaaau

SEQ ID NO: 71616 - RNA, 23 nt, Artificial Sequence
  Oligomer
cagacacugcccaacaugagauc

SEQ ID NO: 71617 - RNA, 23 nt, Artificial Sequence
  Oligomer
acagacacugcccaacaugagau

SEQ ID NO: 71618 - RNA, 23 nt, Artificial Sequence
  Oligomer
uacagacacugcccaacaugaga

SEQ ID NO: 71619 - RNA, 23 nt, Artificial Sequence
  Oligomer
auacagacacugcccaacaugag

SEQ ID NO: 71620 - RNA, 23 nt, Artificial Sequence
  Oligomer
aauacagacacugcccaacauga

SEQ ID NO: 71621 - RNA, 23 nt, Artificial Sequence
  Oligomer
aaauacagacacugcccaacaug

SEQ ID NO: 71622 - RNA, 23 nt, Artificial Sequence
  Oligomer
aaaauacagacacugcccaacau

SEQ ID NO: 71623 - RNA, 23 nt, Artificial Sequence
  Oligomer
gaaaauacagacacugcccaaca

SEQ ID NO: 71624 - RNA, 23 nt, Artificial Sequence
  Oligomer
ugaaaauacagacacugcccaac

SEQ ID NO: 71625 - RNA, 23 nt, Artificial Sequence
  Oligomer
augaaaauacagacacugcccaa

SEQ ID NO: 71626 - RNA, 23 nt, Artificial Sequence
  Oligomer
gcacuucacagaaguuccaguua

SEQ ID NO: 71627 - RNA, 23 nt, Artificial Sequence
  Oligomer
agcacuucacagaaguuccaguu

SEQ ID NO: 71628 - RNA, 23 nt, Artificial Sequence
  Oligomer
cagcacuucacagaaguuccagu

SEQ ID NO: 71629 - RNA, 23 nt, Artificial Sequence
  Oligomer
gcagcacuucacagaaguuccag

SEQ ID NO: 71630 - RNA, 23 nt, Artificial Sequence
  Oligomer
agcagcacuucacagaaguucca

SEQ ID NO: 71631 - RNA, 23 nt, Artificial Sequence
  Oligomer
cagccaccaugacaaucagucug

SEQ ID NO: 71632 - RNA, 23 nt, Artificial Sequence
  Oligomer
acagccaccaugacaaucagucu

SEQ ID NO: 71633 - RNA, 23 nt, Artificial Sequence
  Oligomer
gacagccaccaugacaaucaguc

SEQ ID NO: 71634 - RNA, 23 nt, Artificial Sequence
  Oligomer
aaaggcuaaaagaaauagcugag

SEQ ID NO: 71635 - RNA, 23 nt, Artificial Sequence
  Oligomer
aaaaggcuaaaagaaauagcuga

SEQ ID NO: 71636 - RNA, 23 nt, Artificial Sequence
  Oligomer
cugaaacuuccacacagaauuuu

SEQ ID NO: 71637 - RNA, 23 nt, Artificial Sequence
  Oligomer
aaugaugaugagcugcccaugaa

SEQ ID NO: 71638 - RNA, 23 nt, Artificial Sequence
  Oligomer
gaaugaugaugagcugcccauga

SEQ ID NO: 71639 - RNA, 23 nt, Artificial Sequence
  Oligomer
cuacacucagugcucccaauuuc

SEQ ID NO: 71640 - RNA, 23 nt, Artificial Sequence
  Oligomer
gcuacacucagugcucccaauuu

SEQ ID NO: 71641 - RNA, 23 nt, Artificial Sequence
  Oligomer
ggcuacacucagugcucccaauu

SEQ ID NO: 71642 - RNA, 23 nt, Artificial Sequence
  Oligomer
aggcuacacucagugcucccaau

SEQ ID NO: 71643 - RNA, 23 nt, Artificial Sequence
  Oligomer
aaggcuacacucagugcucccaa

SEQ ID NO: 71644 - RNA, 23 nt, Artificial Sequence
  Oligomer
uugauguucuucaacgauuugga

SEQ ID NO: 71645 - RNA, 23 nt, Artificial Sequence
  Oligomer
uuugauguucuucaacgauuugg

SEQ ID NO: 71646 - RNA, 23 nt, Artificial Sequence
  Oligomer
caguugcggauaaugagcgaaug

SEQ ID NO: 71647 - RNA, 23 nt, Artificial Sequence
  Oligomer
ccaguugcggauaaugagcgaau

SEQ ID NO: 71648 - RNA, 23 nt, Artificial Sequence
  Oligomer
uccaguugcggauaaugagcgaa

SEQ ID NO: 71649 - RNA, 23 nt, Artificial Sequence
  Oligomer
guccaguugcggauaaugagcga

SEQ ID NO: 71650 - RNA, 23 nt, Artificial Sequence
  Oligomer
cagcaggcgccaggaaaaaacuu

SEQ ID NO: 71651 - RNA, 23 nt, Artificial Sequence
  Oligomer
acagcaggcgccaggaaaaaacu

SEQ ID NO: 71652 - RNA, 23 nt, Artificial Sequence
  Oligomer
auaucgaagaaaggagaacggug

SEQ ID NO: 71653 - RNA, 23 nt, Artificial Sequence
  Oligomer
cacucagugcucccaauuucuuu

SEQ ID NO: 71654 - RNA, 23 nt, Artificial Sequence
  Oligomer
aaaugcugcugauagugauggau

SEQ ID NO: 71655 - RNA, 23 nt, Artificial Sequence
  Oligomer
uaaaugcugcugauagugaugga

SEQ ID NO: 71656 - RNA, 23 nt, Artificial Sequence
  Oligomer
guaaaugcugcugauagugaugg

SEQ ID NO: 71657 - RNA, 23 nt, Artificial Sequence
  Oligomer
agaauuugaccuuguacagagaa

SEQ ID NO: 71658 - RNA, 23 nt, Artificial Sequence
  Oligomer
gcucagagcguaucgcucaugga

SEQ ID NO: 71659 - RNA, 23 nt, Artificial Sequence
  Oligomer
ggcucagagcguaucgcucaugg

SEQ ID NO: 71660 - RNA, 23 nt, Artificial Sequence
  Oligomer
uggcucagagcguaucgcucaug

SEQ ID NO: 71661 - RNA, 23 nt, Artificial Sequence
  Oligomer
cuggcucagagcguaucgcucau

SEQ ID NO: 71662 - RNA, 23 nt, Artificial Sequence
  Oligomer
aaucuccagaauaacccagaaga

SEQ ID NO: 71663 - RNA, 23 nt, Artificial Sequence
  Oligomer
aaaucuccagaauaacccagaag

SEQ ID NO: 71664 - RNA, 23 nt, Artificial Sequence
  Oligomer
caaaucuccagaauaacccagaa

SEQ ID NO: 71665 - RNA, 23 nt, Artificial Sequence
  Oligomer
auauuuacauguggagcccgaaa

SEQ ID NO: 71666 - RNA, 23 nt, Artificial Sequence
  Oligomer
auaucagaggaccaccauagcgg

SEQ ID NO: 71667 - RNA, 23 nt, Artificial Sequence
  Oligomer
uauaucagaggaccaccauagcg

SEQ ID NO: 71668 - RNA, 23 nt, Artificial Sequence
  Oligomer
uuauaucagaggaccaccauagc

SEQ ID NO: 71669 - RNA, 23 nt, Artificial Sequence
  Oligomer
uuuauaucagaggaccaccauag

SEQ ID NO: 71670 - RNA, 23 nt, Artificial Sequence
  Oligomer
uuuuauaucagaggaccaccaua

SEQ ID NO: 71671 - RNA, 23 nt, Artificial Sequence
  Oligomer
gcugacuuggauggguaugaugg

SEQ ID NO: 71672 - RNA, 23 nt, Artificial Sequence
  Oligomer
aggcuucuaggucagcaucacuc

SEQ ID NO: 71673 - RNA, 23 nt, Artificial Sequence
  Oligomer
ggcuucuaggucagcaucacucu

SEQ ID NO: 71674 - RNA, 23 nt, Artificial Sequence
  Oligomer
gcuucuaggucagcaucacucug

SEQ ID NO: 71675 - RNA, 23 nt, Artificial Sequence
  Oligomer
cuucuaggucagcaucacucugg

SEQ ID NO: 71676 - RNA, 23 nt, Artificial Sequence
  Oligomer
uucuaggucagcaucacucuggu

SEQ ID NO: 71677 - RNA, 23 nt, Artificial Sequence
  Oligomer
aaguuauuguucacugacaacca

SEQ ID NO: 71678 - RNA, 23 nt, Artificial Sequence
  Oligomer
aguuauuguucacugacaaccaa

SEQ ID NO: 71679 - RNA, 23 nt, Artificial Sequence
  Oligomer
guuauuguucacugacaaccaac

SEQ ID NO: 71680 - RNA, 23 nt, Artificial Sequence
  Oligomer
uuauuguucacugacaaccaacu

SEQ ID NO: 71681 - RNA, 23 nt, Artificial Sequence
  Oligomer
augauugucaugcagucuccuuc

SEQ ID NO: 71682 - RNA, 23 nt, Artificial Sequence
  Oligomer
ugauugucaugcagucuccuucu

SEQ ID NO: 71683 - RNA, 23 nt, Artificial Sequence
  Oligomer
gauugucaugcagucuccuucuu

SEQ ID NO: 71684 - RNA, 23 nt, Artificial Sequence
  Oligomer
auugucaugcagucuccuucuuu

SEQ ID NO: 71685 - RNA, 23 nt, Artificial Sequence
  Oligomer
uugucaugcagucuccuucuuuc

SEQ ID NO: 71686 - RNA, 23 nt, Artificial Sequence
  Oligomer
uaauucuuggguacagucccagc

SEQ ID NO: 71687 - RNA, 23 nt, Artificial Sequence
  Oligomer
gcuccuuugucuugguuuaauuc

SEQ ID NO: 71688 - RNA, 23 nt, Artificial Sequence
  Oligomer
cuccuuugucuugguuuaauucu

SEQ ID NO: 71689 - RNA, 23 nt, Artificial Sequence
  Oligomer
uccuuugucuugguuuaauucuu

SEQ ID NO: 71690 - RNA, 23 nt, Artificial Sequence
  Oligomer
ccauucgauuucaucuucgucuu

SEQ ID NO: 71691 - RNA, 23 nt, Artificial Sequence
  Oligomer
cauucgauuucaucuucgucuuc

SEQ ID NO: 71692 - RNA, 23 nt, Artificial Sequence
  Oligomer
auucgauuucaucuucgucuucc

SEQ ID NO: 71693 - RNA, 23 nt, Artificial Sequence
  Oligomer
cauuucuuuuuaaacuuggaucc

SEQ ID NO: 71694 - RNA, 23 nt, Artificial Sequence
  Oligomer
auuucuuuuuaaacuuggauccu

SEQ ID NO: 71695 - RNA, 23 nt, Artificial Sequence
  Oligomer
uuucuuuuuaaacuuggauccug

SEQ ID NO: 71696 - RNA, 23 nt, Artificial Sequence
  Oligomer
gguuuugguuuaguucccaugga

SEQ ID NO: 71697 - RNA, 23 nt, Artificial Sequence
  Oligomer
guuuugguuuaguucccauggac

SEQ ID NO: 71698 - RNA, 23 nt, Artificial Sequence
  Oligomer
uuuugguuuaguucccauggacg

SEQ ID NO: 71699 - RNA, 23 nt, Artificial Sequence
  Oligomer
uuugguuuaguucccauggacgg

SEQ ID NO: 71700 - RNA, 23 nt, Artificial Sequence
  Oligomer
gagaucuugguccacucacaaug

SEQ ID NO: 71701 - RNA, 23 nt, Artificial Sequence
  Oligomer
agaucuugguccacucacaaugu

SEQ ID NO: 71702 - RNA, 23 nt, Artificial Sequence
  Oligomer
uuuacuagacaggauucuuguag

SEQ ID NO: 71703 - RNA, 23 nt, Artificial Sequence
  Oligomer
uuacuagacaggauucuuguaga

SEQ ID NO: 71704 - RNA, 23 nt, Artificial Sequence
  Oligomer
gggguuuucugaaggguggaagu

SEQ ID NO: 71705 - RNA, 23 nt, Artificial Sequence
  Oligomer
ggguuuucugaaggguggaagua

SEQ ID NO: 71706 - RNA, 23 nt, Artificial Sequence
  Oligomer
gguuuucugaaggguggaaguaa

SEQ ID NO: 71707 - RNA, 23 nt, Artificial Sequence
  Oligomer
guuuucugaaggguggaaguaag

SEQ ID NO: 71708 - RNA, 23 nt, Artificial Sequence
  Oligomer
uuuucugaaggguggaaguaagg

SEQ ID NO: 71709 - RNA, 23 nt, Artificial Sequence
  Oligomer
cuguucaauuuccuccacaaguu

SEQ ID NO: 71710 - RNA, 23 nt, Artificial Sequence
  Oligomer
uguucaauuuccuccacaaguuu

SEQ ID NO: 71711 - RNA, 23 nt, Artificial Sequence
  Oligomer
guucaauuuccuccacaaguuuc

SEQ ID NO: 71712 - RNA, 23 nt, Artificial Sequence
  Oligomer
uucaauuuccuccacaaguuucc

SEQ ID NO: 71713 - RNA, 23 nt, Artificial Sequence
  Oligomer
uuucugaaggguggaaguaaggu

SEQ ID NO: 71714 - RNA, 23 nt, Artificial Sequence
  Oligomer
cggcuuugucucuucgacgcucg

SEQ ID NO: 71715 - RNA, 23 nt, Artificial Sequence
  Oligomer
ggcuuugucucuucgacgcucgu

SEQ ID NO: 71716 - RNA, 23 nt, Artificial Sequence
  Oligomer
gcuuugucucuucgacgcucgug

SEQ ID NO: 71717 - RNA, 23 nt, Artificial Sequence
  Oligomer
cuuugucucuucgacgcucguga

SEQ ID NO: 71718 - RNA, 23 nt, Artificial Sequence
  Oligomer
uuugucucuucgacgcucgugac

SEQ ID NO: 71719 - RNA, 23 nt, Artificial Sequence
  Oligomer
uucuucgauauucaccaggaacu

SEQ ID NO: 71720 - RNA, 23 nt, Artificial Sequence
  Oligomer
gacauucuucaucgcuuucaagc

SEQ ID NO: 71721 - RNA, 23 nt, Artificial Sequence
  Oligomer
acauucuucaucgcuuucaagcu

SEQ ID NO: 71722 - RNA, 23 nt, Artificial Sequence
  Oligomer
cauucuucaucgcuuucaagcua

SEQ ID NO: 71723 - RNA, 23 nt, Artificial Sequence
  Oligomer
auucuucaucgcuuucaagcuac

SEQ ID NO: 71724 - RNA, 23 nt, Artificial Sequence
  Oligomer
uucuucaucgcuuucaagcuaca

SEQ ID NO: 71725 - RNA, 23 nt, Artificial Sequence
  Oligomer
gcuguagagcugccuucuucuuc

SEQ ID NO: 71726 - RNA, 23 nt, Artificial Sequence
  Oligomer
uucuuucaugggcagcucaucau

SEQ ID NO: 71727 - RNA, 23 nt, Artificial Sequence
  Oligomer
ucuuucaugggcagcucaucauc

SEQ ID NO: 71728 - RNA, 23 nt, Artificial Sequence
  Oligomer
cuuucaugggcagcucaucauca

SEQ ID NO: 71729 - RNA, 23 nt, Artificial Sequence
  Oligomer
uuucaugggcagcucaucaucau

SEQ ID NO: 71730 - RNA, 23 nt, Artificial Sequence
  Oligomer
uacauuuacaccaaacuguacca

SEQ ID NO: 71731 - RNA, 23 nt, Artificial Sequence
  Oligomer
acauuuacaccaaacuguaccag

SEQ ID NO: 71732 - RNA, 23 nt, Artificial Sequence
  Oligomer
cauuuacaccaaacuguaccagg

SEQ ID NO: 71733 - RNA, 23 nt, Artificial Sequence
  Oligomer
auuuacaccaaacuguaccagga

SEQ ID NO: 71734 - RNA, 23 nt, Artificial Sequence
  Oligomer
cuauuggaauaaauguucucugg

SEQ ID NO: 71735 - RNA, 23 nt, Artificial Sequence
  Oligomer
uauuggaauaaauguucucuggg

SEQ ID NO: 71736 - RNA, 23 nt, Artificial Sequence
  Oligomer
ucuccaucaucaacuugauccag

SEQ ID NO: 71737 - RNA, 23 nt, Artificial Sequence
  Oligomer
cuccaucaucaacuugauccaga

SEQ ID NO: 71738 - RNA, 23 nt, Artificial Sequence
  Oligomer
uccaucaucaacuugauccagag

SEQ ID NO: 71739 - RNA, 23 nt, Artificial Sequence
  Oligomer
uguuuuuaaagucagcuaugauc

SEQ ID NO: 71740 - RNA, 23 nt, Artificial Sequence
  Oligomer
guuuuuaaagucagcuaugaucu

SEQ ID NO: 71741 - RNA, 23 nt, Artificial Sequence
  Oligomer
uuuuuaaagucagcuaugaucuu

SEQ ID NO: 71742 - RNA, 23 nt, Artificial Sequence
  Oligomer
uuuuaaagucagcuaugaucuug

SEQ ID NO: 71743 - RNA, 23 nt, Artificial Sequence
  Oligomer
uuuaaagucagcuaugaucuuga

SEQ ID NO: 71744 - RNA, 23 nt, Artificial Sequence
  Oligomer
cggguaagucuguagcaaguuuc

SEQ ID NO: 71745 - RNA, 23 nt, Artificial Sequence
  Oligomer
gagguacagaagcagagccuugg

SEQ ID NO: 71746 - RNA, 23 nt, Artificial Sequence
  Oligomer
agguacagaagcagagccuuggc

SEQ ID NO: 71747 - RNA, 23 nt, Artificial Sequence
  Oligomer
gguacagaagcagagccuuggcu

SEQ ID NO: 71748 - RNA, 23 nt, Artificial Sequence
  Oligomer
guacagaagcagagccuuggcuu

SEQ ID NO: 71749 - RNA, 23 nt, Artificial Sequence
  Oligomer
uacagaagcagagccuuggcuug

SEQ ID NO: 71750 - RNA, 23 nt, Artificial Sequence
  Oligomer
uuaaagucagcuaugaucuugac

SEQ ID NO: 71751 - RNA, 23 nt, Artificial Sequence
  Oligomer
cucuucuagagacauucuucauc

SEQ ID NO: 71752 - RNA, 23 nt, Artificial Sequence
  Oligomer
ucuucuagagacauucuucaucg

SEQ ID NO: 71753 - RNA, 23 nt, Artificial Sequence
  Oligomer
cuucuagagacauucuucaucgc

SEQ ID NO: 71754 - RNA, 23 nt, Artificial Sequence
  Oligomer
uucuagagacauucuucaucgcu

SEQ ID NO: 71755 - RNA, 23 nt, Artificial Sequence
  Oligomer
ucuagagacauucuucaucgcuu

SEQ ID NO: 71756 - RNA, 23 nt, Artificial Sequence
  Oligomer
uuuacgcaaguuuguccuuuuac

SEQ ID NO: 71757 - RNA, 23 nt, Artificial Sequence
  Oligomer
uuacgcaaguuuguccuuuuacc

SEQ ID NO: 71758 - RNA, 23 nt, Artificial Sequence
  Oligomer
uggauuuuagagccuuuaguuug

SEQ ID NO: 71759 - RNA, 23 nt, Artificial Sequence
  Oligomer
ggauuuuagagccuuuaguuugu

SEQ ID NO: 71760 - RNA, 23 nt, Artificial Sequence
  Oligomer
gauuuuagagccuuuaguuugug

SEQ ID NO: 71761 - RNA, 23 nt, Artificial Sequence
  Oligomer
auuuuagagccuuuaguuuguga

SEQ ID NO: 71762 - RNA, 23 nt, Artificial Sequence
  Oligomer
uuuuagagccuuuaguuugugaa

SEQ ID NO: 71763 - RNA, 23 nt, Artificial Sequence
  Oligomer
guucuugagcaucucuagcugcc

SEQ ID NO: 71764 - RNA, 23 nt, Artificial Sequence
  Oligomer
uucuugagcaucucuagcugccu

SEQ ID NO: 71765 - RNA, 23 nt, Artificial Sequence
  Oligomer
ucuugagcaucucuagcugccug

SEQ ID NO: 71766 - RNA, 23 nt, Artificial Sequence
  Oligomer
cuugagcaucucuagcugccugg

SEQ ID NO: 71767 - RNA, 23 nt, Artificial Sequence
  Oligomer
uugagcaucucuagcugccuggu

SEQ ID NO: 71768 - RNA, 23 nt, Artificial Sequence
  Oligomer
acaguucuucacugacaauauac

SEQ ID NO: 71769 - RNA, 23 nt, Artificial Sequence
  Oligomer
caguucuucacugacaauauaca

SEQ ID NO: 71770 - RNA, 23 nt, Artificial Sequence
  Oligomer
aguucuucacugacaauauacaa

SEQ ID NO: 71771 - RNA, 23 nt, Artificial Sequence
  Oligomer
auacuuaucugagugcuacacgg

SEQ ID NO: 71772 - RNA, 23 nt, Artificial Sequence
  Oligomer
uacuuaucugagugcuacacggg

SEQ ID NO: 71773 - RNA, 23 nt, Artificial Sequence
  Oligomer
acuuaucugagugcuacacggga

SEQ ID NO: 71774 - RNA, 23 nt, Artificial Sequence
  Oligomer
cuuaucugagugcuacacgggac

SEQ ID NO: 71775 - RNA, 23 nt, Artificial Sequence
  Oligomer
uuaucugagugcuacacgggaca

SEQ ID NO: 71776 - RNA, 23 nt, Artificial Sequence
  Oligomer
uugguucuucuggguuauucugg

SEQ ID NO: 71777 - RNA, 23 nt, Artificial Sequence
  Oligomer
ugguucuucuggguuauucugga

SEQ ID NO: 71778 - RNA, 23 nt, Artificial Sequence
  Oligomer
gguucuucuggguuauucuggag

SEQ ID NO: 71779 - RNA, 23 nt, Artificial Sequence
  Oligomer
guucuucuggguuauucuggaga

SEQ ID NO: 71780 - RNA, 23 nt, Artificial Sequence
  Oligomer
uucuucuggguuauucuggagau

SEQ ID NO: 71781 - RNA, 23 nt, Artificial Sequence
  Oligomer
uuuauuugcaaccugagcauccc

SEQ ID NO: 71782 - RNA, 23 nt, Artificial Sequence
  Oligomer
aaacuuggauccugagaucuugg

SEQ ID NO: 71783 - RNA, 23 nt, Artificial Sequence
  Oligomer
aacuuggauccugagaucuuggu

SEQ ID NO: 71784 - RNA, 23 nt, Artificial Sequence
  Oligomer
acuuggauccugagaucuugguc

SEQ ID NO: 71785 - RNA, 23 nt, Artificial Sequence
  Oligomer
cuuggauccugagaucuuggucc

SEQ ID NO: 71786 - RNA, 23 nt, Artificial Sequence
  Oligomer
uuggauccugagaucuuggucca

SEQ ID NO: 71787 - RNA, 23 nt, Artificial Sequence
  Oligomer
uuguuacaugaggcagcacaaug

SEQ ID NO: 71788 - RNA, 23 nt, Artificial Sequence
  Oligomer
uguuacaugaggcagcacaaugu

SEQ ID NO: 71789 - RNA, 23 nt, Artificial Sequence
  Oligomer
guuacaugaggcagcacaaugua

SEQ ID NO: 71790 - RNA, 23 nt, Artificial Sequence
  Oligomer
uuacaugaggcagcacaauguaa

SEQ ID NO: 71791 - RNA, 23 nt, Artificial Sequence
  Oligomer
uacaugaggcagcacaauguaau

SEQ ID NO: 71792 - RNA, 23 nt, Artificial Sequence
  Oligomer
caucaaacauucgcucauuaucc

SEQ ID NO: 71793 - RNA, 23 nt, Artificial Sequence
  Oligomer
aggacuauuaacaccguucuccu

SEQ ID NO: 71794 - RNA, 23 nt, Artificial Sequence
  Oligomer
ggacuauuaacaccguucuccuu

SEQ ID NO: 71795 - RNA, 23 nt, Artificial Sequence
  Oligomer
gacuauuaacaccguucuccuuu

SEQ ID NO: 71796 - RNA, 23 nt, Artificial Sequence
  Oligomer
acuauuaacaccguucuccuuuc

SEQ ID NO: 71797 - RNA, 23 nt, Artificial Sequence
  Oligomer
ucuucgauauucaccaggaacuu

SEQ ID NO: 71798 - RNA, 23 nt, Artificial Sequence
  Oligomer
cuucgauauucaccaggaacuuu

SEQ ID NO: 71799 - RNA, 23 nt, Artificial Sequence
  Oligomer
uucgauauucaccaggaacuuuu

SEQ ID NO: 71800 - RNA, 23 nt, Artificial Sequence
  Oligomer
auucucuucuagagacauucuuc

SEQ ID NO: 71801 - RNA, 23 nt, Artificial Sequence
  Oligomer
uucucuucuagagacauucuuca

SEQ ID NO: 71802 - RNA, 23 nt, Artificial Sequence
  Oligomer
ucucuucuagagacauucuucau

SEQ ID NO: 71803 - RNA, 23 nt, Artificial Sequence
  Oligomer
uucaucgcuuucaagcuacauug

SEQ ID NO: 71804 - RNA, 23 nt, Artificial Sequence
  Oligomer
ucaucgcuuucaagcuacauugu

SEQ ID NO: 71805 - RNA, 23 nt, Artificial Sequence
  Oligomer
caucgcuuucaagcuacauuguc

SEQ ID NO: 71806 - RNA, 23 nt, Artificial Sequence
  Oligomer
aagcugacuuggauggguaugau

SEQ ID NO: 71807 - RNA, 23 nt, Artificial Sequence
  Oligomer
agcugacuuggauggguaugaug

SEQ ID NO: 71808 - RNA, 23 nt, Artificial Sequence
  Oligomer
ugggguuuucugaaggguggaag

SEQ ID NO: 71809 - RNA, 23 nt, Artificial Sequence
  Oligomer
agguaugcugggagauagcagca

SEQ ID NO: 71810 - RNA, 23 nt, Artificial Sequence
  Oligomer
gguaugcugggagauagcagcac

SEQ ID NO: 71811 - RNA, 23 nt, Artificial Sequence
  Oligomer
guaugcugggagauagcagcacu

SEQ ID NO: 71812 - RNA, 23 nt, Artificial Sequence
  Oligomer
uaugcugggagauagcagcacuc

SEQ ID NO: 71813 - RNA, 23 nt, Artificial Sequence
  Oligomer
aagaaacaucggcaucaucuugg

SEQ ID NO: 71814 - RNA, 23 nt, Artificial Sequence
  Oligomer
agaaacaucggcaucaucuugga

SEQ ID NO: 71815 - RNA, 23 nt, Artificial Sequence
  Oligomer
gaaacaucggcaucaucuuggac

SEQ ID NO: 71816 - RNA, 23 nt, Artificial Sequence
  Oligomer
uuauuugcaaccugagcaucccg

SEQ ID NO: 71817 - RNA, 23 nt, Artificial Sequence
  Oligomer
uauuugcaaccugagcaucccgc

SEQ ID NO: 71818 - RNA, 23 nt, Artificial Sequence
  Oligomer
auuugcaaccugagcaucccgca

SEQ ID NO: 71819 - RNA, 23 nt, Artificial Sequence
  Oligomer
uuuugcuguagagcugccuucuu

SEQ ID NO: 71820 - RNA, 23 nt, Artificial Sequence
  Oligomer
uuugcuguagagcugccuucuuc

SEQ ID NO: 71821 - RNA, 23 nt, Artificial Sequence
  Oligomer
uugcuguagagcugccuucuucu

SEQ ID NO: 71822 - RNA, 23 nt, Artificial Sequence
  Oligomer
uucuuaagaugcuacaaaaacuc

SEQ ID NO: 71823 - RNA, 23 nt, Artificial Sequence
  Oligomer
ucuuaagaugcuacaaaaacuca

SEQ ID NO: 71824 - RNA, 23 nt, Artificial Sequence
  Oligomer
cuuaagaugcuacaaaaacucau

SEQ ID NO: 71825 - RNA, 23 nt, Artificial Sequence
  Oligomer
uuaagaugcuacaaaaacucaua

SEQ ID NO: 71826 - RNA, 23 nt, Artificial Sequence
  Oligomer
uaagaugcuacaaaaacucauau

SEQ ID NO: 71827 - RNA, 23 nt, Artificial Sequence
  Oligomer
uucauucucuucuagagacauuc

SEQ ID NO: 71828 - RNA, 23 nt, Artificial Sequence
  Oligomer
ucauucucuucuagagacauucu

SEQ ID NO: 71829 - RNA, 23 nt, Artificial Sequence
  Oligomer
cauucucuucuagagacauucuu

SEQ ID NO: 71830 - RNA, 23 nt, Artificial Sequence
  Oligomer
uucaggccaagcuccuuugucuu

SEQ ID NO: 71831 - RNA, 23 nt, Artificial Sequence
  Oligomer
aauucuuggguacagucccagca

SEQ ID NO: 71832 - RNA, 23 nt, Artificial Sequence
  Oligomer
guggaugauugucaugcagucuc

SEQ ID NO: 71833 - RNA, 23 nt, Artificial Sequence
  Oligomer
uggaugauugucaugcagucucc

SEQ ID NO: 71834 - RNA, 23 nt, Artificial Sequence
  Oligomer
ggaugauugucaugcagucuccu

SEQ ID NO: 71835 - RNA, 23 nt, Artificial Sequence
  Oligomer
gaugauugucaugcagucuccuu

SEQ ID NO: 71836 - RNA, 23 nt, Artificial Sequence
  Oligomer
gagguucauaaucccaaagcgca

SEQ ID NO: 71837 - RNA, 23 nt, Artificial Sequence
  Oligomer
agguucauaaucccaaagcgcau

SEQ ID NO: 71838 - RNA, 23 nt, Artificial Sequence
  Oligomer
gguucauaaucccaaagcgcaua

SEQ ID NO: 71839 - RNA, 23 nt, Artificial Sequence
  Oligomer
agauuaaaauucagccuacaaac

SEQ ID NO: 71840 - RNA, 23 nt, Artificial Sequence
  Oligomer
gauuaaaauucagccuacaaaca

SEQ ID NO: 71841 - RNA, 23 nt, Artificial Sequence
  Oligomer
auuaaaauucagccuacaaacaa

SEQ ID NO: 71842 - RNA, 23 nt, Artificial Sequence
  Oligomer
cuccuuaucauuaaggcgcgccc

SEQ ID NO: 71843 - RNA, 23 nt, Artificial Sequence
  Oligomer
uccuuaucauuaaggcgcgccca

SEQ ID NO: 71844 - RNA, 23 nt, Artificial Sequence
  Oligomer
ccuuaucauuaaggcgcgcccac

SEQ ID NO: 71845 - RNA, 23 nt, Artificial Sequence
  Oligomer
cuuaucauuaaggcgcgcccacc

SEQ ID NO: 71846 - RNA, 23 nt, Artificial Sequence
  Oligomer
uuaucauuaaggcgcgcccacca

SEQ ID NO: 71847 - RNA, 23 nt, Artificial Sequence
  Oligomer
uuuccucgcacuuaucugcagca

SEQ ID NO: 71848 - RNA, 23 nt, Artificial Sequence
  Oligomer
gauucaggaaccagagagaccac

SEQ ID NO: 71849 - RNA, 23 nt, Artificial Sequence
  Oligomer
auucaggaaccagagagaccacc

SEQ ID NO: 71850 - RNA, 23 nt, Artificial Sequence
  Oligomer
uucaggaaccagagagaccaccu

SEQ ID NO: 71851 - RNA, 23 nt, Artificial Sequence
  Oligomer
guaauuuaguugggcugaguggc

SEQ ID NO: 71852 - RNA, 23 nt, Artificial Sequence
  Oligomer
uaauuuaguugggcugaguggcc

SEQ ID NO: 71853 - RNA, 23 nt, Artificial Sequence
  Oligomer
aauuuaguugggcugaguggccg

SEQ ID NO: 71854 - RNA, 23 nt, Artificial Sequence
  Oligomer
auuuaguugggcugaguggccga

SEQ ID NO: 71855 - RNA, 23 nt, Artificial Sequence
  Oligomer
uuuaguugggcugaguggccgag

SEQ ID NO: 71856 - RNA, 23 nt, Artificial Sequence
  Oligomer
ggacuuucuugcuuagaaccugg

SEQ ID NO: 71857 - RNA, 23 nt, Artificial Sequence
  Oligomer
gacuuucuugcuuagaaccugga

SEQ ID NO: 71858 - RNA, 23 nt, Artificial Sequence
  Oligomer
acuuucuugcuuagaaccuggag

SEQ ID NO: 71859 - RNA, 23 nt, Artificial Sequence
  Oligomer
cuuucuugcuuagaaccuggaga

SEQ ID NO: 71860 - RNA, 23 nt, Artificial Sequence
  Oligomer
uggauauagggaccuacugcagc

SEQ ID NO: 71861 - RNA, 23 nt, Artificial Sequence
  Oligomer
ggauauagggaccuacugcagcc

SEQ ID NO: 71862 - RNA, 23 nt, Artificial Sequence
  Oligomer
gauauagggaccuacugcagcca

SEQ ID NO: 71863 - RNA, 23 nt, Artificial Sequence
  Oligomer
auauagggaccuacugcagccac

SEQ ID NO: 71864 - RNA, 23 nt, Artificial Sequence
  Oligomer
uauagggaccuacugcagccaca

SEQ ID NO: 71865 - RNA, 23 nt, Artificial Sequence
  Oligomer
guuguagcuuggcauucugcucu

SEQ ID NO: 71866 - RNA, 23 nt, Artificial Sequence
  Oligomer
uuguagcuuggcauucugcucuu

SEQ ID NO: 71867 - RNA, 23 nt, Artificial Sequence
  Oligomer
uguagcuuggcauucugcucuug

SEQ ID NO: 71868 - RNA, 23 nt, Artificial Sequence
  Oligomer
guagcuuggcauucugcucuuga

SEQ ID NO: 71869 - RNA, 23 nt, Artificial Sequence
  Oligomer
uagcuuggcauucugcucuugau

SEQ ID NO: 71870 - RNA, 23 nt, Artificial Sequence
  Oligomer
cucuucuguuccacguggccuuu

SEQ ID NO: 71871 - RNA, 23 nt, Artificial Sequence
  Oligomer
ucuucuguuccacguggccuuua

SEQ ID NO: 71872 - RNA, 23 nt, Artificial Sequence
  Oligomer
cuucuguuccacguggccuuuaa

SEQ ID NO: 71873 - RNA, 23 nt, Artificial Sequence
  Oligomer
uucuguuccacguggccuuuaag

SEQ ID NO: 71874 - RNA, 23 nt, Artificial Sequence
  Oligomer
cuuguugcuguugucgcugaucu

SEQ ID NO: 71875 - RNA, 23 nt, Artificial Sequence
  Oligomer
uuguugcuguugucgcugaucuu

SEQ ID NO: 71876 - RNA, 23 nt, Artificial Sequence
  Oligomer
uguugcuguugucgcugaucuug

SEQ ID NO: 71877 - RNA, 23 nt, Artificial Sequence
  Oligomer
guugcuguugucgcugaucuugu

SEQ ID NO: 71878 - RNA, 23 nt, Artificial Sequence
  Oligomer
uugcuguugucgcugaucuuguu

SEQ ID NO: 71879 - RNA, 23 nt, Artificial Sequence
  Oligomer
acuuaucugcagcagucugcaug

SEQ ID NO: 71880 - RNA, 23 nt, Artificial Sequence
  Oligomer
cuuaucugcagcagucugcaugu

SEQ ID NO: 71881 - RNA, 23 nt, Artificial Sequence
  Oligomer
uuaucugcagcagucugcauguc

SEQ ID NO: 71882 - RNA, 23 nt, Artificial Sequence
  Oligomer
uaucugcagcagucugcauguca

SEQ ID NO: 71883 - RNA, 23 nt, Artificial Sequence
  Oligomer
aucugcagcagucugcaugucac

SEQ ID NO: 71884 - RNA, 23 nt, Artificial Sequence
  Oligomer
ucuguuccacguggccuuuaagu

SEQ ID NO: 71885 - RNA, 23 nt, Artificial Sequence
  Oligomer
cuguuccacguggccuuuaagug

SEQ ID NO: 71886 - RNA, 23 nt, Artificial Sequence
  Oligomer
uguuccacguggccuuuaagugc

SEQ ID NO: 71887 - RNA, 23 nt, Artificial Sequence
  Oligomer
guuccacguggccuuuaagugcu

SEQ ID NO: 71888 - RNA, 23 nt, Artificial Sequence
  Oligomer
uuccacguggccuuuaagugcuc

SEQ ID NO: 71889 - RNA, 23 nt, Artificial Sequence
  Oligomer
ggccuuuaagugcucucacuuuu

SEQ ID NO: 71890 - RNA, 23 nt, Artificial Sequence
  Oligomer
gccuuuaagugcucucacuuuuu

SEQ ID NO: 71891 - RNA, 23 nt, Artificial Sequence
  Oligomer
ccuuuaagugcucucacuuuuuu

SEQ ID NO: 71892 - RNA, 23 nt, Artificial Sequence
  Oligomer
cuuuaagugcucucacuuuuuuu

SEQ ID NO: 71893 - RNA, 23 nt, Artificial Sequence
  Oligomer
uuuaagugcucucacuuuuuuua

SEQ ID NO: 71894 - RNA, 23 nt, Artificial Sequence
  Oligomer
ucuguuucagguucuggacugcc

SEQ ID NO: 71895 - RNA, 23 nt, Artificial Sequence
  Oligomer
cuguuucagguucuggacugcca

SEQ ID NO: 71896 - RNA, 23 nt, Artificial Sequence
  Oligomer
uguuucagguucuggacugccag

SEQ ID NO: 71897 - RNA, 23 nt, Artificial Sequence
  Oligomer
guuucagguucuggacugccagg

SEQ ID NO: 71898 - RNA, 23 nt, Artificial Sequence
  Oligomer
uuucagguucuggacugccaggc

SEQ ID NO: 71899 - RNA, 23 nt, Artificial Sequence
  Oligomer
ugcuguagagcugccuucuucuu

SEQ ID NO: 71900 - RNA, 23 nt, Artificial Sequence
  Oligomer
uuguuucuuagcugcagcuccuu

SEQ ID NO: 71901 - RNA, 23 nt, Artificial Sequence
  Oligomer
uguuucuuagcugcagcuccuua

SEQ ID NO: 71902 - RNA, 23 nt, Artificial Sequence
  Oligomer
guuucuuagcugcagcuccuuau

SEQ ID NO: 71903 - RNA, 23 nt, Artificial Sequence
  Oligomer
uuucuuagcugcagcuccuuaua

SEQ ID NO: 71904 - RNA, 23 nt, Artificial Sequence
  Oligomer
cggcaucaucuuggacccgaacc

SEQ ID NO: 71905 - RNA, 23 nt, Artificial Sequence
  Oligomer
ggcaucaucuuggacccgaaccg

SEQ ID NO: 71906 - RNA, 23 nt, Artificial Sequence
  Oligomer
gcaucaucuuggacccgaaccgc

SEQ ID NO: 71907 - RNA, 23 nt, Artificial Sequence
  Oligomer
caucaucuuggacccgaaccgca

SEQ ID NO: 71908 - RNA, 23 nt, Artificial Sequence
  Oligomer
aucaucuuggacccgaaccgcau

SEQ ID NO: 71909 - RNA, 23 nt, Artificial Sequence
  Oligomer
uacacgguaagaaacaucggcau

SEQ ID NO: 71910 - RNA, 23 nt, Artificial Sequence
  Oligomer
ucuucgucuucccuguggaugau

SEQ ID NO: 71911 - RNA, 23 nt, Artificial Sequence
  Oligomer
cuucgucuucccuguggaugauu

SEQ ID NO: 71912 - RNA, 23 nt, Artificial Sequence
  Oligomer
uucgucuucccuguggaugauug

SEQ ID NO: 71913 - RNA, 23 nt, Artificial Sequence
  Oligomer
ugguccacucacaaugucccugc

SEQ ID NO: 71914 - RNA, 23 nt, Artificial Sequence
  Oligomer
agcauugugaagagccgugaugc

SEQ ID NO: 71915 - RNA, 23 nt, Artificial Sequence
  Oligomer
gcauugugaagagccgugaugcc

SEQ ID NO: 71916 - RNA, 23 nt, Artificial Sequence
  Oligomer
cauugugaagagccgugaugccu

SEQ ID NO: 71917 - RNA, 23 nt, Artificial Sequence
  Oligomer
auugugaagagccgugaugccuu

SEQ ID NO: 71918 - RNA, 23 nt, Artificial Sequence
  Oligomer
uugugaagagccgugaugccuuc

SEQ ID NO: 71919 - RNA, 23 nt, Artificial Sequence
  Oligomer
uccuuuuaccaggaggcagagag

SEQ ID NO: 71920 - RNA, 23 nt, Artificial Sequence
  Oligomer
ccuuuuaccaggaggcagagaga

SEQ ID NO: 71921 - RNA, 23 nt, Artificial Sequence
  Oligomer
cuuuuaccaggaggcagagagac

SEQ ID NO: 71922 - RNA, 23 nt, Artificial Sequence
  Oligomer
uuuuaccaggaggcagagagacc

SEQ ID NO: 71923 - RNA, 23 nt, Artificial Sequence
  Oligomer
uuuaccaggaggcagagagaccu

SEQ ID NO: 71924 - RNA, 23 nt, Artificial Sequence
  Oligomer
gggcuuucugagcuggcagucac

SEQ ID NO: 71925 - RNA, 23 nt, Artificial Sequence
  Oligomer
ggcuuucugagcuggcagucaca

SEQ ID NO: 71926 - RNA, 23 nt, Artificial Sequence
  Oligomer
gcuuucugagcuggcagucacag

SEQ ID NO: 71927 - RNA, 23 nt, Artificial Sequence
  Oligomer
cuuucugagcuggcagucacaga

SEQ ID NO: 71928 - RNA, 23 nt, Artificial Sequence
  Oligomer
uuucugagcuggcagucacagaa

SEQ ID NO: 71929 - RNA, 23 nt, Artificial Sequence
  Oligomer
uucuuuagaggccuuggugcguu

SEQ ID NO: 71930 - RNA, 23 nt, Artificial Sequence
  Oligomer
ucuuuagaggccuuggugcguua

SEQ ID NO: 71931 - RNA, 23 nt, Artificial Sequence
  Oligomer
uuugcaaccugagcaucccgcaa

SEQ ID NO: 71932 - RNA, 23 nt, Artificial Sequence
  Oligomer
aauauuacggguaagucuguagc

SEQ ID NO: 71933 - RNA, 23 nt, Artificial Sequence
  Oligomer
auauuacggguaagucuguagca

SEQ ID NO: 71934 - RNA, 23 nt, Artificial Sequence
  Oligomer
uauuacggguaagucuguagcaa

SEQ ID NO: 71935 - RNA, 23 nt, Artificial Sequence
  Oligomer
auuacggguaagucuguagcaag

SEQ ID NO: 71936 - RNA, 23 nt, Artificial Sequence
  Oligomer
uuacggguaagucuguagcaagu

SEQ ID NO: 71937 - RNA, 23 nt, Artificial Sequence
  Oligomer
uggugaauucuucaauccuucau

SEQ ID NO: 71938 - RNA, 23 nt, Artificial Sequence
  Oligomer
ggugaauucuucaauccuucauu

SEQ ID NO: 71939 - RNA, 23 nt, Artificial Sequence
  Oligomer
acuguaggucauggcaaacacag

SEQ ID NO: 71940 - RNA, 23 nt, Artificial Sequence
  Oligomer
cuguaggucauggcaaacacagc

SEQ ID NO: 71941 - RNA, 23 nt, Artificial Sequence
  Oligomer
uguaggucauggcaaacacagcg

SEQ ID NO: 71942 - RNA, 23 nt, Artificial Sequence
  Oligomer
guaggucauggcaaacacagcgg

SEQ ID NO: 71943 - RNA, 23 nt, Artificial Sequence
  Oligomer
uaggucauggcaaacacagcggc

SEQ ID NO: 71944 - RNA, 23 nt, Artificial Sequence
  Oligomer
ggcguucaugacgaaggaagaag

SEQ ID NO: 71945 - RNA, 23 nt, Artificial Sequence
  Oligomer
gcguucaugacgaaggaagaagc

SEQ ID NO: 71946 - RNA, 23 nt, Artificial Sequence
  Oligomer
cguucaugacgaaggaagaagcg

SEQ ID NO: 71947 - RNA, 23 nt, Artificial Sequence
  Oligomer
guucaugacgaaggaagaagcga

SEQ ID NO: 71948 - RNA, 23 nt, Artificial Sequence
  Oligomer
uucaugacgaaggaagaagcgaa

SEQ ID NO: 71949 - RNA, 23 nt, Artificial Sequence
  Oligomer
aguuuguccuuuuaccaggaggc

SEQ ID NO: 71950 - RNA, 23 nt, Artificial Sequence
  Oligomer
guuuguccuuuuaccaggaggca

SEQ ID NO: 71951 - RNA, 23 nt, Artificial Sequence
  Oligomer
uuuguccuuuuaccaggaggcag

SEQ ID NO: 71952 - RNA, 23 nt, Artificial Sequence
  Oligomer
uuguccuuuuaccaggaggcaga

SEQ ID NO: 71953 - RNA, 23 nt, Artificial Sequence
  Oligomer
acuguugacaacugcugagaacu

SEQ ID NO: 71954 - RNA, 23 nt, Artificial Sequence
  Oligomer
cuguugacaacugcugagaacuu

SEQ ID NO: 71955 - RNA, 23 nt, Artificial Sequence
  Oligomer
uguugacaacugcugagaacuuc

SEQ ID NO: 71956 - RNA, 23 nt, Artificial Sequence
  Oligomer
guugacaacugcugagaacuucc

SEQ ID NO: 71957 - RNA, 23 nt, Artificial Sequence
  Oligomer
ucacugcucugguucuuccucag

SEQ ID NO: 71958 - RNA, 23 nt, Artificial Sequence
  Oligomer
ucgauauucaccaggaacuuuua

SEQ ID NO: 71959 - RNA, 23 nt, Artificial Sequence
  Oligomer
uggguacagucccagcaaguuac

SEQ ID NO: 71960 - RNA, 23 nt, Artificial Sequence
  Oligomer
ggguacagucccagcaaguuacg

SEQ ID NO: 71961 - RNA, 23 nt, Artificial Sequence
  Oligomer
gguacagucccagcaaguuacgu

SEQ ID NO: 71962 - RNA, 23 nt, Artificial Sequence
  Oligomer
agccucuggauuugguucuucug

SEQ ID NO: 71963 - RNA, 23 nt, Artificial Sequence
  Oligomer
gccucuggauuugguucuucugg

SEQ ID NO: 71964 - RNA, 23 nt, Artificial Sequence
  Oligomer
uucguuccucugacuuccaaauc

SEQ ID NO: 71965 - RNA, 23 nt, Artificial Sequence
  Oligomer
ucuaggucagcaucacucugguu

SEQ ID NO: 71966 - RNA, 23 nt, Artificial Sequence
  Oligomer
cuaggucagcaucacucugguuu

SEQ ID NO: 71967 - RNA, 23 nt, Artificial Sequence
  Oligomer
uaggucagcaucacucugguuuc

SEQ ID NO: 71968 - RNA, 23 nt, Artificial Sequence
  Oligomer
aggucaaauucucccuccaaaga

SEQ ID NO: 71969 - RNA, 23 nt, Artificial Sequence
  Oligomer
ugacuuccaaaucguugaagaac

SEQ ID NO: 71970 - RNA, 23 nt, Artificial Sequence
  Oligomer
gacuuccaaaucguugaagaaca

SEQ ID NO: 71971 - RNA, 23 nt, Artificial Sequence
  Oligomer
acuuccaaaucguugaagaacau

SEQ ID NO: 71972 - RNA, 23 nt, Artificial Sequence
  Oligomer
cuuccaaaucguugaagaacauc

SEQ ID NO: 71973 - RNA, 23 nt, Artificial Sequence
  Oligomer
uuccaaaucguugaagaacauca

SEQ ID NO: 71974 - RNA, 23 nt, Artificial Sequence
  Oligomer
ugaauauuuggcccauuaggacc

SEQ ID NO: 71975 - RNA, 23 nt, Artificial Sequence
  Oligomer
gaauauuuggcccauuaggaccc

SEQ ID NO: 71976 - RNA, 23 nt, Artificial Sequence
  Oligomer
aauauuuggcccauuaggacccu

SEQ ID NO: 71977 - RNA, 23 nt, Artificial Sequence
  Oligomer
auauuuggcccauuaggacccuc

SEQ ID NO: 71978 - RNA, 23 nt, Artificial Sequence
  Oligomer
uauuuggcccauuaggacccucu

SEQ ID NO: 71979 - RNA, 23 nt, Artificial Sequence
  Oligomer
uguuuugguuuuguaggaacagg

SEQ ID NO: 71980 - RNA, 23 nt, Artificial Sequence
  Oligomer
guuuugguuuuguaggaacagga

SEQ ID NO: 71981 - RNA, 23 nt, Artificial Sequence
  Oligomer
uuuugguuuuguaggaacaggag

SEQ ID NO: 71982 - RNA, 23 nt, Artificial Sequence
  Oligomer
uuugguuuuguaggaacaggagg

SEQ ID NO: 71983 - RNA, 23 nt, Artificial Sequence
  Oligomer
uugguuuuguaggaacaggaggu

SEQ ID NO: 71984 - RNA, 23 nt, Artificial Sequence
  Oligomer
ucaauuuccuccacaaguuuccc

SEQ ID NO: 71985 - RNA, 23 nt, Artificial Sequence
  Oligomer
ucugugaagugcugcucauuguu

SEQ ID NO: 71986 - RNA, 23 nt, Artificial Sequence
  Oligomer
cugugaagugcugcucauuguua

SEQ ID NO: 71987 - RNA, 23 nt, Artificial Sequence
  Oligomer
ucuucaucgcuuucaagcuacau

SEQ ID NO: 71988 - RNA, 23 nt, Artificial Sequence
  Oligomer
cuucaucgcuuucaagcuacauu

SEQ ID NO: 71989 - RNA, 23 nt, Artificial Sequence
  Oligomer
uucaagcuacauugucauuaaaa

SEQ ID NO: 71990 - RNA, 23 nt, Artificial Sequence
  Oligomer
ucaagcuacauugucauuaaaau

SEQ ID NO: 71991 - RNA, 23 nt, Artificial Sequence
  Oligomer
ggcauucugcucuugauucaauu

SEQ ID NO: 71992 - RNA, 23 nt, Artificial Sequence
  Oligomer
gcauucugcucuugauucaauuu

SEQ ID NO: 71993 - RNA, 23 nt, Artificial Sequence
  Oligomer
ccacugcagacugauugucaugg

SEQ ID NO: 71994 - RNA, 23 nt, Artificial Sequence
  Oligomer
cacugcagacugauugucauggu

SEQ ID NO: 71995 - RNA, 23 nt, Artificial Sequence
  Oligomer
acugcagacugauugucauggug

SEQ ID NO: 71996 - RNA, 23 nt, Artificial Sequence
  Oligomer
cugcagacugauugucauggugg

SEQ ID NO: 71997 - RNA, 23 nt, Artificial Sequence
  Oligomer
ugcagacugauugucaugguggc

SEQ ID NO: 71998 - RNA, 23 nt, Artificial Sequence
  Oligomer
aguuucuccugcucagcaacuug

SEQ ID NO: 71999 - RNA, 23 nt, Artificial Sequence
  Oligomer
guuucuccugcucagcaacuugu

SEQ ID NO: 72000 - RNA, 23 nt, Artificial Sequence
  Oligomer
uuucuccugcucagcaacuuguu

SEQ ID NO: 72001 - RNA, 23 nt, Artificial Sequence
  Oligomer
uucuccugcucagcaacuuguug

SEQ ID NO: 72002 - RNA, 23 nt, Artificial Sequence
  Oligomer
ucuccugcucagcaacuuguugc

SEQ ID NO: 72003 - RNA, 23 nt, Artificial Sequence
  Oligomer
gcaauuguugcugggcuucaauc

SEQ ID NO: 72004 - RNA, 23 nt, Artificial Sequence
  Oligomer
caauuguugcugggcuucaaucu

SEQ ID NO: 72005 - RNA, 23 nt, Artificial Sequence
  Oligomer
aauuguugcugggcuucaaucug

SEQ ID NO: 72006 - RNA, 23 nt, Artificial Sequence
  Oligomer
aaauucuguguggaaguuucagg

SEQ ID NO: 72007 - RNA, 23 nt, Artificial Sequence
  Oligomer
aauucuguguggaaguuucaggc

SEQ ID NO: 72008 - RNA, 23 nt, Artificial Sequence
  Oligomer
auucuguguggaaguuucaggcc

SEQ ID NO: 72009 - RNA, 23 nt, Artificial Sequence
  Oligomer
uucuguguggaaguuucaggcca

SEQ ID NO: 72010 - RNA, 23 nt, Artificial Sequence
  Oligomer
ucuguguggaaguuucaggccaa

SEQ ID NO: 72011 - RNA, 23 nt, Artificial Sequence
  Oligomer
gagcuggcaugucacuguucucu

SEQ ID NO: 72012 - RNA, 23 nt, Artificial Sequence
  Oligomer
agcuggcaugucacuguucucug

SEQ ID NO: 72013 - RNA, 23 nt, Artificial Sequence
  Oligomer
gcuggcaugucacuguucucugu

SEQ ID NO: 72014 - RNA, 23 nt, Artificial Sequence
  Oligomer
cuggcaugucacuguucucugua

SEQ ID NO: 72015 - RNA, 23 nt, Artificial Sequence
  Oligomer
uggcaugucacuguucucuguac

SEQ ID NO: 72016 - RNA, 23 nt, Artificial Sequence
  Oligomer
uucuuucguaaggcuucuagguc

SEQ ID NO: 72017 - RNA, 23 nt, Artificial Sequence
  Oligomer
ucuuucguaaggcuucuagguca

SEQ ID NO: 72018 - RNA, 23 nt, Artificial Sequence
  Oligomer
cgccugcuguugcguauacaugg

SEQ ID NO: 72019 - RNA, 23 nt, Artificial Sequence
  Oligomer
gccugcuguugcguauacaugga

SEQ ID NO: 72020 - RNA, 23 nt, Artificial Sequence
  Oligomer
ccugcuguugcguauacauggaa

SEQ ID NO: 72021 - RNA, 23 nt, Artificial Sequence
  Oligomer
cugcuguugcguauacauggaau

SEQ ID NO: 72022 - RNA, 23 nt, Artificial Sequence
  Oligomer
ugcuguugcguauacauggaaua

SEQ ID NO: 72023 - RNA, 23 nt, Artificial Sequence
  Oligomer
cauugagaacggacgcacuuucu

SEQ ID NO: 72024 - RNA, 23 nt, Artificial Sequence
  Oligomer
auugagaacggacgcacuuucuu

SEQ ID NO: 72025 - RNA, 23 nt, Artificial Sequence
  Oligomer
uugagaacggacgcacuuucuuc

SEQ ID NO: 72026 - RNA, 23 nt, Artificial Sequence
  Oligomer
agccuuggcuugggaaaagaucu

SEQ ID NO: 72027 - RNA, 23 nt, Artificial Sequence
  Oligomer
gccuuggcuugggaaaagaucug

SEQ ID NO: 72028 - RNA, 23 nt, Artificial Sequence
  Oligomer
ccuuggcuugggaaaagaucugc

SEQ ID NO: 72029 - RNA, 23 nt, Artificial Sequence
  Oligomer
cuuggcuugggaaaagaucugca

SEQ ID NO: 72030 - RNA, 23 nt, Artificial Sequence
  Oligomer
uuggcuugggaaaagaucugcau

SEQ ID NO: 72031 - RNA, 23 nt, Artificial Sequence
  Oligomer
gcuuagcuuccugauucucagcu

SEQ ID NO: 72032 - RNA, 23 nt, Artificial Sequence
  Oligomer
cuuagcuuccugauucucagcua

SEQ ID NO: 72033 - RNA, 23 nt, Artificial Sequence
  Oligomer
uuagcuuccugauucucagcuau

SEQ ID NO: 72034 - RNA, 23 nt, Artificial Sequence
  Oligomer
ucacugacaaccaacuaacaguu

SEQ ID NO: 72035 - RNA, 23 nt, Artificial Sequence
  Oligomer
gagcacugaguguagccuuccuc

SEQ ID NO: 72036 - RNA, 23 nt, Artificial Sequence
  Oligomer
agcacugaguguagccuuccucc

SEQ ID NO: 72037 - RNA, 23 nt, Artificial Sequence
  Oligomer
gcacugaguguagccuuccucca

SEQ ID NO: 72038 - RNA, 23 nt, Artificial Sequence
  Oligomer
cacugaguguagccuuccuccau

SEQ ID NO: 72039 - RNA, 23 nt, Artificial Sequence
  Oligomer
acugaguguagccuuccuccauu

SEQ ID NO: 72040 - RNA, 23 nt, Artificial Sequence
  Oligomer
gguccacucacaaugucccugcc

SEQ ID NO: 72041 - RNA, 23 nt, Artificial Sequence
  Oligomer
guccacucacaaugucccugcca

SEQ ID NO: 72042 - RNA, 23 nt, Artificial Sequence
  Oligomer
uccacucacaaugucccugccag

SEQ ID NO: 72043 - RNA, 23 nt, Artificial Sequence
  Oligomer
cucauuccaugagcgauacgcuc

SEQ ID NO: 72044 - RNA, 23 nt, Artificial Sequence
  Oligomer
ucauuccaugagcgauacgcucu

SEQ ID NO: 72045 - RNA, 23 nt, Artificial Sequence
  Oligomer
cauuccaugagcgauacgcucug

SEQ ID NO: 72046 - RNA, 23 nt, Artificial Sequence
  Oligomer
auuccaugagcgauacgcucuga

SEQ ID NO: 72047 - RNA, 23 nt, Artificial Sequence
  Oligomer
uuccaugagcgauacgcucugag

SEQ ID NO: 72048 - RNA, 23 nt, Artificial Sequence
  Oligomer
agccaguuuuacgcaaguuuguc

SEQ ID NO: 72049 - RNA, 23 nt, Artificial Sequence
  Oligomer
cgaacuucguuccucugacuucc

SEQ ID NO: 72050 - RNA, 23 nt, Artificial Sequence
  Oligomer
gaacuucguuccucugacuucca

SEQ ID NO: 72051 - RNA, 23 nt, Artificial Sequence
  Oligomer
aacuucguuccucugacuuccaa

SEQ ID NO: 72052 - RNA, 23 nt, Artificial Sequence
  Oligomer
acuucguuccucugacuuccaaa

SEQ ID NO: 72053 - RNA, 23 nt, Artificial Sequence
  Oligomer
cuucguuccucugacuuccaaau

SEQ ID NO: 72054 - RNA, 23 nt, Artificial Sequence
  Oligomer
caaaucguugaagaacaucaaac

SEQ ID NO: 72055 - RNA, 23 nt, Artificial Sequence
  Oligomer
aaaucguugaagaacaucaaaca

SEQ ID NO: 72056 - RNA, 23 nt, Artificial Sequence
  Oligomer
aaucguugaagaacaucaaacau

SEQ ID NO: 72057 - RNA, 23 nt, Artificial Sequence
  Oligomer
aucguugaagaacaucaaacauu

SEQ ID NO: 72058 - RNA, 23 nt, Artificial Sequence
  Oligomer
ucguugaagaacaucaaacauuc

SEQ ID NO: 72059 - RNA, 23 nt, Artificial Sequence
  Oligomer
guccucugauauaaaagcuucug

SEQ ID NO: 72060 - RNA, 23 nt, Artificial Sequence
  Oligomer
uccucugauauaaaagcuucuga

SEQ ID NO: 72061 - RNA, 23 nt, Artificial Sequence
  Oligomer
ccucugauauaaaagcuucugaa

SEQ ID NO: 72062 - RNA, 23 nt, Artificial Sequence
  Oligomer
cucugauauaaaagcuucugaau

SEQ ID NO: 72063 - RNA, 23 nt, Artificial Sequence
  Oligomer
ucugauauaaaagcuucugaaua

SEQ ID NO: 72064 - RNA, 23 nt, Artificial Sequence
  Oligomer
uccaugacugccacuucugaauu

SEQ ID NO: 72065 - RNA, 23 nt, Artificial Sequence
  Oligomer
ugccauuuccugaaguucagcaa

SEQ ID NO: 72066 - RNA, 23 nt, Artificial Sequence
  Oligomer
uauuguucacugacaaccaacua

SEQ ID NO: 72067 - RNA, 23 nt, Artificial Sequence
  Oligomer
gguaagaaacaucggcaucaucu

SEQ ID NO: 72068 - RNA, 23 nt, Artificial Sequence
  Oligomer
guaagaaacaucggcaucaucuu

SEQ ID NO: 72069 - RNA, 23 nt, Artificial Sequence
  Oligomer
uaagaaacaucggcaucaucuug

SEQ ID NO: 72070 - RNA, 23 nt, Artificial Sequence
  Oligomer
uugaacuugcugccacggucugg

SEQ ID NO: 72071 - RNA, 23 nt, Artificial Sequence
  Oligomer
guuguuguagcuuggcauucugc

SEQ ID NO: 72072 - RNA, 23 nt, Artificial Sequence
  Oligomer
uuguuguagcuuggcauucugcu

SEQ ID NO: 72073 - RNA, 23 nt, Artificial Sequence
  Oligomer
uguuguagcuuggcauucugcuc

SEQ ID NO: 72074 - RNA, 23 nt, Artificial Sequence
  Oligomer
aaguuucuccugcucagcaacuu

SEQ ID NO: 72075 - RNA, 23 nt, Artificial Sequence
  Oligomer
acgcuaaauguccucuaauggug

SEQ ID NO: 72076 - RNA, 23 nt, Artificial Sequence
  Oligomer
cgcuaaauguccucuaaugguga

SEQ ID NO: 72077 - RNA, 23 nt, Artificial Sequence
  Oligomer
gcuaaauguccucuaauggugaa

SEQ ID NO: 72078 - RNA, 23 nt, Artificial Sequence
  Oligomer
cuaaauguccucuaauggugaau

SEQ ID NO: 72079 - RNA, 23 nt, Artificial Sequence
  Oligomer
uaaauguccucuaauggugaauu

SEQ ID NO: 72080 - RNA, 23 nt, Artificial Sequence
  Oligomer
uaagucuugugaaauuuuugcca

SEQ ID NO: 72081 - RNA, 23 nt, Artificial Sequence
  Oligomer
aagucuugugaaauuuuugccaa

SEQ ID NO: 72082 - RNA, 23 nt, Artificial Sequence
  Oligomer
agucuugugaaauuuuugccaaa

SEQ ID NO: 72083 - RNA, 23 nt, Artificial Sequence
  Oligomer
gucuugugaaauuuuugccaaaa

SEQ ID NO: 72084 - RNA, 23 nt, Artificial Sequence
  Oligomer
ucuugugaaauuuuugccaaaaa

SEQ ID NO: 72085 - RNA, 23 nt, Artificial Sequence
  Oligomer
uguccuuuuaccaggaggcagag

SEQ ID NO: 72086 - RNA, 23 nt, Artificial Sequence
  Oligomer
cguuuucaugguucuccugaacu

SEQ ID NO: 72087 - RNA, 23 nt, Artificial Sequence
  Oligomer
guuuucaugguucuccugaacug

SEQ ID NO: 72088 - RNA, 23 nt, Artificial Sequence
  Oligomer
uuuucaugguucuccugaacuga

SEQ ID NO: 72089 - RNA, 23 nt, Artificial Sequence
  Oligomer
uuucaugguucuccugaacugaa

SEQ ID NO: 72090 - RNA, 23 nt, Artificial Sequence
  Oligomer
uucaugguucuccugaacugaag

SEQ ID NO: 72091 - RNA, 23 nt, Artificial Sequence
  Oligomer
acugauugucaugguggcugucg

SEQ ID NO: 72092 - RNA, 23 nt, Artificial Sequence
  Oligomer
cugauugucaugguggcugucga

SEQ ID NO: 72093 - RNA, 23 nt, Artificial Sequence
  Oligomer
ugauugucaugguggcugucgau

SEQ ID NO: 72094 - RNA, 23 nt, Artificial Sequence
  Oligomer
gauugucaugguggcugucgauc

SEQ ID NO: 72095 - RNA, 23 nt, Artificial Sequence
  Oligomer
auugucaugguggcugucgaucc

SEQ ID NO: 72096 - RNA, 23 nt, Artificial Sequence
  Oligomer
gccguucuugagcaucucuagcu

SEQ ID NO: 72097 - RNA, 23 nt, Artificial Sequence
  Oligomer
ccguucuugagcaucucuagcug

SEQ ID NO: 72098 - RNA, 23 nt, Artificial Sequence
  Oligomer
cguucuugagcaucucuagcugc

SEQ ID NO: 72099 - RNA, 23 nt, Artificial Sequence
  Oligomer
uuaagugcucucacuuuuuuuag

SEQ ID NO: 72100 - RNA, 23 nt, Artificial Sequence
  Oligomer
auucuuggguacagucccagcaa

SEQ ID NO: 72101 - RNA, 23 nt, Artificial Sequence
  Oligomer
uucuuggguacagucccagcaag

SEQ ID NO: 72102 - RNA, 23 nt, Artificial Sequence
  Oligomer
aaguuacguggaacauaucccuc

SEQ ID NO: 72103 - RNA, 23 nt, Artificial Sequence
  Oligomer
aguuacguggaacauaucccucc

SEQ ID NO: 72104 - RNA, 23 nt, Artificial Sequence
  Oligomer
guuacguggaacauaucccuccu

SEQ ID NO: 72105 - RNA, 23 nt, Artificial Sequence
  Oligomer
uuacguggaacauaucccuccuu

SEQ ID NO: 72106 - RNA, 23 nt, Artificial Sequence
  Oligomer
uacguggaacauaucccuccuua

SEQ ID NO: 72107 - RNA, 23 nt, Artificial Sequence
  Oligomer
ucaugacgaaggaagaagcgaac

SEQ ID NO: 72108 - RNA, 23 nt, Artificial Sequence
  Oligomer
ggacucccucaggcucauaauca

SEQ ID NO: 72109 - RNA, 23 nt, Artificial Sequence
  Oligomer
gacucccucaggcucauaaucaa

SEQ ID NO: 72110 - RNA, 23 nt, Artificial Sequence
  Oligomer
acucccucaggcucauaaucaag

SEQ ID NO: 72111 - RNA, 23 nt, Artificial Sequence
  Oligomer
auauggauucuggauuucuacug

SEQ ID NO: 72112 - RNA, 23 nt, Artificial Sequence
  Oligomer
cuuucguaaggcuucuaggucag

SEQ ID NO: 72113 - RNA, 23 nt, Artificial Sequence
  Oligomer
uuucguaaggcuucuaggucagc

SEQ ID NO: 72114 - RNA, 23 nt, Artificial Sequence
  Oligomer
uucguaaggcuucuaggucagca

SEQ ID NO: 72115 - RNA, 23 nt, Artificial Sequence
  Oligomer
uugaaggacuccaaucagggcca

SEQ ID NO: 72116 - RNA, 23 nt, Artificial Sequence
  Oligomer
auaguagacgacuggauauaggg

SEQ ID NO: 72117 - RNA, 23 nt, Artificial Sequence
  Oligomer
uaguagacgacuggauauaggga

SEQ ID NO: 72118 - RNA, 23 nt, Artificial Sequence
  Oligomer
aguagacgacuggauauagggac

SEQ ID NO: 72119 - RNA, 23 nt, Artificial Sequence
  Oligomer
guagacgacuggauauagggacc

SEQ ID NO: 72120 - RNA, 23 nt, Artificial Sequence
  Oligomer
uagacgacuggauauagggaccu

SEQ ID NO: 72121 - RNA, 23 nt, Artificial Sequence
  Oligomer
uccuuauagaggcgaucaagcuc

SEQ ID NO: 72122 - RNA, 23 nt, Artificial Sequence
  Oligomer
ccuuauagaggcgaucaagcuca

SEQ ID NO: 72123 - RNA, 23 nt, Artificial Sequence
  Oligomer
cuuauagaggcgaucaagcucag

SEQ ID NO: 72124 - RNA, 23 nt, Artificial Sequence
  Oligomer
uuauagaggcgaucaagcucagc

SEQ ID NO: 72125 - RNA, 23 nt, Artificial Sequence
  Oligomer
uauagaggcgaucaagcucagcc

SEQ ID NO: 72126 - RNA, 23 nt, Artificial Sequence
  Oligomer
uuaguugccagcaauuguugcug

SEQ ID NO: 72127 - RNA, 23 nt, Artificial Sequence
  Oligomer
uaguugccagcaauuguugcugg

SEQ ID NO: 72128 - RNA, 23 nt, Artificial Sequence
  Oligomer
aguugccagcaauuguugcuggg

SEQ ID NO: 72129 - RNA, 23 nt, Artificial Sequence
  Oligomer
guugccagcaauuguugcugggc

SEQ ID NO: 72130 - RNA, 23 nt, Artificial Sequence
  Oligomer
uugccagcaauuguugcugggcu

SEQ ID NO: 72131 - RNA, 23 nt, Artificial Sequence
  Oligomer
cuaauuacugguaccguagcuua

SEQ ID NO: 72132 - RNA, 23 nt, Artificial Sequence
  Oligomer
aucccuccuuaucauuaaggcgc

SEQ ID NO: 72133 - RNA, 23 nt, Artificial Sequence
  Oligomer
ucccuccuuaucauuaaggcgcg

SEQ ID NO: 72134 - RNA, 23 nt, Artificial Sequence
  Oligomer
cccuccuuaucauuaaggcgcgc

SEQ ID NO: 72135 - RNA, 23 nt, Artificial Sequence
  Oligomer
ccuccuuaucauuaaggcgcgcc

SEQ ID NO: 72136 - RNA, 23 nt, Artificial Sequence
  Oligomer
ucucugggugcugcuguugauuc

SEQ ID NO: 72137 - RNA, 23 nt, Artificial Sequence
  Oligomer
cucugggugcugcuguugauucu

SEQ ID NO: 72138 - RNA, 23 nt, Artificial Sequence
  Oligomer
ucugggugcugcuguugauucug

SEQ ID NO: 72139 - RNA, 23 nt, Artificial Sequence
  Oligomer
gccccucugaagccugaaugacc

SEQ ID NO: 72140 - RNA, 23 nt, Artificial Sequence
  Oligomer
uuccaucagaugaaacugguaga

SEQ ID NO: 72141 - RNA, 23 nt, Artificial Sequence
  Oligomer
cuagagacauucuucaucgcuuu

SEQ ID NO: 72142 - RNA, 23 nt, Artificial Sequence
  Oligomer
aauaagucuugugaaauuuuugc

SEQ ID NO: 72143 - RNA, 23 nt, Artificial Sequence
  Oligomer
auaagucuugugaaauuuuugcc

SEQ ID NO: 72144 - RNA, 23 nt, Artificial Sequence
  Oligomer
caaguuacguggaacauaucccu

SEQ ID NO: 72145 - RNA, 23 nt, Artificial Sequence
  Oligomer
acguggaacauaucccuccuuau

SEQ ID NO: 72146 - RNA, 23 nt, Artificial Sequence
  Oligomer
ugucaugcagucuccuucuuuca

SEQ ID NO: 72147 - RNA, 23 nt, Artificial Sequence
  Oligomer
acaauguaauggaguccauccau

SEQ ID NO: 72148 - RNA, 23 nt, Artificial Sequence
  Oligomer
caauguaauggaguccauccauc

SEQ ID NO: 72149 - RNA, 23 nt, Artificial Sequence
  Oligomer
aauguaauggaguccauccauca

SEQ ID NO: 72150 - RNA, 23 nt, Artificial Sequence
  Oligomer
ugaaaaguguggcccucugguau

SEQ ID NO: 72151 - RNA, 23 nt, Artificial Sequence
  Oligomer
aaccuggagaaagggucuggucu

SEQ ID NO: 72152 - RNA, 23 nt, Artificial Sequence
  Oligomer
accuggagaaagggucuggucuu

SEQ ID NO: 72153 - RNA, 23 nt, Artificial Sequence
  Oligomer
ccuggagaaagggucuggucuug

SEQ ID NO: 72154 - RNA, 23 nt, Artificial Sequence
  Oligomer
ggucuuggccaaccgaagguaug

SEQ ID NO: 72155 - RNA, 23 nt, Artificial Sequence
  Oligomer
gucuuggccaaccgaagguaugc

SEQ ID NO: 72156 - RNA, 23 nt, Artificial Sequence
  Oligomer
ucuuggccaaccgaagguaugcu

SEQ ID NO: 72157 - RNA, 23 nt, Artificial Sequence
  Oligomer
cuuggccaaccgaagguaugcug

SEQ ID NO: 72158 - RNA, 23 nt, Artificial Sequence
  Oligomer
uuggccaaccgaagguaugcugg

SEQ ID NO: 72159 - RNA, 23 nt, Artificial Sequence
  Oligomer
uggcuugggaaaagaucugcauu

SEQ ID NO: 72160 - RNA, 23 nt, Artificial Sequence
  Oligomer
ggcuugggaaaagaucugcauuu

SEQ ID NO: 72161 - RNA, 23 nt, Artificial Sequence
  Oligomer
gcuugggaaaagaucugcauuug

SEQ ID NO: 72162 - RNA, 23 nt, Artificial Sequence
  Oligomer
cuugggaaaagaucugcauuuga

SEQ ID NO: 72163 - RNA, 23 nt, Artificial Sequence
  Oligomer
uugggaaaagaucugcauuugaa

SEQ ID NO: 72164 - RNA, 23 nt, Artificial Sequence
  Oligomer
acacgcuuauccaugacugccac

SEQ ID NO: 72165 - RNA, 23 nt, Artificial Sequence
  Oligomer
cacgcuuauccaugacugccacu

SEQ ID NO: 72166 - RNA, 23 nt, Artificial Sequence
  Oligomer
uagcugcagcuccuuauagaggc

SEQ ID NO: 72167 - RNA, 23 nt, Artificial Sequence
  Oligomer
agcugcagcuccuuauagaggcg

SEQ ID NO: 72168 - RNA, 23 nt, Artificial Sequence
  Oligomer
gcugcagcuccuuauagaggcga

SEQ ID NO: 72169 - RNA, 23 nt, Artificial Sequence
  Oligomer
cugcagcuccuuauagaggcgau

SEQ ID NO: 72170 - RNA, 23 nt, Artificial Sequence
  Oligomer
ugcagcuccuuauagaggcgauc

SEQ ID NO: 72171 - RNA, 23 nt, Artificial Sequence
  Oligomer
uuccuuaguugccagcaauuguu

SEQ ID NO: 72172 - RNA, 23 nt, Artificial Sequence
  Oligomer
uccuuaguugccagcaauuguug

SEQ ID NO: 72173 - RNA, 23 nt, Artificial Sequence
  Oligomer
ccuuaguugccagcaauuguugc

SEQ ID NO: 72174 - RNA, 23 nt, Artificial Sequence
  Oligomer
cuuaguugccagcaauuguugcu

SEQ ID NO: 72175 - RNA, 23 nt, Artificial Sequence
  Oligomer
agcugauuucccaacugcccaau

SEQ ID NO: 72176 - RNA, 23 nt, Artificial Sequence
  Oligomer
gucaugcagucuccuucuuucau

SEQ ID NO: 72177 - RNA, 23 nt, Artificial Sequence
  Oligomer
ucaugcagucuccuucuuucaug

SEQ ID NO: 72178 - RNA, 23 nt, Artificial Sequence
  Oligomer
uaaucccaaagcgcauaaaugac

SEQ ID NO: 72179 - RNA, 23 nt, Artificial Sequence
  Oligomer
aaucccaaagcgcauaaaugacu

SEQ ID NO: 72180 - RNA, 23 nt, Artificial Sequence
  Oligomer
ugggacagagauggucuccaugg

SEQ ID NO: 72181 - RNA, 23 nt, Artificial Sequence
  Oligomer
gggacagagauggucuccauggc

SEQ ID NO: 72182 - RNA, 23 nt, Artificial Sequence
  Oligomer
ggacagagauggucuccauggcc

SEQ ID NO: 72183 - RNA, 23 nt, Artificial Sequence
  Oligomer
gacagagauggucuccauggccg

SEQ ID NO: 72184 - RNA, 23 nt, Artificial Sequence
  Oligomer
acagagauggucuccauggccgc

SEQ ID NO: 72185 - RNA, 23 nt, Artificial Sequence
  Oligomer
cuuuagaggccuuggugcguuag

SEQ ID NO: 72186 - RNA, 23 nt, Artificial Sequence
  Oligomer
uuuagaggccuuggugcguuaga

SEQ ID NO: 72187 - RNA, 23 nt, Artificial Sequence
  Oligomer
ucguaaggcuucuaggucagcau

SEQ ID NO: 72188 - RNA, 23 nt, Artificial Sequence
  Oligomer
cguaaggcuucuaggucagcauc

SEQ ID NO: 72189 - RNA, 23 nt, Artificial Sequence
  Oligomer
guaaggcuucuaggucagcauca

SEQ ID NO: 72190 - RNA, 23 nt, Artificial Sequence
  Oligomer
uaaggcuucuaggucagcaucac

SEQ ID NO: 72191 - RNA, 23 nt, Artificial Sequence
  Oligomer
gguuucgguaaggauuagauaag

SEQ ID NO: 72192 - RNA, 23 nt, Artificial Sequence
  Oligomer
guuucgguaaggauuagauaaga

SEQ ID NO: 72193 - RNA, 23 nt, Artificial Sequence
  Oligomer
uuucgguaaggauuagauaagaa

SEQ ID NO: 72194 - RNA, 23 nt, Artificial Sequence
  Oligomer
uucgguaaggauuagauaagaaa

SEQ ID NO: 72195 - RNA, 23 nt, Artificial Sequence
  Oligomer
uaagaaaggcaguaauuuaguug

SEQ ID NO: 72196 - RNA, 23 nt, Artificial Sequence
  Oligomer
ugguuuuguaggaacaggaggug

SEQ ID NO: 72197 - RNA, 23 nt, Artificial Sequence
  Oligomer
gguuuuguaggaacaggaggugg

SEQ ID NO: 72198 - RNA, 23 nt, Artificial Sequence
  Oligomer
guuuuguaggaacaggagguggu

SEQ ID NO: 72199 - RNA, 23 nt, Artificial Sequence
  Oligomer
uuuuguaggaacaggagguggua

SEQ ID NO: 72200 - RNA, 23 nt, Artificial Sequence
  Oligomer
ugaaggacuccaaucagggccaa

SEQ ID NO: 72201 - RNA, 23 nt, Artificial Sequence
  Oligomer
uuuagagccuuuaguuugugaag

SEQ ID NO: 72202 - RNA, 23 nt, Artificial Sequence
  Oligomer
uccuucauucucuucuagagaca

SEQ ID NO: 72203 - RNA, 23 nt, Artificial Sequence
  Oligomer
auguaauggaguccauccaucac

SEQ ID NO: 72204 - RNA, 23 nt, Artificial Sequence
  Oligomer
uguaauggaguccauccaucacu

SEQ ID NO: 72205 - RNA, 23 nt, Artificial Sequence
  Oligomer
guaauggaguccauccaucacua

SEQ ID NO: 72206 - RNA, 23 nt, Artificial Sequence
  Oligomer
uaauggaguccauccaucacuau

SEQ ID NO: 72207 - RNA, 23 nt, Artificial Sequence
  Oligomer
gcgcaugcucaccgagucuucuc

SEQ ID NO: 72208 - RNA, 23 nt, Artificial Sequence
  Oligomer
cgcaugcucaccgagucuucucc

SEQ ID NO: 72209 - RNA, 23 nt, Artificial Sequence
  Oligomer
gcaugcucaccgagucuucuccg

SEQ ID NO: 72210 - RNA, 23 nt, Artificial Sequence
  Oligomer
caugcucaccgagucuucuccgg

SEQ ID NO: 72211 - RNA, 23 nt, Artificial Sequence
  Oligomer
augcucaccgagucuucuccggg

SEQ ID NO: 72212 - RNA, 23 nt, Artificial Sequence
  Oligomer
ucuggagauuugggcuguugucu

SEQ ID NO: 72213 - RNA, 23 nt, Artificial Sequence
  Oligomer
cuggagauuugggcuguugucug

SEQ ID NO: 72214 - RNA, 23 nt, Artificial Sequence
  Oligomer
uggagauuugggcuguugucugg

SEQ ID NO: 72215 - RNA, 23 nt, Artificial Sequence
  Oligomer
uccucagaguaccaaaggaaggu

SEQ ID NO: 72216 - RNA, 23 nt, Artificial Sequence
  Oligomer
ccucagaguaccaaaggaaggug

SEQ ID NO: 72217 - RNA, 23 nt, Artificial Sequence
  Oligomer
cucagaguaccaaaggaaggugg

SEQ ID NO: 72218 - RNA, 23 nt, Artificial Sequence
  Oligomer
ucagaguaccaaaggaagguggg

SEQ ID NO: 72219 - RNA, 23 nt, Artificial Sequence
  Oligomer
uguuguuguagcuuggcauucug

SEQ ID NO: 72220 - RNA, 23 nt, Artificial Sequence
  Oligomer
uugucaugguggcugucgauccu

SEQ ID NO: 72221 - RNA, 23 nt, Artificial Sequence
  Oligomer
guccucuaauggugaauucuuca

SEQ ID NO: 72222 - RNA, 23 nt, Artificial Sequence
  Oligomer
uccucuaauggugaauucuucaa

SEQ ID NO: 72223 - RNA, 23 nt, Artificial Sequence
  Oligomer
ccucuaauggugaauucuucaau

SEQ ID NO: 72224 - RNA, 23 nt, Artificial Sequence
  Oligomer
uuuaaacuuggauccugagaucu

SEQ ID NO: 72225 - RNA, 23 nt, Artificial Sequence
  Oligomer
uuaaacuuggauccugagaucuu

SEQ ID NO: 72226 - RNA, 23 nt, Artificial Sequence
  Oligomer
uaaacuuggauccugagaucuug

SEQ ID NO: 72227 - RNA, 23 nt, Artificial Sequence
  Oligomer
uucugagguucauaaucccaaag

SEQ ID NO: 72228 - RNA, 23 nt, Artificial Sequence
  Oligomer
ucaggaaccagagagaccaccuc

SEQ ID NO: 72229 - RNA, 23 nt, Artificial Sequence
  Oligomer
auuuggcccauuaggacccucug

SEQ ID NO: 72230 - RNA, 23 nt, Artificial Sequence
  Oligomer
gaucucauguugggcagugucug

SEQ ID NO: 72231 - RNA, 23 nt, Artificial Sequence
  Oligomer
aucucauguugggcagugucugu

SEQ ID NO: 72232 - RNA, 23 nt, Artificial Sequence
  Oligomer
ucucauguugggcagugucugua

SEQ ID NO: 72233 - RNA, 23 nt, Artificial Sequence
  Oligomer
cucauguugggcagugucuguau

SEQ ID NO: 72234 - RNA, 23 nt, Artificial Sequence
  Oligomer
ucauguugggcagugucuguauu

SEQ ID NO: 72235 - RNA, 23 nt, Artificial Sequence
  Oligomer
cauguugggcagugucuguauuu

SEQ ID NO: 72236 - RNA, 23 nt, Artificial Sequence
  Oligomer
auguugggcagugucuguauuuu

SEQ ID NO: 72237 - RNA, 23 nt, Artificial Sequence
  Oligomer
uguugggcagugucuguauuuuc

SEQ ID NO: 72238 - RNA, 23 nt, Artificial Sequence
  Oligomer
guugggcagugucuguauuuuca

SEQ ID NO: 72239 - RNA, 23 nt, Artificial Sequence
  Oligomer
uugggcagugucuguauuuucau

SEQ ID NO: 72240 - RNA, 23 nt, Artificial Sequence
  Oligomer
uaacuggaacuucugugaagugc

SEQ ID NO: 72241 - RNA, 23 nt, Artificial Sequence
  Oligomer
aacuggaacuucugugaagugcu

SEQ ID NO: 72242 - RNA, 23 nt, Artificial Sequence
  Oligomer
acuggaacuucugugaagugcug

SEQ ID NO: 72243 - RNA, 23 nt, Artificial Sequence
  Oligomer
cuggaacuucugugaagugcugc

SEQ ID NO: 72244 - RNA, 23 nt, Artificial Sequence
  Oligomer
uggaacuucugugaagugcugcu

SEQ ID NO: 72245 - RNA, 23 nt, Artificial Sequence
  Oligomer
cagacugauugucaugguggcug

SEQ ID NO: 72246 - RNA, 23 nt, Artificial Sequence
  Oligomer
agacugauugucaugguggcugu

SEQ ID NO: 72247 - RNA, 23 nt, Artificial Sequence
  Oligomer
gacugauugucaugguggcuguc

SEQ ID NO: 72248 - RNA, 23 nt, Artificial Sequence
  Oligomer
cucagcuauuucuuuuagccuuu

SEQ ID NO: 72249 - RNA, 23 nt, Artificial Sequence
  Oligomer
ucagcuauuucuuuuagccuuuu

SEQ ID NO: 72250 - RNA, 23 nt, Artificial Sequence
  Oligomer
aaaauucuguguggaaguuucag

SEQ ID NO: 72251 - RNA, 23 nt, Artificial Sequence
  Oligomer
uucaugggcagcucaucaucauu

SEQ ID NO: 72252 - RNA, 23 nt, Artificial Sequence
  Oligomer
ucaugggcagcucaucaucauuc

SEQ ID NO: 72253 - RNA, 23 nt, Artificial Sequence
  Oligomer
gaaauugggagcacugaguguag

SEQ ID NO: 72254 - RNA, 23 nt, Artificial Sequence
  Oligomer
aaauugggagcacugaguguagc

SEQ ID NO: 72255 - RNA, 23 nt, Artificial Sequence
  Oligomer
aauugggagcacugaguguagcc

SEQ ID NO: 72256 - RNA, 23 nt, Artificial Sequence
  Oligomer
auugggagcacugaguguagccu

SEQ ID NO: 72257 - RNA, 23 nt, Artificial Sequence
  Oligomer
uugggagcacugaguguagccuu

SEQ ID NO: 72258 - RNA, 23 nt, Artificial Sequence
  Oligomer
uccaaaucguugaagaacaucaa

SEQ ID NO: 72259 - RNA, 23 nt, Artificial Sequence
  Oligomer
ccaaaucguugaagaacaucaaa

SEQ ID NO: 72260 - RNA, 23 nt, Artificial Sequence
  Oligomer
cauucgcucauuauccgcaacug

SEQ ID NO: 72261 - RNA, 23 nt, Artificial Sequence
  Oligomer
auucgcucauuauccgcaacugg

SEQ ID NO: 72262 - RNA, 23 nt, Artificial Sequence
  Oligomer
uucgcucauuauccgcaacugga

SEQ ID NO: 72263 - RNA, 23 nt, Artificial Sequence
  Oligomer
ucgcucauuauccgcaacuggac

SEQ ID NO: 72264 - RNA, 23 nt, Artificial Sequence
  Oligomer
aaguuuuuuccuggcgccugcug

SEQ ID NO: 72265 - RNA, 23 nt, Artificial Sequence
  Oligomer
aguuuuuuccuggcgccugcugu

SEQ ID NO: 72266 - RNA, 23 nt, Artificial Sequence
  Oligomer
caccguucuccuuucuucgauau

SEQ ID NO: 72267 - RNA, 23 nt, Artificial Sequence
  Oligomer
aaagaaauugggagcacugagug

SEQ ID NO: 72268 - RNA, 23 nt, Artificial Sequence
  Oligomer
auccaucacuaucagcagcauuu

SEQ ID NO: 72269 - RNA, 23 nt, Artificial Sequence
  Oligomer
uccaucacuaucagcagcauuua

SEQ ID NO: 72270 - RNA, 23 nt, Artificial Sequence
  Oligomer
ccaucacuaucagcagcauuuac

SEQ ID NO: 72271 - RNA, 23 nt, Artificial Sequence
  Oligomer
uucucuguacaaggucaaauucu

SEQ ID NO: 72272 - RNA, 23 nt, Artificial Sequence
  Oligomer
uccaugagcgauacgcucugagc

SEQ ID NO: 72273 - RNA, 23 nt, Artificial Sequence
  Oligomer
ccaugagcgauacgcucugagcc

SEQ ID NO: 72274 - RNA, 23 nt, Artificial Sequence
  Oligomer
caugagcgauacgcucugagcca

SEQ ID NO: 72275 - RNA, 23 nt, Artificial Sequence
  Oligomer
augagcgauacgcucugagccag

SEQ ID NO: 72276 - RNA, 23 nt, Artificial Sequence
  Oligomer
ucuucuggguuauucuggagauu

SEQ ID NO: 72277 - RNA, 23 nt, Artificial Sequence
  Oligomer
cuucuggguuauucuggagauuu

SEQ ID NO: 72278 - RNA, 23 nt, Artificial Sequence
  Oligomer
uucuggguuauucuggagauuug

SEQ ID NO: 72279 - RNA, 23 nt, Artificial Sequence
  Oligomer
uuucgggcuccacauguaaauau

SEQ ID NO: 72280 - RNA, 23 nt, Artificial Sequence
  Oligomer
ccgcuauggugguccucugauau

SEQ ID NO: 72281 - RNA, 23 nt, Artificial Sequence
  Oligomer
cgcuauggugguccucugauaua

SEQ ID NO: 72282 - RNA, 23 nt, Artificial Sequence
  Oligomer
gcuauggugguccucugauauaa

SEQ ID NO: 72283 - RNA, 23 nt, Artificial Sequence
  Oligomer
cuauggugguccucugauauaaa

SEQ ID NO: 72284 - RNA, 23 nt, Artificial Sequence
  Oligomer
uauggugguccucugauauaaaa

SEQ ID NO: 72285 - RNA, 19 nt, Artificial Sequence
  Oligomer
ucaggacccggaaugacaa

SEQ ID NO: 72286 - RNA, 19 nt, Artificial Sequence
  Oligomer
gaaucugcuggacacgcua

SEQ ID NO: 72287 - RNA, 19 nt, Artificial Sequence
  Oligomer
ucuucuacucgcaccugaa

SEQ ID NO: 72288 - RNA, 19 nt, Artificial Sequence
  Oligomer
ccuuccucacagugacaca

SEQ ID NO: 72289 - RNA, 19 nt, Artificial Sequence
  Oligomer
aguucuuugcggccuucga

SEQ ID NO: 72290 - RNA, 19 nt, Artificial Sequence
  Oligomer
ccaccuucaagucucucca

SEQ ID NO: 72291 - RNA, 19 nt, Artificial Sequence
  Oligomer
cuuuuaggcuggcccagau

SEQ ID NO: 72292 - RNA, 19 nt, Artificial Sequence
  Oligomer
ucugguacaccaccaagaa

SEQ ID NO: 72293 - RNA, 19 nt, Artificial Sequence
  Oligomer
gcugcagguggaauucuug

SEQ ID NO: 72294 - RNA, 19 nt, Artificial Sequence
  Oligomer
caggagaugcuucagagga

SEQ ID NO: 72295 - RNA, 19 nt, Artificial Sequence
  Oligomer
uccuuguccugcacagcaa

SEQ ID NO: 72296 - RNA, 19 nt, Artificial Sequence
  Oligomer
ucuccuuggcacccuugaa

SEQ ID NO: 72297 - RNA, 19 nt, Artificial Sequence
  Oligomer
acgaguuccgggaugaucu

SEQ ID NO: 72298 - RNA, 19 nt, Artificial Sequence
  Oligomer
caccaagaacuguguggga

SEQ ID NO: 72299 - RNA, 19 nt, Artificial Sequence
  Oligomer
ccuuggcacccuugaaucu

SEQ ID NO: 72300 - RNA, 19 nt, Artificial Sequence
  Oligomer
cucacaacugccucucuga

SEQ ID NO: 72301 - RNA, 19 nt, Artificial Sequence
  Oligomer
agacuuuuaggcuggccca

SEQ ID NO: 72302 - RNA, 19 nt, Artificial Sequence
  Oligomer
uguucgagggcgaagaguu

SEQ ID NO: 72303 - RNA, 19 nt, Artificial Sequence
  Oligomer
ugagcagauccgucacaug

SEQ ID NO: 72304 - RNA, 19 nt, Artificial Sequence
  Oligomer
caccuuccucacagugaca

SEQ ID NO: 72305 - RNA, 19 nt, Artificial Sequence
  Oligomer
ccuucaagucucuccagug

SEQ ID NO: 72306 - RNA, 19 nt, Artificial Sequence
  Oligomer
uuuuaggcuggcccagaua

SEQ ID NO: 72307 - RNA, 19 nt, Artificial Sequence
  Oligomer
ugaaucugggagaugccga

SEQ ID NO: 72308 - RNA, 19 nt, Artificial Sequence
  Oligomer
uggagggcagaaucugcuu

SEQ ID NO: 72309 - RNA, 19 nt, Artificial Sequence
  Oligomer
acuuuuaggcuggcccaga

SEQ ID NO: 72310 - RNA, 19 nt, Artificial Sequence
  Oligomer
cgucacaugcucuucuccu

SEQ ID NO: 72311 - RNA, 19 nt, Artificial Sequence
  Oligomer
caucaagcugccgagacuu

SEQ ID NO: 72312 - RNA, 19 nt, Artificial Sequence
  Oligomer
gagggcgaagaguucuuug

SEQ ID NO: 72313 - RNA, 19 nt, Artificial Sequence
  Oligomer
uccugaccucagauuugga

SEQ ID NO: 72314 - RNA, 19 nt, Artificial Sequence
  Oligomer
cucauuccagaaaugccca

SEQ ID NO: 72315 - RNA, 19 nt, Artificial Sequence
  Oligomer
ccucacagugacacacaac

SEQ ID NO: 72316 - RNA, 19 nt, Artificial Sequence
  Oligomer
caaguaccaggacagcauc

SEQ ID NO: 72317 - RNA, 19 nt, Artificial Sequence
  Oligomer
uacuggcucugguacacca

SEQ ID NO: 72318 - RNA, 19 nt, Artificial Sequence
  Oligomer
acuucuccugguuccuugu

SEQ ID NO: 72319 - RNA, 19 nt, Artificial Sequence
  Oligomer
augcuucagaggauucgga

SEQ ID NO: 72320 - RNA, 19 nt, Artificial Sequence
  Oligomer
ucuugcgucugagcacuca

SEQ ID NO: 72321 - RNA, 19 nt, Artificial Sequence
  Oligomer
cagacuguuccugaccuca

SEQ ID NO: 72322 - RNA, 19 nt, Artificial Sequence
  Oligomer
uguguggagggcagaaucu

SEQ ID NO: 72323 - RNA, 19 nt, Artificial Sequence
  Oligomer
ucuggaugagcagauccgu

SEQ ID NO: 72324 - RNA, 19 nt, Artificial Sequence
  Oligomer
acaucacagcucagguggu

SEQ ID NO: 72325 - RNA, 19 nt, Artificial Sequence
  Oligomer
gucucacaacugccucucu

SEQ ID NO: 72326 - RNA, 19 nt, Artificial Sequence
  Oligomer
caccuucaagucucuccag

SEQ ID NO: 72327 - RNA, 19 nt, Artificial Sequence
  Oligomer
gaugaucuggaugagcaga

SEQ ID NO: 72328 - RNA, 19 nt, Artificial Sequence
  Oligomer
gaauucuugcgucugagca

SEQ ID NO: 72329 - RNA, 19 nt, Artificial Sequence
  Oligomer
ggaauucuugcgucugagc

SEQ ID NO: 72330 - RNA, 19 nt, Artificial Sequence
  Oligomer
gguacaccaccaagaacug

SEQ ID NO: 72331 - RNA, 19 nt, Artificial Sequence
  Oligomer
cugggaugacaucacagcu

SEQ ID NO: 72332 - RNA, 19 nt, Artificial Sequence
  Oligomer
acccggaaugacaacagcu

SEQ ID NO: 72333 - RNA, 19 nt, Artificial Sequence
  Oligomer
uucagaggauucggacgca

SEQ ID NO: 72334 - RNA, 19 nt, Artificial Sequence
  Oligomer
uggaugagcagauccguca

SEQ ID NO: 72335 - RNA, 19 nt, Artificial Sequence
  Oligomer
augacaucacagcucaggu

SEQ ID NO: 72336 - RNA, 19 nt, Artificial Sequence
  Oligomer
aguuccgggaugaucugga

SEQ ID NO: 72337 - RNA, 19 nt, Artificial Sequence
  Oligomer
cuuucugacgcagagcaac

SEQ ID NO: 72338 - RNA, 19 nt, Artificial Sequence
  Oligomer
uucuacucgcaccugaaga

SEQ ID NO: 72339 - RNA, 19 nt, Artificial Sequence
  Oligomer
cugucucacaacugccucu

SEQ ID NO: 72340 - RNA, 19 nt, Artificial Sequence
  Oligomer
cugaccucagauuuggaca

SEQ ID NO: 72341 - RNA, 19 nt, Artificial Sequence
  Oligomer
uguuccugaccucagauuu

SEQ ID NO: 72342 - RNA, 19 nt, Artificial Sequence
  Oligomer
accuucaagucucuccagu

SEQ ID NO: 72343 - RNA, 19 nt, Artificial Sequence
  Oligomer
cuuugucuucuacucgcac

SEQ ID NO: 72344 - RNA, 19 nt, Artificial Sequence
  Oligomer
aggacccggaaugacaaca

SEQ ID NO: 72345 - RNA, 19 nt, Artificial Sequence
  Oligomer
gaugcuucagaggauucgg

SEQ ID NO: 72346 - RNA, 19 nt, Artificial Sequence
  Oligomer
uuuaggcuggcccagauau

SEQ ID NO: 72347 - RNA, 19 nt, Artificial Sequence
  Oligomer
cagauccgucacaugcucu

SEQ ID NO: 72348 - RNA, 19 nt, Artificial Sequence
  Oligomer
cuucaacagccuggagaca

SEQ ID NO: 72349 - RNA, 19 nt, Artificial Sequence
  Oligomer
agcagauccgucacaugcu

SEQ ID NO: 72350 - RNA, 19 nt, Artificial Sequence
  Oligomer
cauuccagaaaugcccaga

SEQ ID NO: 72351 - RNA, 19 nt, Artificial Sequence
  Oligomer
ucaccuuccucacagugac

SEQ ID NO: 72352 - RNA, 19 nt, Artificial Sequence
  Oligomer
gcucuugcugucucacaac

SEQ ID NO: 72353 - RNA, 19 nt, Artificial Sequence
  Oligomer
agcuucaacagccuggaga

SEQ ID NO: 72354 - RNA, 19 nt, Artificial Sequence
  Oligomer
agauuuggacagcuuuccu

SEQ ID NO: 72355 - RNA, 19 nt, Artificial Sequence
  Oligomer
guuccugaccucagauuug

SEQ ID NO: 72356 - RNA, 19 nt, Artificial Sequence
  Oligomer
ccucauuccagaaaugccc

SEQ ID NO: 72357 - RNA, 19 nt, Artificial Sequence
  Oligomer
ugcuucagaggauucggac

SEQ ID NO: 72358 - RNA, 19 nt, Artificial Sequence
  Oligomer
cucaccuuccucacaguga

SEQ ID NO: 72359 - RNA, 19 nt, Artificial Sequence
  Oligomer
cuugcugucucacaacugc

SEQ ID NO: 72360 - RNA, 19 nt, Artificial Sequence
  Oligomer
uuaggcuggcccagauauu

SEQ ID NO: 72361 - RNA, 19 nt, Artificial Sequence
  Oligomer
ucuccugguuccuuguggu

SEQ ID NO: 72362 - RNA, 19 nt, Artificial Sequence
  Oligomer
auuuggacagcuuuccugu

SEQ ID NO: 72363 - RNA, 19 nt, Artificial Sequence
  Oligomer
aaaugcccagacuguuccu

SEQ ID NO: 72364 - RNA, 19 nt, Artificial Sequence
  Oligomer
uuccucacagugacacaca

SEQ ID NO: 72365 - RNA, 19 nt, Artificial Sequence
  Oligomer
ccuugaaucugggagaugc

SEQ ID NO: 72366 - RNA, 19 nt, Artificial Sequence
  Oligomer
cugaagaaugugaaggagg

SEQ ID NO: 72367 - RNA, 19 nt, Artificial Sequence
  Oligomer
gguggaauucuugcgucug

SEQ ID NO: 72368 - RNA, 19 nt, Artificial Sequence
  Oligomer
uuggacagcuuuccuguga

SEQ ID NO: 72369 - RNA, 19 nt, Artificial Sequence
  Oligomer
gauuuggacagcuuuccug

SEQ ID NO: 72370 - RNA, 19 nt, Artificial Sequence
  Oligomer
ucagauuuggacagcuuuc

SEQ ID NO: 72371 - RNA, 19 nt, Artificial Sequence
  Oligomer
acuguuccugaccucagau

SEQ ID NO: 72372 - RNA, 19 nt, Artificial Sequence
  Oligomer
augcccagacuguuccuga

SEQ ID NO: 72373 - RNA, 19 nt, Artificial Sequence
  Oligomer
cuaccuccugagauuggag

SEQ ID NO: 72374 - RNA, 19 nt, Artificial Sequence
  Oligomer
ucucagaaucugcuggaca

SEQ ID NO: 72375 - RNA, 19 nt, Artificial Sequence
  Oligomer
cagaaucugcuuugucuuc

SEQ ID NO: 72376 - RNA, 19 nt, Artificial Sequence
  Oligomer
cugguacaccaccaagaac

SEQ ID NO: 72377 - RNA, 19 nt, Artificial Sequence
  Oligomer
cccacagacuuuuaggcug

SEQ ID NO: 72378 - RNA, 19 nt, Artificial Sequence
  Oligomer
augagcagauccgucacau

SEQ ID NO: 72379 - RNA, 19 nt, Artificial Sequence
  Oligomer
cuucuacucgcaccugaag

SEQ ID NO: 72380 - RNA, 19 nt, Artificial Sequence
  Oligomer
aucugcuuugucuucuacu

SEQ ID NO: 72381 - RNA, 19 nt, Artificial Sequence
  Oligomer
agacuguuccugaccucag

SEQ ID NO: 72382 - RNA, 19 nt, Artificial Sequence
  Oligomer
cccucauuccagaaaugcc

SEQ ID NO: 72383 - RNA, 19 nt, Artificial Sequence
  Oligomer
aucucucucagaaucugcu

SEQ ID NO: 72384 - RNA, 19 nt, Artificial Sequence
  Oligomer
accugggaugacaucacag

SEQ ID NO: 72385 - RNA, 19 nt, Artificial Sequence
  Oligomer
cugcugcagguggaauucu

SEQ ID NO: 72386 - RNA, 19 nt, Artificial Sequence
  Oligomer
cucacagugacacacaacc

SEQ ID NO: 72387 - RNA, 19 nt, Artificial Sequence
  Oligomer
ucucacaacugccucucug

SEQ ID NO: 72388 - RNA, 19 nt, Artificial Sequence
  Oligomer
ucugcuuugucuucuacuc

SEQ ID NO: 72389 - RNA, 19 nt, Artificial Sequence
  Oligomer
caagucucuccagugugug

SEQ ID NO: 72390 - RNA, 19 nt, Artificial Sequence
  Oligomer
ccacagacuuuuaggcugg

SEQ ID NO: 72391 - RNA, 19 nt, Artificial Sequence
  Oligomer
aaucugggagaugccgaga

SEQ ID NO: 72392 - RNA, 19 nt, Artificial Sequence
  Oligomer
ucucucagaaucugcugga

SEQ ID NO: 72393 - RNA, 19 nt, Artificial Sequence
  Oligomer
cuuccucacagugacacac

SEQ ID NO: 72394 - RNA, 19 nt, Artificial Sequence
  Oligomer
ugcugucucacaacugccu

SEQ ID NO: 72395 - RNA, 19 nt, Artificial Sequence
  Oligomer
uugucuucuacucgcaccu

SEQ ID NO: 72396 - RNA, 19 nt, Artificial Sequence
  Oligomer
uccuuggcacccuugaauc

SEQ ID NO: 72397 - RNA, 19 nt, Artificial Sequence
  Oligomer
aauucuugcgucugagcac

SEQ ID NO: 72398 - RNA, 19 nt, Artificial Sequence
  Oligomer
uacucgcaccugaagaaug

SEQ ID NO: 72399 - RNA, 19 nt, Artificial Sequence
  Oligomer
cacagacuuuuaggcuggc

SEQ ID NO: 72400 - RNA, 19 nt, Artificial Sequence
  Oligomer
gauccgucacaugcucuuc

SEQ ID NO: 72401 - RNA, 19 nt, Artificial Sequence
  Oligomer
cuugaaucugggagaugcc

SEQ ID NO: 72402 - RNA, 19 nt, Artificial Sequence
  Oligomer
ugugaaccucaucgcucug

SEQ ID NO: 72403 - RNA, 19 nt, Artificial Sequence
  Oligomer
ucacaacugccucucugag

SEQ ID NO: 72404 - RNA, 19 nt, Artificial Sequence
  Oligomer
agaugcuucagaggauucg

SEQ ID NO: 72405 - RNA, 19 nt, Artificial Sequence
  Oligomer
auccgucacaugcucuucu

SEQ ID NO: 72406 - RNA, 19 nt, Artificial Sequence
  Oligomer
auucuugcgucugagcacu

SEQ ID NO: 72407 - RNA, 19 nt, Artificial Sequence
  Oligomer
cugcuuugucuucuacucg

SEQ ID NO: 72408 - RNA, 19 nt, Artificial Sequence
  Oligomer
auguucgagggcgaagagu

SEQ ID NO: 72409 - RNA, 19 nt, Artificial Sequence
  Oligomer
gaaaugcccagacuguucc

SEQ ID NO: 72410 - RNA, 19 nt, Artificial Sequence
  Oligomer
ucugacacgguggagaugu

SEQ ID NO: 72411 - RNA, 19 nt, Artificial Sequence
  Oligomer
ucuugcugucucacaacug

SEQ ID NO: 72412 - RNA, 19 nt, Artificial Sequence
  Oligomer
ucacaugcucuucuccugg

SEQ ID NO: 72413 - RNA, 19 nt, Artificial Sequence
  Oligomer
gaugacaucacagcucagg

SEQ ID NO: 72414 - RNA, 19 nt, Artificial Sequence
  Oligomer
uccugguuccuugugguuu

SEQ ID NO: 72415 - RNA, 19 nt, Artificial Sequence
  Oligomer
cuuggcacccuugaaucug

SEQ ID NO: 72416 - RNA, 19 nt, Artificial Sequence
  Oligomer
uuccagaaaugcccagacu

SEQ ID NO: 72417 - RNA, 19 nt, Artificial Sequence
  Oligomer
uccagaaaugcccagacug

SEQ ID NO: 72418 - RNA, 19 nt, Artificial Sequence
  Oligomer
aaucugcuggacacgcuac

SEQ ID NO: 72419 - RNA, 19 nt, Artificial Sequence
  Oligomer
cugcagguggaauucuugc

SEQ ID NO: 72420 - RNA, 19 nt, Artificial Sequence
  Oligomer
gaucucucucagaaucugc

SEQ ID NO: 72421 - RNA, 19 nt, Artificial Sequence
  Oligomer
uggaccugagcuucaacag

SEQ ID NO: 72422 - RNA, 19 nt, Artificial Sequence
  Oligomer
ugcuuugucuucuacucgc

SEQ ID NO: 72423 - RNA, 19 nt, Artificial Sequence
  Oligomer
uuuggacagcuuuccugug

SEQ ID NO: 72424 - RNA, 19 nt, Artificial Sequence
  Oligomer
uuggcacccuugaaucugg

SEQ ID NO: 72425 - RNA, 19 nt, Artificial Sequence
  Oligomer
gaccucagauuuggacagc

SEQ ID NO: 72426 - RNA, 19 nt, Artificial Sequence
  Oligomer
ucgaucucucucagaaucu

SEQ ID NO: 72427 - RNA, 19 nt, Artificial Sequence
  Oligomer
aagucucuccagugugugg

SEQ ID NO: 72428 - RNA, 19 nt, Artificial Sequence
  Oligomer
cucgcaccugaagaaugug

SEQ ID NO: 72429 - RNA, 19 nt, Artificial Sequence
  Oligomer
agggcgaagaguucuuugc

SEQ ID NO: 72430 - RNA, 19 nt, Artificial Sequence
  Oligomer
acgcuaccuccugagauug

SEQ ID NO: 72431 - RNA, 19 nt, Artificial Sequence
  Oligomer
caccaccaagaacugugug

SEQ ID NO: 72432 - RNA, 19 nt, Artificial Sequence
  Oligomer
ucauuccagaaaugcccag

SEQ ID NO: 72433 - RNA, 19 nt, Artificial Sequence
  Oligomer
uaggcuggcccagauauuc

SEQ ID NO: 72434 - RNA, 19 nt, Artificial Sequence
  Oligomer
ucacagugacacacaaccg

SEQ ID NO: 72435 - RNA, 19 nt, Artificial Sequence
  Oligomer
ugucuucuacucgcaccug

SEQ ID NO: 72436 - RNA, 19 nt, Artificial Sequence
  Oligomer
accaagaacugugugggag

SEQ ID NO: 72437 - RNA, 19 nt, Artificial Sequence
  Oligomer
gaucuggaugagcagaucc

SEQ ID NO: 72438 - RNA, 19 nt, Artificial Sequence
  Oligomer
uucaagucucuccagugug

SEQ ID NO: 72439 - RNA, 19 nt, Artificial Sequence
  Oligomer
cuucuccugguuccuugug

SEQ ID NO: 72440 - RNA, 19 nt, Artificial Sequence
  Oligomer
cagauuuggacagcuuucc

SEQ ID NO: 72441 - RNA, 19 nt, Artificial Sequence
  Oligomer
auuccagaaaugcccagac

SEQ ID NO: 72442 - RNA, 19 nt, Artificial Sequence
  Oligomer
uuguccugcacagcaaccu

SEQ ID NO: 72443 - RNA, 19 nt, Artificial Sequence
  Oligomer
ucagaaucugcuggacacg

SEQ ID NO: 72444 - RNA, 19 nt, Artificial Sequence
  Oligomer
uucugacgcagagcaaccu

SEQ ID NO: 72445 - RNA, 19 nt, Artificial Sequence
  Oligomer
ugacacgguggagauguuc

SEQ ID NO: 72446 - RNA, 19 nt, Artificial Sequence
  Oligomer
aucaagcugccgagacuuc

SEQ ID NO: 72447 - RNA, 19 nt, Artificial Sequence
  Oligomer
uuucugacgcagagcaacc

SEQ ID NO: 72448 - RNA, 19 nt, Artificial Sequence
  Oligomer
uuccugaccucagauuugg

SEQ ID NO: 72449 - RNA, 19 nt, Artificial Sequence
  Oligomer
uugcugucucacaacugcc

SEQ ID NO: 72450 - RNA, 19 nt, Artificial Sequence
  Oligomer
uucgagggcgaagaguucu

SEQ ID NO: 72451 - RNA, 19 nt, Artificial Sequence
  Oligomer
cugguuccuugugguuucc

SEQ ID NO: 72452 - RNA, 19 nt, Artificial Sequence
  Oligomer
ugcagguggaauucuugcg

SEQ ID NO: 72453 - RNA, 19 nt, Artificial Sequence
  Oligomer
ucucucucagaaucugcug

SEQ ID NO: 72454 - RNA, 19 nt, Artificial Sequence
  Oligomer
uuugucuucuacucgcacc

SEQ ID NO: 72455 - RNA, 19 nt, Artificial Sequence
  Oligomer
gcccucauuccagaaaugc

SEQ ID NO: 72456 - RNA, 19 nt, Artificial Sequence
  Oligomer
cucucucagaaucugcugg

SEQ ID NO: 72457 - RNA, 19 nt, Artificial Sequence
  Oligomer
accuuccucacagugacac

SEQ ID NO: 72458 - RNA, 19 nt, Artificial Sequence
  Oligomer
aucuggaugagcagauccg

SEQ ID NO: 72459 - RNA, 19 nt, Artificial Sequence
  Oligomer
caccugaagaaugugaagg

SEQ ID NO: 72460 - RNA, 19 nt, Artificial Sequence
  Oligomer
uucuugcgucugagcacuc

SEQ ID NO: 72461 - RNA, 19 nt, Artificial Sequence
  Oligomer
aaguaccaggacagcaucc

SEQ ID NO: 72462 - RNA, 19 nt, Artificial Sequence
  Oligomer
uuccgggaugaucuggaug

SEQ ID NO: 72463 - RNA, 19 nt, Artificial Sequence
  Oligomer
accaccaagaacugugugg

SEQ ID NO: 72464 - RNA, 19 nt, Artificial Sequence
  Oligomer
uucaacagccuggagacac

SEQ ID NO: 72465 - RNA, 19 nt, Artificial Sequence
  Oligomer
uucuccugguuccuugugg

SEQ ID NO: 72466 - RNA, 19 nt, Artificial Sequence
  Oligomer
uaccuccugagauuggagg

SEQ ID NO: 72467 - RNA, 19 nt, Artificial Sequence
  Oligomer
uugaaucugggagaugccg

SEQ ID NO: 72468 - RNA, 19 nt, Artificial Sequence
  Oligomer
uacaccaccaagaacugug

SEQ ID NO: 72469 - RNA, 19 nt, Artificial Sequence
  Oligomer
acagacuuuuaggcuggcc

SEQ ID NO: 72470 - RNA, 19 nt, Artificial Sequence
  Oligomer
ugucucacaacugccucuc

SEQ ID NO: 72471 - RNA, 19 nt, Artificial Sequence
  Oligomer
aaugcccagacuguuccug

SEQ ID NO: 72472 - RNA, 19 nt, Artificial Sequence
  Oligomer
ugguuccuugugguuuccc

SEQ ID NO: 72473 - RNA, 19 nt, Artificial Sequence
  Oligomer
uugucauuccggguccuga

SEQ ID NO: 72474 - RNA, 19 nt, Artificial Sequence
  Oligomer
uagcguguccagcagauuc

SEQ ID NO: 72475 - RNA, 19 nt, Artificial Sequence
  Oligomer
uucaggugcgaguagaaga

SEQ ID NO: 72476 - RNA, 19 nt, Artificial Sequence
  Oligomer
ugugucacugugaggaagg

SEQ ID NO: 72477 - RNA, 19 nt, Artificial Sequence
  Oligomer
ucgaaggccgcaaagaacu

SEQ ID NO: 72478 - RNA, 19 nt, Artificial Sequence
  Oligomer
uggagagacuugaaggugg

SEQ ID NO: 72479 - RNA, 19 nt, Artificial Sequence
  Oligomer
aucugggccagccuaaaag

SEQ ID NO: 72480 - RNA, 19 nt, Artificial Sequence
  Oligomer
uucuuggugguguaccaga

SEQ ID NO: 72481 - RNA, 19 nt, Artificial Sequence
  Oligomer
caagaauuccaccugcagc

SEQ ID NO: 72482 - RNA, 19 nt, Artificial Sequence
  Oligomer
uccucugaagcaucuccug

SEQ ID NO: 72483 - RNA, 19 nt, Artificial Sequence
  Oligomer
uugcugugcaggacaagga

SEQ ID NO: 72484 - RNA, 19 nt, Artificial Sequence
  Oligomer
uucaagggugccaaggaga

SEQ ID NO: 72485 - RNA, 19 nt, Artificial Sequence
  Oligomer
agaucaucccggaacucgu

SEQ ID NO: 72486 - RNA, 19 nt, Artificial Sequence
  Oligomer
ucccacacaguucuuggug

SEQ ID NO: 72487 - RNA, 19 nt, Artificial Sequence
  Oligomer
agauucaagggugccaagg

SEQ ID NO: 72488 - RNA, 19 nt, Artificial Sequence
  Oligomer
ucagagaggcaguugugag

SEQ ID NO: 72489 - RNA, 19 nt, Artificial Sequence
  Oligomer
ugggccagccuaaaagucu

SEQ ID NO: 72490 - RNA, 19 nt, Artificial Sequence
  Oligomer
aacucuucgcccucgaaca

SEQ ID NO: 72491 - RNA, 19 nt, Artificial Sequence
  Oligomer
caugugacggaucugcuca

SEQ ID NO: 72492 - RNA, 19 nt, Artificial Sequence
  Oligomer
ugucacugugaggaaggug

SEQ ID NO: 72493 - RNA, 19 nt, Artificial Sequence
  Oligomer
cacuggagagacuugaagg

SEQ ID NO: 72494 - RNA, 19 nt, Artificial Sequence
  Oligomer
uaucugggccagccuaaaa

SEQ ID NO: 72495 - RNA, 19 nt, Artificial Sequence
  Oligomer
ucggcaucucccagauuca

SEQ ID NO: 72496 - RNA, 19 nt, Artificial Sequence
  Oligomer
aagcagauucugcccucca

SEQ ID NO: 72497 - RNA, 19 nt, Artificial Sequence
  Oligomer
ucugggccagccuaaaagu

SEQ ID NO: 72498 - RNA, 19 nt, Artificial Sequence
  Oligomer
aggagaagagcaugugacg

SEQ ID NO: 72499 - RNA, 19 nt, Artificial Sequence
  Oligomer
aagucucggcagcuugaug

SEQ ID NO: 72500 - RNA, 19 nt, Artificial Sequence
  Oligomer
caaagaacucuucgcccuc

SEQ ID NO: 72501 - RNA, 19 nt, Artificial Sequence
  Oligomer
uccaaaucugaggucagga

SEQ ID NO: 72502 - RNA, 19 nt, Artificial Sequence
  Oligomer
ugggcauuucuggaaugag

SEQ ID NO: 72503 - RNA, 19 nt, Artificial Sequence
  Oligomer
guugugugucacugugagg

SEQ ID NO: 72504 - RNA, 19 nt, Artificial Sequence
  Oligomer
gaugcuguccugguacuug

SEQ ID NO: 72505 - RNA, 19 nt, Artificial Sequence
  Oligomer
ugguguaccagagccagua

SEQ ID NO: 72506 - RNA, 19 nt, Artificial Sequence
  Oligomer
acaaggaaccaggagaagu

SEQ ID NO: 72507 - RNA, 19 nt, Artificial Sequence
  Oligomer
uccgaauccucugaagcau

SEQ ID NO: 72508 - RNA, 19 nt, Artificial Sequence
  Oligomer
ugagugcucagacgcaaga

SEQ ID NO: 72509 - RNA, 19 nt, Artificial Sequence
  Oligomer
ugaggucaggaacagucug

SEQ ID NO: 72510 - RNA, 19 nt, Artificial Sequence
  Oligomer
agauucugcccuccacaca

SEQ ID NO: 72511 - RNA, 19 nt, Artificial Sequence
  Oligomer
acggaucugcucauccaga

SEQ ID NO: 72512 - RNA, 19 nt, Artificial Sequence
  Oligomer
accaccugagcugugaugu

SEQ ID NO: 72513 - RNA, 19 nt, Artificial Sequence
  Oligomer
agagaggcaguugugagac

SEQ ID NO: 72514 - RNA, 19 nt, Artificial Sequence
  Oligomer
cuggagagacuugaaggug

SEQ ID NO: 72515 - RNA, 19 nt, Artificial Sequence
  Oligomer
ucugcucauccagaucauc

SEQ ID NO: 72516 - RNA, 19 nt, Artificial Sequence
  Oligomer
ugcucagacgcaagaauuc

SEQ ID NO: 72517 - RNA, 19 nt, Artificial Sequence
  Oligomer
gcucagacgcaagaauucc

SEQ ID NO: 72518 - RNA, 19 nt, Artificial Sequence
  Oligomer
caguucuuggugguguacc

SEQ ID NO: 72519 - RNA, 19 nt, Artificial Sequence
  Oligomer
agcugugaugucaucccag

SEQ ID NO: 72520 - RNA, 19 nt, Artificial Sequence
  Oligomer
agcuguugucauuccgggu

SEQ ID NO: 72521 - RNA, 19 nt, Artificial Sequence
  Oligomer
ugcguccgaauccucugaa

SEQ ID NO: 72522 - RNA, 19 nt, Artificial Sequence
  Oligomer
ugacggaucugcucaucca

SEQ ID NO: 72523 - RNA, 19 nt, Artificial Sequence
  Oligomer
accugagcugugaugucau

SEQ ID NO: 72524 - RNA, 19 nt, Artificial Sequence
  Oligomer
uccagaucaucccggaacu

SEQ ID NO: 72525 - RNA, 19 nt, Artificial Sequence
  Oligomer
guugcucugcgucagaaag

SEQ ID NO: 72526 - RNA, 19 nt, Artificial Sequence
  Oligomer
ucuucaggugcgaguagaa

SEQ ID NO: 72527 - RNA, 19 nt, Artificial Sequence
  Oligomer
agaggcaguugugagacag

SEQ ID NO: 72528 - RNA, 19 nt, Artificial Sequence
  Oligomer
uguccaaaucugaggucag

SEQ ID NO: 72529 - RNA, 19 nt, Artificial Sequence
  Oligomer
aaaucugaggucaggaaca

SEQ ID NO: 72530 - RNA, 19 nt, Artificial Sequence
  Oligomer
acuggagagacuugaaggu

SEQ ID NO: 72531 - RNA, 19 nt, Artificial Sequence
  Oligomer
gugcgaguagaagacaaag

SEQ ID NO: 72532 - RNA, 19 nt, Artificial Sequence
  Oligomer
uguugucauuccggguccu

SEQ ID NO: 72533 - RNA, 19 nt, Artificial Sequence
  Oligomer
ccgaauccucugaagcauc

SEQ ID NO: 72534 - RNA, 19 nt, Artificial Sequence
  Oligomer
auaucugggccagccuaaa

SEQ ID NO: 72535 - RNA, 19 nt, Artificial Sequence
  Oligomer
agagcaugugacggaucug

SEQ ID NO: 72536 - RNA, 19 nt, Artificial Sequence
  Oligomer
ugucuccaggcuguugaag

SEQ ID NO: 72537 - RNA, 19 nt, Artificial Sequence
  Oligomer
agcaugugacggaucugcu

SEQ ID NO: 72538 - RNA, 19 nt, Artificial Sequence
  Oligomer
ucugggcauuucuggaaug

SEQ ID NO: 72539 - RNA, 19 nt, Artificial Sequence
  Oligomer
gucacugugaggaagguga

SEQ ID NO: 72540 - RNA, 19 nt, Artificial Sequence
  Oligomer
guugugagacagcaagagc

SEQ ID NO: 72541 - RNA, 19 nt, Artificial Sequence
  Oligomer
ucuccaggcuguugaagcu

SEQ ID NO: 72542 - RNA, 19 nt, Artificial Sequence
  Oligomer
aggaaagcuguccaaaucu

SEQ ID NO: 72543 - RNA, 19 nt, Artificial Sequence
  Oligomer
caaaucugaggucaggaac

SEQ ID NO: 72544 - RNA, 19 nt, Artificial Sequence
  Oligomer
gggcauuucuggaaugagg

SEQ ID NO: 72545 - RNA, 19 nt, Artificial Sequence
  Oligomer
guccgaauccucugaagca

SEQ ID NO: 72546 - RNA, 19 nt, Artificial Sequence
  Oligomer
ucacugugaggaaggugag

SEQ ID NO: 72547 - RNA, 19 nt, Artificial Sequence
  Oligomer
gcaguugugagacagcaag

SEQ ID NO: 72548 - RNA, 19 nt, Artificial Sequence
  Oligomer
aauaucugggccagccuaa

SEQ ID NO: 72549 - RNA, 19 nt, Artificial Sequence
  Oligomer
accacaaggaaccaggaga

SEQ ID NO: 72550 - RNA, 19 nt, Artificial Sequence
  Oligomer
acaggaaagcuguccaaau

SEQ ID NO: 72551 - RNA, 19 nt, Artificial Sequence
  Oligomer
aggaacagucugggcauuu

SEQ ID NO: 72552 - RNA, 19 nt, Artificial Sequence
  Oligomer
ugugugucacugugaggaa

SEQ ID NO: 72553 - RNA, 19 nt, Artificial Sequence
  Oligomer
gcaucucccagauucaagg

SEQ ID NO: 72554 - RNA, 19 nt, Artificial Sequence
  Oligomer
ccuccuucacauucuucag

SEQ ID NO: 72555 - RNA, 19 nt, Artificial Sequence
  Oligomer
cagacgcaagaauuccacc

SEQ ID NO: 72556 - RNA, 19 nt, Artificial Sequence
  Oligomer
ucacaggaaagcuguccaa

SEQ ID NO: 72557 - RNA, 19 nt, Artificial Sequence
  Oligomer
caggaaagcuguccaaauc

SEQ ID NO: 72558 - RNA, 19 nt, Artificial Sequence
  Oligomer
gaaagcuguccaaaucuga

SEQ ID NO: 72559 - RNA, 19 nt, Artificial Sequence
  Oligomer
aucugaggucaggaacagu

SEQ ID NO: 72560 - RNA, 19 nt, Artificial Sequence
  Oligomer
ucaggaacagucugggcau

SEQ ID NO: 72561 - RNA, 19 nt, Artificial Sequence
  Oligomer
cuccaaucucaggagguag

SEQ ID NO: 72562 - RNA, 19 nt, Artificial Sequence
  Oligomer
uguccagcagauucugaga

SEQ ID NO: 72563 - RNA, 19 nt, Artificial Sequence
  Oligomer
gaagacaaagcagauucug

SEQ ID NO: 72564 - RNA, 19 nt, Artificial Sequence
  Oligomer
guucuuggugguguaccag

SEQ ID NO: 72565 - RNA, 19 nt, Artificial Sequence
  Oligomer
cagccuaaaagucuguggg

SEQ ID NO: 72566 - RNA, 19 nt, Artificial Sequence
  Oligomer
augugacggaucugcucau

SEQ ID NO: 72567 - RNA, 19 nt, Artificial Sequence
  Oligomer
cuucaggugcgaguagaag

SEQ ID NO: 72568 - RNA, 19 nt, Artificial Sequence
  Oligomer
aguagaagacaaagcagau

SEQ ID NO: 72569 - RNA, 19 nt, Artificial Sequence
  Oligomer
cugaggucaggaacagucu

SEQ ID NO: 72570 - RNA, 19 nt, Artificial Sequence
  Oligomer
ggcauuucuggaaugaggg

SEQ ID NO: 72571 - RNA, 19 nt, Artificial Sequence
  Oligomer
agcagauucugagagagau

SEQ ID NO: 72572 - RNA, 19 nt, Artificial Sequence
  Oligomer
cugugaugucaucccaggu

SEQ ID NO: 72573 - RNA, 19 nt, Artificial Sequence
  Oligomer
agaauuccaccugcagcag

SEQ ID NO: 72574 - RNA, 19 nt, Artificial Sequence
  Oligomer
gguugugugucacugugag

SEQ ID NO: 72575 - RNA, 19 nt, Artificial Sequence
  Oligomer
cagagaggcaguugugaga

SEQ ID NO: 72576 - RNA, 19 nt, Artificial Sequence
  Oligomer
gaguagaagacaaagcaga

SEQ ID NO: 72577 - RNA, 19 nt, Artificial Sequence
  Oligomer
cacacacuggagagacuug

SEQ ID NO: 72578 - RNA, 19 nt, Artificial Sequence
  Oligomer
ccagccuaaaagucugugg

SEQ ID NO: 72579 - RNA, 19 nt, Artificial Sequence
  Oligomer
ucucggcaucucccagauu

SEQ ID NO: 72580 - RNA, 19 nt, Artificial Sequence
  Oligomer
uccagcagauucugagaga

SEQ ID NO: 72581 - RNA, 19 nt, Artificial Sequence
  Oligomer
gugugucacugugaggaag

SEQ ID NO: 72582 - RNA, 19 nt, Artificial Sequence
  Oligomer
aggcaguugugagacagca

SEQ ID NO: 72583 - RNA, 19 nt, Artificial Sequence
  Oligomer
aggugcgaguagaagacaa

SEQ ID NO: 72584 - RNA, 19 nt, Artificial Sequence
  Oligomer
gauucaagggugccaagga

SEQ ID NO: 72585 - RNA, 19 nt, Artificial Sequence
  Oligomer
gugcucagacgcaagaauu

SEQ ID NO: 72586 - RNA, 19 nt, Artificial Sequence
  Oligomer
cauucuucaggugcgagua

SEQ ID NO: 72587 - RNA, 19 nt, Artificial Sequence
  Oligomer
gccagccuaaaagucugug

SEQ ID NO: 72588 - RNA, 19 nt, Artificial Sequence
  Oligomer
gaagagcaugugacggauc

SEQ ID NO: 72589 - RNA, 19 nt, Artificial Sequence
  Oligomer
ggcaucucccagauucaag

SEQ ID NO: 72590 - RNA, 19 nt, Artificial Sequence
  Oligomer
cagagcgaugagguucaca

SEQ ID NO: 72591 - RNA, 19 nt, Artificial Sequence
  Oligomer
cucagagaggcaguuguga

SEQ ID NO: 72592 - RNA, 19 nt, Artificial Sequence
  Oligomer
cgaauccucugaagcaucu

SEQ ID NO: 72593 - RNA, 19 nt, Artificial Sequence
  Oligomer
agaagagcaugugacggau

SEQ ID NO: 72594 - RNA, 19 nt, Artificial Sequence
  Oligomer
agugcucagacgcaagaau

SEQ ID NO: 72595 - RNA, 19 nt, Artificial Sequence
  Oligomer
cgaguagaagacaaagcag

SEQ ID NO: 72596 - RNA, 19 nt, Artificial Sequence
  Oligomer
acucuucgcccucgaacau

SEQ ID NO: 72597 - RNA, 19 nt, Artificial Sequence
  Oligomer
ggaacagucugggcauuuc

SEQ ID NO: 72598 - RNA, 19 nt, Artificial Sequence
  Oligomer
acaucuccaccgugucaga

SEQ ID NO: 72599 - RNA, 19 nt, Artificial Sequence
  Oligomer
caguugugagacagcaaga

SEQ ID NO: 72600 - RNA, 19 nt, Artificial Sequence
  Oligomer
ccaggagaagagcauguga

SEQ ID NO: 72601 - RNA, 19 nt, Artificial Sequence
  Oligomer
ccugagcugugaugucauc

SEQ ID NO: 72602 - RNA, 19 nt, Artificial Sequence
  Oligomer
aaaccacaaggaaccagga

SEQ ID NO: 72603 - RNA, 19 nt, Artificial Sequence
  Oligomer
cagauucaagggugccaag

SEQ ID NO: 72604 - RNA, 19 nt, Artificial Sequence
  Oligomer
agucugggcauuucuggaa

SEQ ID NO: 72605 - RNA, 19 nt, Artificial Sequence
  Oligomer
cagucugggcauuucugga

SEQ ID NO: 72606 - RNA, 19 nt, Artificial Sequence
  Oligomer
guagcguguccagcagauu

SEQ ID NO: 72607 - RNA, 19 nt, Artificial Sequence
  Oligomer
gcaagaauuccaccugcag

SEQ ID NO: 72608 - RNA, 19 nt, Artificial Sequence
  Oligomer
gcagauucugagagagauc

SEQ ID NO: 72609 - RNA, 19 nt, Artificial Sequence
  Oligomer
cuguugaagcucaggucca

SEQ ID NO: 72610 - RNA, 19 nt, Artificial Sequence
  Oligomer
gcgaguagaagacaaagca

SEQ ID NO: 72611 - RNA, 19 nt, Artificial Sequence
  Oligomer
cacaggaaagcuguccaaa

SEQ ID NO: 72612 - RNA, 19 nt, Artificial Sequence
  Oligomer
ccagauucaagggugccaa

SEQ ID NO: 72613 - RNA, 19 nt, Artificial Sequence
  Oligomer
gcuguccaaaucugagguc

SEQ ID NO: 72614 - RNA, 19 nt, Artificial Sequence
  Oligomer
agauucugagagagaucga

SEQ ID NO: 72615 - RNA, 19 nt, Artificial Sequence
  Oligomer
ccacacacuggagagacuu

SEQ ID NO: 72616 - RNA, 19 nt, Artificial Sequence
  Oligomer
cacauucuucaggugcgag

SEQ ID NO: 72617 - RNA, 19 nt, Artificial Sequence
  Oligomer
gcaaagaacucuucgcccu

SEQ ID NO: 72618 - RNA, 19 nt, Artificial Sequence
  Oligomer
caaucucaggagguagcgu

SEQ ID NO: 72619 - RNA, 19 nt, Artificial Sequence
  Oligomer
cacacaguucuugguggug

SEQ ID NO: 72620 - RNA, 19 nt, Artificial Sequence
  Oligomer
cugggcauuucuggaauga

SEQ ID NO: 72621 - RNA, 19 nt, Artificial Sequence
  Oligomer
gaauaucugggccagccua

SEQ ID NO: 72622 - RNA, 19 nt, Artificial Sequence
  Oligomer
cgguugugugucacuguga

SEQ ID NO: 72623 - RNA, 19 nt, Artificial Sequence
  Oligomer
caggugcgaguagaagaca

SEQ ID NO: 72624 - RNA, 19 nt, Artificial Sequence
  Oligomer
cucccacacaguucuuggu

SEQ ID NO: 72625 - RNA, 19 nt, Artificial Sequence
  Oligomer
ggaucugcucauccagauc

SEQ ID NO: 72626 - RNA, 19 nt, Artificial Sequence
  Oligomer
cacacuggagagacuugaa

SEQ ID NO: 72627 - RNA, 19 nt, Artificial Sequence
  Oligomer
cacaaggaaccaggagaag

SEQ ID NO: 72628 - RNA, 19 nt, Artificial Sequence
  Oligomer
ggaaagcuguccaaaucug

SEQ ID NO: 72629 - RNA, 19 nt, Artificial Sequence
  Oligomer
gucugggcauuucuggaau

SEQ ID NO: 72630 - RNA, 19 nt, Artificial Sequence
  Oligomer
agguugcugugcaggacaa

SEQ ID NO: 72631 - RNA, 19 nt, Artificial Sequence
  Oligomer
cguguccagcagauucuga

SEQ ID NO: 72632 - RNA, 19 nt, Artificial Sequence
  Oligomer
agguugcucugcgucagaa

SEQ ID NO: 72633 - RNA, 19 nt, Artificial Sequence
  Oligomer
gaacaucuccaccguguca

SEQ ID NO: 72634 - RNA, 19 nt, Artificial Sequence
  Oligomer
gaagucucggcagcuugau

SEQ ID NO: 72635 - RNA, 19 nt, Artificial Sequence
  Oligomer
gguugcucugcgucagaaa

SEQ ID NO: 72636 - RNA, 19 nt, Artificial Sequence
  Oligomer
ccaaaucugaggucaggaa

SEQ ID NO: 72637 - RNA, 19 nt, Artificial Sequence
  Oligomer
ggcaguugugagacagcaa

SEQ ID NO: 72638 - RNA, 19 nt, Artificial Sequence
  Oligomer
agaacucuucgcccucgaa

SEQ ID NO: 72639 - RNA, 19 nt, Artificial Sequence
  Oligomer
ggaaaccacaaggaaccag

SEQ ID NO: 72640 - RNA, 19 nt, Artificial Sequence
  Oligomer
cgcaagaauuccaccugca

SEQ ID NO: 72641 - RNA, 19 nt, Artificial Sequence
  Oligomer
cagcagauucugagagaga

SEQ ID NO: 72642 - RNA, 19 nt, Artificial Sequence
  Oligomer
ggugcgaguagaagacaaa

SEQ ID NO: 72643 - RNA, 19 nt, Artificial Sequence
  Oligomer
gcauuucuggaaugagggc

SEQ ID NO: 72644 - RNA, 19 nt, Artificial Sequence
  Oligomer
ccagcagauucugagagag

SEQ ID NO: 72645 - RNA, 19 nt, Artificial Sequence
  Oligomer
gugucacugugaggaaggu

SEQ ID NO: 72646 - RNA, 19 nt, Artificial Sequence
  Oligomer
cggaucugcucauccagau

SEQ ID NO: 72647 - RNA, 19 nt, Artificial Sequence
  Oligomer
ccuucacauucuucaggug

SEQ ID NO: 72648 - RNA, 19 nt, Artificial Sequence
  Oligomer
gagugcucagacgcaagaa

SEQ ID NO: 72649 - RNA, 19 nt, Artificial Sequence
  Oligomer
ggaugcuguccugguacuu

SEQ ID NO: 72650 - RNA, 19 nt, Artificial Sequence
  Oligomer
cauccagaucaucccggaa

SEQ ID NO: 72651 - RNA, 19 nt, Artificial Sequence
  Oligomer
ccacacaguucuugguggu

SEQ ID NO: 72652 - RNA, 19 nt, Artificial Sequence
  Oligomer
gugucuccaggcuguugaa

SEQ ID NO: 72653 - RNA, 19 nt, Artificial Sequence
  Oligomer
ccacaaggaaccaggagaa

SEQ ID NO: 72654 - RNA, 19 nt, Artificial Sequence
  Oligomer
ccuccaaucucaggaggua

SEQ ID NO: 72655 - RNA, 19 nt, Artificial Sequence
  Oligomer
cggcaucucccagauucaa

SEQ ID NO: 72656 - RNA, 19 nt, Artificial Sequence
  Oligomer
cacaguucuugguggugua

SEQ ID NO: 72657 - RNA, 19 nt, Artificial Sequence
  Oligomer
ggccagccuaaaagucugu

SEQ ID NO: 72658 - RNA, 19 nt, Artificial Sequence
  Oligomer
gagaggcaguugugagaca

SEQ ID NO: 72659 - RNA, 19 nt, Artificial Sequence
  Oligomer
caggaacagucugggcauu

SEQ ID NO: 72660 - RNA, 19 nt, Artificial Sequence
  Oligomer
gggaaaccacaaggaacca

SEQ ID NO: 72661 - RNA, 21 nt, Artificial Sequence
  Oligomer
cuuccucacagugacacacaa

SEQ ID NO: 72662 - RNA, 21 nt, Artificial Sequence
  Oligomer
guuccugaccucagauuugga

SEQ ID NO: 72663 - RNA, 21 nt, Artificial Sequence
  Oligomer
acuuuuaggcuggcccagaua

SEQ ID NO: 72664 - RNA, 21 nt, Artificial Sequence
  Oligomer
cuugaaucugggagaugccga

SEQ ID NO: 72665 - RNA, 21 nt, Artificial Sequence
  Oligomer
agguggaauucuugcgucuga

SEQ ID NO: 72666 - RNA, 21 nt, Artificial Sequence
  Oligomer
agaugcuucagaggauucgga

SEQ ID NO: 72667 - RNA, 21 nt, Artificial Sequence
  Oligomer
cuuuuaggcuggcccagauau

SEQ ID NO: 72668 - RNA, 21 nt, Artificial Sequence
  Oligomer
ugagcuucaacagccuggaga

SEQ ID NO: 72669 - RNA, 21 nt, Artificial Sequence
  Oligomer
ucuggaugagcagauccguca

SEQ ID NO: 72670 - RNA, 21 nt, Artificial Sequence
  Oligomer
ccaccuucaagucucuccagu

SEQ ID NO: 72671 - RNA, 21 nt, Artificial Sequence
  Oligomer
ccugaagaaugugaaggaggu

SEQ ID NO: 72672 - RNA, 21 nt, Artificial Sequence
  Oligomer
cagacuguuccugaccucaga

SEQ ID NO: 72673 - RNA, 21 nt, Artificial Sequence
  Oligomer
gacuuuuaggcuggcccagau

SEQ ID NO: 72674 - RNA, 21 nt, Artificial Sequence
  Oligomer
agaguucuuugcggccuucga

SEQ ID NO: 72675 - RNA, 21 nt, Artificial Sequence
  Oligomer
ccuucaagucucuccagugug

SEQ ID NO: 72676 - RNA, 21 nt, Artificial Sequence
  Oligomer
agauguucgagggcgaagagu

SEQ ID NO: 72677 - RNA, 21 nt, Artificial Sequence
  Oligomer
agacuuuuaggcuggcccaga

SEQ ID NO: 72678 - RNA, 21 nt, Artificial Sequence
  Oligomer
cuucuacucgcaccugaagaa

SEQ ID NO: 72679 - RNA, 21 nt, Artificial Sequence
  Oligomer
gauguucgagggcgaagaguu

SEQ ID NO: 72680 - RNA, 21 nt, Artificial Sequence
  Oligomer
accuggaccugagcuucaaca

SEQ ID NO: 72681 - RNA, 21 nt, Artificial Sequence
  Oligomer
uugucuucuacucgcaccuga

SEQ ID NO: 72682 - RNA, 21 nt, Artificial Sequence
  Oligomer
uguggagggcagaaucugcuu

SEQ ID NO: 72683 - RNA, 21 nt, Artificial Sequence
  Oligomer
ucaggacccggaaugacaaca

SEQ ID NO: 72684 - RNA, 21 nt, Artificial Sequence
  Oligomer
uggcagcccucauuccagaaa

SEQ ID NO: 72685 - RNA, 21 nt, Artificial Sequence
  Oligomer
gaugcuucagaggauucggac

SEQ ID NO: 72686 - RNA, 21 nt, Artificial Sequence
  Oligomer
gggaugaucuggaugagcaga

SEQ ID NO: 72687 - RNA, 21 nt, Artificial Sequence
  Oligomer
guucgagggcgaagaguucuu

SEQ ID NO: 72688 - RNA, 21 nt, Artificial Sequence
  Oligomer
guuccgggaugaucuggauga

SEQ ID NO: 72689 - RNA, 21 nt, Artificial Sequence
  Oligomer
cuucaagucucuccagugugu

SEQ ID NO: 72690 - RNA, 21 nt, Artificial Sequence
  Oligomer
ucuucuacucgcaccugaaga

SEQ ID NO: 72691 - RNA, 21 nt, Artificial Sequence
  Oligomer
guggaauucuugcgucugagc

SEQ ID NO: 72692 - RNA, 21 nt, Artificial Sequence
  Oligomer
ccucauuccagaaaugcccag

SEQ ID NO: 72693 - RNA, 21 nt, Artificial Sequence
  Oligomer
cucaccuuccucacagugaca

SEQ ID NO: 72694 - RNA, 21 nt, Artificial Sequence
  Oligomer
uuggcacccuugaaucuggga

SEQ ID NO: 72695 - RNA, 21 nt, Artificial Sequence
  Oligomer
agggcagaaucugcuuugucu

SEQ ID NO: 72696 - RNA, 21 nt, Artificial Sequence
  Oligomer
cuucaacagccuggagacacu

SEQ ID NO: 72697 - RNA, 21 nt, Artificial Sequence
  Oligomer
accugaagaaugugaaggagg

SEQ ID NO: 72698 - RNA, 21 nt, Artificial Sequence
  Oligomer
acucgcaccugaagaauguga

SEQ ID NO: 72699 - RNA, 21 nt, Artificial Sequence
  Oligomer
ugacacgguggagauguucga

SEQ ID NO: 72700 - RNA, 21 nt, Artificial Sequence
  Oligomer
ucucucagaaucugcuggaca

SEQ ID NO: 72701 - RNA, 21 nt, Artificial Sequence
  Oligomer
cuuugucuucuacucgcaccu

SEQ ID NO: 72702 - RNA, 21 nt, Artificial Sequence
  Oligomer
acuguguggagggcagaaucu

SEQ ID NO: 72703 - RNA, 21 nt, Artificial Sequence
  Oligomer
ugacaucacagcucagguggu

SEQ ID NO: 72704 - RNA, 21 nt, Artificial Sequence
  Oligomer
ccucagauuuggacagcuuuc

SEQ ID NO: 72705 - RNA, 21 nt, Artificial Sequence
  Oligomer
agauccgucacaugcucuucu

SEQ ID NO: 72706 - RNA, 21 nt, Artificial Sequence
  Oligomer
uggaugagcagauccgucaca

SEQ ID NO: 72707 - RNA, 21 nt, Artificial Sequence
  Oligomer
cuacucgcaccugaagaaugu

SEQ ID NO: 72708 - RNA, 21 nt, Artificial Sequence
  Oligomer
ugugaaccucaucgcucugca

SEQ ID NO: 72709 - RNA, 21 nt, Artificial Sequence
  Oligomer
ggagaugcuucagaggauucg

SEQ ID NO: 72710 - RNA, 21 nt, Artificial Sequence
  Oligomer
ugagcagauccgucacaugcu

SEQ ID NO: 72711 - RNA, 21 nt, Artificial Sequence
  Oligomer
cuugcugucucacaacugccu

SEQ ID NO: 72712 - RNA, 21 nt, Artificial Sequence
  Oligomer
aaaugcccagacuguuccuga

SEQ ID NO: 72713 - RNA, 21 nt, Artificial Sequence
  Oligomer
aaguaccaggacagcauccga

SEQ ID NO: 72714 - RNA, 21 nt, Artificial Sequence
  Oligomer
guggagggcagaaucugcuuu

SEQ ID NO: 72715 - RNA, 21 nt, Artificial Sequence
  Oligomer
cagauuuggacagcuuuccug

SEQ ID NO: 72716 - RNA, 21 nt, Artificial Sequence
  Oligomer
uggaauucuugcgucugagca

SEQ ID NO: 72717 - RNA, 21 nt, Artificial Sequence
  Oligomer
uguucgagggcgaagaguucu

SEQ ID NO: 72718 - RNA, 21 nt, Artificial Sequence
  Oligomer
auuuggacagcuuuccuguga

SEQ ID NO: 72719 - RNA, 21 nt, Artificial Sequence
  Oligomer
uccugaccucagauuuggaca

SEQ ID NO: 72720 - RNA, 21 nt, Artificial Sequence
  Oligomer
uuuuaggcuggcccagauauu

SEQ ID NO: 72721 - RNA, 21 nt, Artificial Sequence
  Oligomer
ucuacucgcaccugaagaaug

SEQ ID NO: 72722 - RNA, 21 nt, Artificial Sequence
  Oligomer
ucugguacaccaccaagaacu

SEQ ID NO: 72723 - RNA, 21 nt, Artificial Sequence
  Oligomer
cucugguacaccaccaagaac

SEQ ID NO: 72724 - RNA, 21 nt, Artificial Sequence
  Oligomer
aauucuugcgucugagcacuc

SEQ ID NO: 72725 - RNA, 21 nt, Artificial Sequence
  Oligomer
ucgagggcgaagaguucuuug

SEQ ID NO: 72726 - RNA, 21 nt, Artificial Sequence
  Oligomer
cauuccagaaaugcccagacu

SEQ ID NO: 72727 - RNA, 21 nt, Artificial Sequence
  Oligomer
agaaucugcuggacacgcuac

SEQ ID NO: 72728 - RNA, 21 nt, Artificial Sequence
  Oligomer
gaugagcagauccgucacaug

SEQ ID NO: 72729 - RNA, 21 nt, Artificial Sequence
  Oligomer
acgcuaccuccugagauugga

SEQ ID NO: 72730 - RNA, 21 nt, Artificial Sequence
  Oligomer
aguuccgggaugaucuggaug

SEQ ID NO: 72731 - RNA, 21 nt, Artificial Sequence
  Oligomer
cuuucugacgcagagcaaccu

SEQ ID NO: 72732 - RNA, 21 nt, Artificial Sequence
  Oligomer
gguacaccaccaagaacugug

SEQ ID NO: 72733 - RNA, 21 nt, Artificial Sequence
  Oligomer
gauuuggacagcuuuccugug

SEQ ID NO: 72734 - RNA, 21 nt, Artificial Sequence
  Oligomer
uggagggcagaaucugcuuug

SEQ ID NO: 72735 - RNA, 21 nt, Artificial Sequence
  Oligomer
aagaguucuuugcggccuucg

SEQ ID NO: 72736 - RNA, 21 nt, Artificial Sequence
  Oligomer
ugcugucucacaacugccucu

SEQ ID NO: 72737 - RNA, 21 nt, Artificial Sequence
  Oligomer
acagacuuuuaggcuggccca

SEQ ID NO: 72738 - RNA, 21 nt, Artificial Sequence
  Oligomer
gauccgucacaugcucuucuc

SEQ ID NO: 72739 - RNA, 21 nt, Artificial Sequence
  Oligomer
gcuuugucuucuacucgcacc

SEQ ID NO: 72740 - RNA, 21 nt, Artificial Sequence
  Oligomer
cacuucuccugguuccuugug

SEQ ID NO: 72741 - RNA, 21 nt, Artificial Sequence
  Oligomer
auuccagaaaugcccagacug

SEQ ID NO: 72742 - RNA, 21 nt, Artificial Sequence
  Oligomer
agcugcugcagguggaauucu

SEQ ID NO: 72743 - RNA, 21 nt, Artificial Sequence
  Oligomer
cucucagaaucugcuggacac

SEQ ID NO: 72744 - RNA, 21 nt, Artificial Sequence
  Oligomer
aucaagcugccgagacuucga

SEQ ID NO: 72745 - RNA, 21 nt, Artificial Sequence
  Oligomer
accaccaagaacuguguggga

SEQ ID NO: 72746 - RNA, 21 nt, Artificial Sequence
  Oligomer
ucagaaucugcuggacacgcu

SEQ ID NO: 72747 - RNA, 21 nt, Artificial Sequence
  Oligomer
uccgucacaugcucuucuccu

SEQ ID NO: 72748 - RNA, 21 nt, Artificial Sequence
  Oligomer
gucuucuacucgcaccugaag

SEQ ID NO: 72749 - RNA, 21 nt, Artificial Sequence
  Oligomer
ucucucucagaaucugcugga

SEQ ID NO: 72750 - RNA, 21 nt, Artificial Sequence
  Oligomer
caccuucaagucucuccagug

SEQ ID NO: 72751 - RNA, 21 nt, Artificial Sequence
  Oligomer
auucuugcgucugagcacuca

SEQ ID NO: 72752 - RNA, 21 nt, Artificial Sequence
  Oligomer
ugaaucugggagaugccgaga

SEQ ID NO: 72753 - RNA, 21 nt, Artificial Sequence
  Oligomer
cuccuuggcacccuugaaucu

SEQ ID NO: 72754 - RNA, 21 nt, Artificial Sequence
  Oligomer
gaauucuugcgucugagcacu

SEQ ID NO: 72755 - RNA, 21 nt, Artificial Sequence
  Oligomer
accugggaugacaucacagcu

SEQ ID NO: 72756 - RNA, 21 nt, Artificial Sequence
  Oligomer
uucuccugguuccuugugguu

SEQ ID NO: 72757 - RNA, 21 nt, Artificial Sequence
  Oligomer
uuccucacagugacacacaac

SEQ ID NO: 72758 - RNA, 21 nt, Artificial Sequence
  Oligomer
ucuccugguuccuugugguuu

SEQ ID NO: 72759 - RNA, 21 nt, Artificial Sequence
  Oligomer
cugcagguggaauucuugcgu

SEQ ID NO: 72760 - RNA, 21 nt, Artificial Sequence
  Oligomer
cuguuccugaccucagauuug

SEQ ID NO: 72761 - RNA, 21 nt, Artificial Sequence
  Oligomer
cagaaaugcccagacuguucc

SEQ ID NO: 72762 - RNA, 21 nt, Artificial Sequence
  Oligomer
uccucacagugacacacaacc

SEQ ID NO: 72763 - RNA, 21 nt, Artificial Sequence
  Oligomer
agcuucaacagccuggagaca

SEQ ID NO: 72764 - RNA, 21 nt, Artificial Sequence
  Oligomer
gaucuggaugagcagauccgu

SEQ ID NO: 72765 - RNA, 21 nt, Artificial Sequence
  Oligomer
ugaucuggaugagcagauccg

SEQ ID NO: 72766 - RNA, 21 nt, Artificial Sequence
  Oligomer
ugguacaccaccaagaacugu

SEQ ID NO: 72767 - RNA, 21 nt, Artificial Sequence
  Oligomer
cucauuccagaaaugcccaga

SEQ ID NO: 72768 - RNA, 21 nt, Artificial Sequence
  Oligomer
ucuugcugucucacaacugcc

SEQ ID NO: 72769 - RNA, 21 nt, Artificial Sequence
  Oligomer
uucuacucgcaccugaagaau

SEQ ID NO: 72770 - RNA, 21 nt, Artificial Sequence
  Oligomer
uuuggacagcuuuccugugac

SEQ ID NO: 72771 - RNA, 21 nt, Artificial Sequence
  Oligomer
uugaaucugggagaugccgag

SEQ ID NO: 72772 - RNA, 21 nt, Artificial Sequence
  Oligomer
uucuugcgucugagcacucac

SEQ ID NO: 72773 - RNA, 21 nt, Artificial Sequence
  Oligomer
ccugaccucagauuuggacag

SEQ ID NO: 72774 - RNA, 21 nt, Artificial Sequence
  Oligomer
accuucaagucucuccagugu

SEQ ID NO: 72775 - RNA, 21 nt, Artificial Sequence
  Oligomer
ugcugcagguggaauucuugc

SEQ ID NO: 72776 - RNA, 21 nt, Artificial Sequence
  Oligomer
cagcccucauuccagaaaugc

SEQ ID NO: 72777 - RNA, 21 nt, Artificial Sequence
  Oligomer
gagaugcuucagaggauucgg

SEQ ID NO: 72778 - RNA, 21 nt, Artificial Sequence
  Oligomer
ucgaucucucucagaaucugc

SEQ ID NO: 72779 - RNA, 21 nt, Artificial Sequence
  Oligomer
cuucuccugguuccuuguggu

SEQ ID NO: 72780 - RNA, 21 nt, Artificial Sequence
  Oligomer
uuccagaaaugcccagacugu

SEQ ID NO: 72781 - RNA, 21 nt, Artificial Sequence
  Oligomer
ucaagucucuccagugugugg

SEQ ID NO: 72782 - RNA, 21 nt, Artificial Sequence
  Oligomer
aucuggaugagcagauccguc

SEQ ID NO: 72783 - RNA, 21 nt, Artificial Sequence
  Oligomer
cgcaccugaagaaugugaagg

SEQ ID NO: 72784 - RNA, 21 nt, Artificial Sequence
  Oligomer
uguuccugaccucagauuugg

SEQ ID NO: 72785 - RNA, 21 nt, Artificial Sequence
  Oligomer
gaucucucucagaaucugcug

SEQ ID NO: 72786 - RNA, 21 nt, Artificial Sequence
  Oligomer
cucgaucucucucagaaucug

SEQ ID NO: 72787 - RNA, 21 nt, Artificial Sequence
  Oligomer
gaugacaucacagcucaggug

SEQ ID NO: 72788 - RNA, 21 nt, Artificial Sequence
  Oligomer
ucaccuuccucacagugacac

SEQ ID NO: 72789 - RNA, 21 nt, Artificial Sequence
  Oligomer
cuccugguuccuugugguuuc

SEQ ID NO: 72790 - RNA, 21 nt, Artificial Sequence
  Oligomer
augcuucagaggauucggacg

SEQ ID NO: 72791 - RNA, 21 nt, Artificial Sequence
  Oligomer
auccgucacaugcucuucucc

SEQ ID NO: 72792 - RNA, 21 nt, Artificial Sequence
  Oligomer
ucuccuuggcacccuugaauc

SEQ ID NO: 72793 - RNA, 21 nt, Artificial Sequence
  Oligomer
agcccucauuccagaaaugcc

SEQ ID NO: 72794 - RNA, 21 nt, Artificial Sequence
  Oligomer
uccuuggcacccuugaaucug

SEQ ID NO: 72795 - RNA, 21 nt, Artificial Sequence
  Oligomer
ucucacaacugccucucugag

SEQ ID NO: 72796 - RNA, 21 nt, Artificial Sequence
  Oligomer
uuccugaccucagauuuggac

SEQ ID NO: 72797 - RNA, 21 nt, Artificial Sequence
  Oligomer
cucuugcugucucacaacugc

SEQ ID NO: 72798 - RNA, 21 nt, Artificial Sequence
  Oligomer
ucugcuuugucuucuacucgc

SEQ ID NO: 72799 - RNA, 21 nt, Artificial Sequence
  Oligomer
auguucgagggcgaagaguuc

SEQ ID NO: 72800 - RNA, 21 nt, Artificial Sequence
  Oligomer
uacucgcaccugaagaaugug

SEQ ID NO: 72801 - RNA, 21 nt, Artificial Sequence
  Oligomer
aucugcuuugucuucuacucg

SEQ ID NO: 72802 - RNA, 21 nt, Artificial Sequence
  Oligomer
acaccaccaagaacugugugg

SEQ ID NO: 72803 - RNA, 21 nt, Artificial Sequence
  Oligomer
aaucugcuggacacgcuaccu

SEQ ID NO: 72804 - RNA, 21 nt, Artificial Sequence
  Oligomer
uucaagucucuccagugugug

SEQ ID NO: 72805 - RNA, 21 nt, Artificial Sequence
  Oligomer
uuucugacgcagagcaaccug

SEQ ID NO: 72806 - RNA, 21 nt, Artificial Sequence
  Oligomer
acuucuccugguuccuugugg

SEQ ID NO: 72807 - RNA, 21 nt, Artificial Sequence
  Oligomer
ugcagguggaauucuugcguc

SEQ ID NO: 72808 - RNA, 21 nt, Artificial Sequence
  Oligomer
cucagauuuggacagcuuucc

SEQ ID NO: 72809 - RNA, 21 nt, Artificial Sequence
  Oligomer
aaugcccagacuguuccugac

SEQ ID NO: 72810 - RNA, 21 nt, Artificial Sequence
  Oligomer
accuuccucacagugacacac

SEQ ID NO: 72811 - RNA, 21 nt, Artificial Sequence
  Oligomer
ugucucacaacugccucucug

SEQ ID NO: 72812 - RNA, 21 nt, Artificial Sequence
  Oligomer
gaugaucuggaugagcagauc

SEQ ID NO: 72813 - RNA, 21 nt, Artificial Sequence
  Oligomer
ucugacacgguggagauguuc

SEQ ID NO: 72814 - RNA, 21 nt, Artificial Sequence
  Oligomer
augacaucacagcucaggugg

SEQ ID NO: 72815 - RNA, 21 nt, Artificial Sequence
  Oligomer
gaaaugcccagacuguuccug

SEQ ID NO: 72816 - RNA, 21 nt, Artificial Sequence
  Oligomer
uuaggcuggcccagauauucc

SEQ ID NO: 72817 - RNA, 21 nt, Artificial Sequence
  Oligomer
cagauccgucacaugcucuuc

SEQ ID NO: 72818 - RNA, 21 nt, Artificial Sequence
  Oligomer
ucacaacugccucucugagcu

SEQ ID NO: 72819 - RNA, 21 nt, Artificial Sequence
  Oligomer
ucucagaaucugcuggacacg

SEQ ID NO: 72820 - RNA, 21 nt, Artificial Sequence
  Oligomer
aaucugcuuugucuucuacuc

SEQ ID NO: 72821 - RNA, 21 nt, Artificial Sequence
  Oligomer
uucgagggcgaagaguucuuu

SEQ ID NO: 72822 - RNA, 21 nt, Artificial Sequence
  Oligomer
uuuaggcuggcccagauauuc

SEQ ID NO: 72823 - RNA, 21 nt, Artificial Sequence
  Oligomer
augagcagauccgucacaugc

SEQ ID NO: 72824 - RNA, 21 nt, Artificial Sequence
  Oligomer
uugcugucucacaacugccuc

SEQ ID NO: 72825 - RNA, 21 nt, Artificial Sequence
  Oligomer
cucucucagaaucugcuggac

SEQ ID NO: 72826 - RNA, 21 nt, Artificial Sequence
  Oligomer
augaucuggaugagcagaucc

SEQ ID NO: 72827 - RNA, 21 nt, Artificial Sequence
  Oligomer
uucaacagccuggagacacug

SEQ ID NO: 72828 - RNA, 21 nt, Artificial Sequence
  Oligomer
uuggacagcuuuccugugacc

SEQ ID NO: 72829 - RNA, 21 nt, Artificial Sequence
  Oligomer
acccuugaaucugggagaugc

SEQ ID NO: 72830 - RNA, 21 nt, Artificial Sequence
  Oligomer
uccugguuccuugugguuucc

SEQ ID NO: 72831 - RNA, 21 nt, Artificial Sequence
  Oligomer
aucucucucagaaucugcugg

SEQ ID NO: 72832 - RNA, 21 nt, Artificial Sequence
  Oligomer
cugaccucagauuuggacagc

SEQ ID NO: 72833 - RNA, 21 nt, Artificial Sequence
  Oligomer
uuugucuucuacucgcaccug

SEQ ID NO: 72834 - RNA, 21 nt, Artificial Sequence
  Oligomer
uacaccaccaagaacugugug

SEQ ID NO: 72835 - RNA, 21 nt, Artificial Sequence
  Oligomer
uuccgggaugaucuggaugag

SEQ ID NO: 72836 - RNA, 21 nt, Artificial Sequence
  Oligomer
uugugugucacugugaggaag

SEQ ID NO: 72837 - RNA, 21 nt, Artificial Sequence
  Oligomer
uccaaaucugaggucaggaac

SEQ ID NO: 72838 - RNA, 21 nt, Artificial Sequence
  Oligomer
uaucugggccagccuaaaagu

SEQ ID NO: 72839 - RNA, 21 nt, Artificial Sequence
  Oligomer
ucggcaucucccagauucaag

SEQ ID NO: 72840 - RNA, 21 nt, Artificial Sequence
  Oligomer
ucagacgcaagaauuccaccu

SEQ ID NO: 72841 - RNA, 21 nt, Artificial Sequence
  Oligomer
uccgaauccucugaagcaucu

SEQ ID NO: 72842 - RNA, 21 nt, Artificial Sequence
  Oligomer
auaucugggccagccuaaaag

SEQ ID NO: 72843 - RNA, 21 nt, Artificial Sequence
  Oligomer
ucuccaggcuguugaagcuca

SEQ ID NO: 72844 - RNA, 21 nt, Artificial Sequence
  Oligomer
ugacggaucugcucauccaga

SEQ ID NO: 72845 - RNA, 21 nt, Artificial Sequence
  Oligomer
acuggagagacuugaaggugg

SEQ ID NO: 72846 - RNA, 21 nt, Artificial Sequence
  Oligomer
accuccuucacauucuucagg

SEQ ID NO: 72847 - RNA, 21 nt, Artificial Sequence
  Oligomer
ucugaggucaggaacagucug

SEQ ID NO: 72848 - RNA, 21 nt, Artificial Sequence
  Oligomer
aucugggccagccuaaaaguc

SEQ ID NO: 72849 - RNA, 21 nt, Artificial Sequence
  Oligomer
ucgaaggccgcaaagaacucu

SEQ ID NO: 72850 - RNA, 21 nt, Artificial Sequence
  Oligomer
cacacuggagagacuugaagg

SEQ ID NO: 72851 - RNA, 21 nt, Artificial Sequence
  Oligomer
acucuucgcccucgaacaucu

SEQ ID NO: 72852 - RNA, 21 nt, Artificial Sequence
  Oligomer
ucugggccagccuaaaagucu

SEQ ID NO: 72853 - RNA, 21 nt, Artificial Sequence
  Oligomer
uucuucaggugcgaguagaag

SEQ ID NO: 72854 - RNA, 21 nt, Artificial Sequence
  Oligomer
aacucuucgcccucgaacauc

SEQ ID NO: 72855 - RNA, 21 nt, Artificial Sequence
  Oligomer
uguugaagcucagguccaggu

SEQ ID NO: 72856 - RNA, 21 nt, Artificial Sequence
  Oligomer
ucaggugcgaguagaagacaa

SEQ ID NO: 72857 - RNA, 21 nt, Artificial Sequence
  Oligomer
aagcagauucugcccuccaca

SEQ ID NO: 72858 - RNA, 21 nt, Artificial Sequence
  Oligomer
uguugucauuccggguccuga

SEQ ID NO: 72859 - RNA, 21 nt, Artificial Sequence
  Oligomer
uuucuggaaugagggcugcca

SEQ ID NO: 72860 - RNA, 21 nt, Artificial Sequence
  Oligomer
guccgaauccucugaagcauc

SEQ ID NO: 72861 - RNA, 21 nt, Artificial Sequence
  Oligomer
ucugcucauccagaucauccc

SEQ ID NO: 72862 - RNA, 21 nt, Artificial Sequence
  Oligomer
aagaacucuucgcccucgaac

SEQ ID NO: 72863 - RNA, 21 nt, Artificial Sequence
  Oligomer
ucauccagaucaucccggaac

SEQ ID NO: 72864 - RNA, 21 nt, Artificial Sequence
  Oligomer
acacacuggagagacuugaag

SEQ ID NO: 72865 - RNA, 21 nt, Artificial Sequence
  Oligomer
ucuucaggugcgaguagaaga

SEQ ID NO: 72866 - RNA, 21 nt, Artificial Sequence
  Oligomer
gcucagacgcaagaauuccac

SEQ ID NO: 72867 - RNA, 21 nt, Artificial Sequence
  Oligomer
cugggcauuucuggaaugagg

SEQ ID NO: 72868 - RNA, 21 nt, Artificial Sequence
  Oligomer
ugucacugugaggaaggugag

SEQ ID NO: 72869 - RNA, 21 nt, Artificial Sequence
  Oligomer
ucccagauucaagggugccaa

SEQ ID NO: 72870 - RNA, 21 nt, Artificial Sequence
  Oligomer
agacaaagcagauucugcccu

SEQ ID NO: 72871 - RNA, 21 nt, Artificial Sequence
  Oligomer
agugucuccaggcuguugaag

SEQ ID NO: 72872 - RNA, 21 nt, Artificial Sequence
  Oligomer
ccuccuucacauucuucaggu

SEQ ID NO: 72873 - RNA, 21 nt, Artificial Sequence
  Oligomer
ucacauucuucaggugcgagu

SEQ ID NO: 72874 - RNA, 21 nt, Artificial Sequence
  Oligomer
ucgaacaucuccaccguguca

SEQ ID NO: 72875 - RNA, 21 nt, Artificial Sequence
  Oligomer
uguccagcagauucugagaga

SEQ ID NO: 72876 - RNA, 21 nt, Artificial Sequence
  Oligomer
aggugcgaguagaagacaaag

SEQ ID NO: 72877 - RNA, 21 nt, Artificial Sequence
  Oligomer
agauucugcccuccacacagu

SEQ ID NO: 72878 - RNA, 21 nt, Artificial Sequence
  Oligomer
accaccugagcugugauguca

SEQ ID NO: 72879 - RNA, 21 nt, Artificial Sequence
  Oligomer
gaaagcuguccaaaucugagg

SEQ ID NO: 72880 - RNA, 21 nt, Artificial Sequence
  Oligomer
agaagagcaugugacggaucu

SEQ ID NO: 72881 - RNA, 21 nt, Artificial Sequence
  Oligomer
ugugacggaucugcucaucca

SEQ ID NO: 72882 - RNA, 21 nt, Artificial Sequence
  Oligomer
acauucuucaggugcgaguag

SEQ ID NO: 72883 - RNA, 21 nt, Artificial Sequence
  Oligomer
ugcagagcgaugagguucaca

SEQ ID NO: 72884 - RNA, 21 nt, Artificial Sequence
  Oligomer
cgaauccucugaagcaucucc

SEQ ID NO: 72885 - RNA, 21 nt, Artificial Sequence
  Oligomer
agcaugugacggaucugcuca

SEQ ID NO: 72886 - RNA, 21 nt, Artificial Sequence
  Oligomer
aggcaguugugagacagcaag

SEQ ID NO: 72887 - RNA, 21 nt, Artificial Sequence
  Oligomer
ucaggaacagucugggcauuu

SEQ ID NO: 72888 - RNA, 21 nt, Artificial Sequence
  Oligomer
ucggaugcuguccugguacuu

SEQ ID NO: 72889 - RNA, 21 nt, Artificial Sequence
  Oligomer
aaagcagauucugcccuccac

SEQ ID NO: 72890 - RNA, 21 nt, Artificial Sequence
  Oligomer
caggaaagcuguccaaaucug

SEQ ID NO: 72891 - RNA, 21 nt, Artificial Sequence
  Oligomer
ugcucagacgcaagaauucca

SEQ ID NO: 72892 - RNA, 21 nt, Artificial Sequence
  Oligomer
agaacucuucgcccucgaaca

SEQ ID NO: 72893 - RNA, 21 nt, Artificial Sequence
  Oligomer
ucacaggaaagcuguccaaau

SEQ ID NO: 72894 - RNA, 21 nt, Artificial Sequence
  Oligomer
uguccaaaucugaggucagga

SEQ ID NO: 72895 - RNA, 21 nt, Artificial Sequence
  Oligomer
aauaucugggccagccuaaaa

SEQ ID NO: 72896 - RNA, 21 nt, Artificial Sequence
  Oligomer
cauucuucaggugcgaguaga

SEQ ID NO: 72897 - RNA, 21 nt, Artificial Sequence
  Oligomer
aguucuuggugguguaccaga

SEQ ID NO: 72898 - RNA, 21 nt, Artificial Sequence
  Oligomer
guucuuggugguguaccagag

SEQ ID NO: 72899 - RNA, 21 nt, Artificial Sequence
  Oligomer
gagugcucagacgcaagaauu

SEQ ID NO: 72900 - RNA, 21 nt, Artificial Sequence
  Oligomer
caaagaacucuucgcccucga

SEQ ID NO: 72901 - RNA, 21 nt, Artificial Sequence
  Oligomer
agucugggcauuucuggaaug

SEQ ID NO: 72902 - RNA, 21 nt, Artificial Sequence
  Oligomer
guagcguguccagcagauucu

SEQ ID NO: 72903 - RNA, 21 nt, Artificial Sequence
  Oligomer
caugugacggaucugcucauc

SEQ ID NO: 72904 - RNA, 21 nt, Artificial Sequence
  Oligomer
uccaaucucaggagguagcgu

SEQ ID NO: 72905 - RNA, 21 nt, Artificial Sequence
  Oligomer
cauccagaucaucccggaacu

SEQ ID NO: 72906 - RNA, 21 nt, Artificial Sequence
  Oligomer
agguugcucugcgucagaaag

SEQ ID NO: 72907 - RNA, 21 nt, Artificial Sequence
  Oligomer
cacaguucuuggugguguacc

SEQ ID NO: 72908 - RNA, 21 nt, Artificial Sequence
  Oligomer
cacaggaaagcuguccaaauc

SEQ ID NO: 72909 - RNA, 21 nt, Artificial Sequence
  Oligomer
caaagcagauucugcccucca

SEQ ID NO: 72910 - RNA, 21 nt, Artificial Sequence
  Oligomer
cgaaggccgcaaagaacucuu

SEQ ID NO: 72911 - RNA, 21 nt, Artificial Sequence
  Oligomer
agaggcaguugugagacagca

SEQ ID NO: 72912 - RNA, 21 nt, Artificial Sequence
  Oligomer
ugggccagccuaaaagucugu

SEQ ID NO: 72913 - RNA, 21 nt, Artificial Sequence
  Oligomer
gagaagagcaugugacggauc

SEQ ID NO: 72914 - RNA, 21 nt, Artificial Sequence
  Oligomer
ggugcgaguagaagacaaagc

SEQ ID NO: 72915 - RNA, 21 nt, Artificial Sequence
  Oligomer
cacaaggaaccaggagaagug

SEQ ID NO: 72916 - RNA, 21 nt, Artificial Sequence
  Oligomer
cagucugggcauuucuggaau

SEQ ID NO: 72917 - RNA, 21 nt, Artificial Sequence
  Oligomer
agaauuccaccugcagcagcu

SEQ ID NO: 72918 - RNA, 21 nt, Artificial Sequence
  Oligomer
guguccagcagauucugagag

SEQ ID NO: 72919 - RNA, 21 nt, Artificial Sequence
  Oligomer
ucgaagucucggcagcuugau

SEQ ID NO: 72920 - RNA, 21 nt, Artificial Sequence
  Oligomer
ucccacacaguucuugguggu

SEQ ID NO: 72921 - RNA, 21 nt, Artificial Sequence
  Oligomer
agcguguccagcagauucuga

SEQ ID NO: 72922 - RNA, 21 nt, Artificial Sequence
  Oligomer
aggagaagagcaugugacgga

SEQ ID NO: 72923 - RNA, 21 nt, Artificial Sequence
  Oligomer
cuucaggugcgaguagaagac

SEQ ID NO: 72924 - RNA, 21 nt, Artificial Sequence
  Oligomer
uccagcagauucugagagaga

SEQ ID NO: 72925 - RNA, 21 nt, Artificial Sequence
  Oligomer
cacuggagagacuugaaggug

SEQ ID NO: 72926 - RNA, 21 nt, Artificial Sequence
  Oligomer
ugagugcucagacgcaagaau

SEQ ID NO: 72927 - RNA, 21 nt, Artificial Sequence
  Oligomer
ucucggcaucucccagauuca

SEQ ID NO: 72928 - RNA, 21 nt, Artificial Sequence
  Oligomer
agauucaagggugccaaggag

SEQ ID NO: 72929 - RNA, 21 nt, Artificial Sequence
  Oligomer
agugcucagacgcaagaauuc

SEQ ID NO: 72930 - RNA, 21 nt, Artificial Sequence
  Oligomer
agcugugaugucaucccaggu

SEQ ID NO: 72931 - RNA, 21 nt, Artificial Sequence
  Oligomer
aaccacaaggaaccaggagaa

SEQ ID NO: 72932 - RNA, 21 nt, Artificial Sequence
  Oligomer
guugugugucacugugaggaa

SEQ ID NO: 72933 - RNA, 21 nt, Artificial Sequence
  Oligomer
aaaccacaaggaaccaggaga

SEQ ID NO: 72934 - RNA, 21 nt, Artificial Sequence
  Oligomer
acgcaagaauuccaccugcag

SEQ ID NO: 72935 - RNA, 21 nt, Artificial Sequence
  Oligomer
caaaucugaggucaggaacag

SEQ ID NO: 72936 - RNA, 21 nt, Artificial Sequence
  Oligomer
ggaacagucugggcauuucug

SEQ ID NO: 72937 - RNA, 21 nt, Artificial Sequence
  Oligomer
gguugugugucacugugagga

SEQ ID NO: 72938 - RNA, 21 nt, Artificial Sequence
  Oligomer
ugucuccaggcuguugaagcu

SEQ ID NO: 72939 - RNA, 21 nt, Artificial Sequence
  Oligomer
acggaucugcucauccagauc

SEQ ID NO: 72940 - RNA, 21 nt, Artificial Sequence
  Oligomer
cggaucugcucauccagauca

SEQ ID NO: 72941 - RNA, 21 nt, Artificial Sequence
  Oligomer
acaguucuuggugguguacca

SEQ ID NO: 72942 - RNA, 21 nt, Artificial Sequence
  Oligomer
ucugggcauuucuggaaugag

SEQ ID NO: 72943 - RNA, 21 nt, Artificial Sequence
  Oligomer
ggcaguugugagacagcaaga

SEQ ID NO: 72944 - RNA, 21 nt, Artificial Sequence
  Oligomer
auucuucaggugcgaguagaa

SEQ ID NO: 72945 - RNA, 21 nt, Artificial Sequence
  Oligomer
gucacaggaaagcuguccaaa

SEQ ID NO: 72946 - RNA, 21 nt, Artificial Sequence
  Oligomer
cucggcaucucccagauucaa

SEQ ID NO: 72947 - RNA, 21 nt, Artificial Sequence
  Oligomer
gugagugcucagacgcaagaa

SEQ ID NO: 72948 - RNA, 21 nt, Artificial Sequence
  Oligomer
cuguccaaaucugaggucagg

SEQ ID NO: 72949 - RNA, 21 nt, Artificial Sequence
  Oligomer
acacuggagagacuugaaggu

SEQ ID NO: 72950 - RNA, 21 nt, Artificial Sequence
  Oligomer
gcaagaauuccaccugcagca

SEQ ID NO: 72951 - RNA, 21 nt, Artificial Sequence
  Oligomer
gcauuucuggaaugagggcug

SEQ ID NO: 72952 - RNA, 21 nt, Artificial Sequence
  Oligomer
ccgaauccucugaagcaucuc

SEQ ID NO: 72953 - RNA, 21 nt, Artificial Sequence
  Oligomer
gcagauucugagagagaucga

SEQ ID NO: 72954 - RNA, 21 nt, Artificial Sequence
  Oligomer
accacaaggaaccaggagaag

SEQ ID NO: 72955 - RNA, 21 nt, Artificial Sequence
  Oligomer
acagucugggcauuucuggaa

SEQ ID NO: 72956 - RNA, 21 nt, Artificial Sequence
  Oligomer
ccacacacuggagagacuuga

SEQ ID NO: 72957 - RNA, 21 nt, Artificial Sequence
  Oligomer
gacggaucugcucauccagau

SEQ ID NO: 72958 - RNA, 21 nt, Artificial Sequence
  Oligomer
ccuucacauucuucaggugcg

SEQ ID NO: 72959 - RNA, 21 nt, Artificial Sequence
  Oligomer
ccaaaucugaggucaggaaca

SEQ ID NO: 72960 - RNA, 21 nt, Artificial Sequence
  Oligomer
cagcagauucugagagagauc

SEQ ID NO: 72961 - RNA, 21 nt, Artificial Sequence
  Oligomer
cagauucugagagagaucgag

SEQ ID NO: 72962 - RNA, 21 nt, Artificial Sequence
  Oligomer
caccugagcugugaugucauc

SEQ ID NO: 72963 - RNA, 21 nt, Artificial Sequence
  Oligomer
gugucacugugaggaagguga

SEQ ID NO: 72964 - RNA, 21 nt, Artificial Sequence
  Oligomer
gaaaccacaaggaaccaggag

SEQ ID NO: 72965 - RNA, 21 nt, Artificial Sequence
  Oligomer
cguccgaauccucugaagcau

SEQ ID NO: 72966 - RNA, 21 nt, Artificial Sequence
  Oligomer
ggagaagagcaugugacggau

SEQ ID NO: 72967 - RNA, 21 nt, Artificial Sequence
  Oligomer
gauucaagggugccaaggaga

SEQ ID NO: 72968 - RNA, 21 nt, Artificial Sequence
  Oligomer
ggcauuucuggaaugagggcu

SEQ ID NO: 72969 - RNA, 21 nt, Artificial Sequence
  Oligomer
cagauucaagggugccaagga

SEQ ID NO: 72970 - RNA, 21 nt, Artificial Sequence
  Oligomer
cucagagaggcaguugugaga

SEQ ID NO: 72971 - RNA, 21 nt, Artificial Sequence
  Oligomer
guccaaaucugaggucaggaa

SEQ ID NO: 72972 - RNA, 21 nt, Artificial Sequence
  Oligomer
gcaguugugagacagcaagag

SEQ ID NO: 72973 - RNA, 21 nt, Artificial Sequence
  Oligomer
gcgaguagaagacaaagcaga

SEQ ID NO: 72974 - RNA, 21 nt, Artificial Sequence
  Oligomer
gaacucuucgcccucgaacau

SEQ ID NO: 72975 - RNA, 21 nt, Artificial Sequence
  Oligomer
cacauucuucaggugcgagua

SEQ ID NO: 72976 - RNA, 21 nt, Artificial Sequence
  Oligomer
cgaguagaagacaaagcagau

SEQ ID NO: 72977 - RNA, 21 nt, Artificial Sequence
  Oligomer
ccacacaguucuugguggugu

SEQ ID NO: 72978 - RNA, 21 nt, Artificial Sequence
  Oligomer
agguagcguguccagcagauu

SEQ ID NO: 72979 - RNA, 21 nt, Artificial Sequence
  Oligomer
cacacacuggagagacuugaa

SEQ ID NO: 72980 - RNA, 21 nt, Artificial Sequence
  Oligomer
cagguugcucugcgucagaaa

SEQ ID NO: 72981 - RNA, 21 nt, Artificial Sequence
  Oligomer
ccacaaggaaccaggagaagu

SEQ ID NO: 72982 - RNA, 21 nt, Artificial Sequence
  Oligomer
gacgcaagaauuccaccugca

SEQ ID NO: 72983 - RNA, 21 nt, Artificial Sequence
  Oligomer
ggaaagcuguccaaaucugag

SEQ ID NO: 72984 - RNA, 21 nt, Artificial Sequence
  Oligomer
gucaggaacagucugggcauu

SEQ ID NO: 72985 - RNA, 21 nt, Artificial Sequence
  Oligomer
gugugucacugugaggaaggu

SEQ ID NO: 72986 - RNA, 21 nt, Artificial Sequence
  Oligomer
cagagaggcaguugugagaca

SEQ ID NO: 72987 - RNA, 21 nt, Artificial Sequence
  Oligomer
gaucugcucauccagaucauc

SEQ ID NO: 72988 - RNA, 21 nt, Artificial Sequence
  Oligomer
gaacaucuccaccgugucaga

SEQ ID NO: 72989 - RNA, 21 nt, Artificial Sequence
  Oligomer
ccaccugagcugugaugucau

SEQ ID NO: 72990 - RNA, 21 nt, Artificial Sequence
  Oligomer
caggaacagucugggcauuuc

SEQ ID NO: 72991 - RNA, 21 nt, Artificial Sequence
  Oligomer
ggaauaucugggccagccuaa

SEQ ID NO: 72992 - RNA, 21 nt, Artificial Sequence
  Oligomer
gaagagcaugugacggaucug

SEQ ID NO: 72993 - RNA, 21 nt, Artificial Sequence
  Oligomer
agcucagagaggcaguuguga

SEQ ID NO: 72994 - RNA, 21 nt, Artificial Sequence
  Oligomer
cguguccagcagauucugaga

SEQ ID NO: 72995 - RNA, 21 nt, Artificial Sequence
  Oligomer
gaguagaagacaaagcagauu

SEQ ID NO: 72996 - RNA, 21 nt, Artificial Sequence
  Oligomer
aaagaacucuucgcccucgaa

SEQ ID NO: 72997 - RNA, 21 nt, Artificial Sequence
  Oligomer
gaauaucugggccagccuaaa

SEQ ID NO: 72998 - RNA, 21 nt, Artificial Sequence
  Oligomer
gcaugugacggaucugcucau

SEQ ID NO: 72999 - RNA, 21 nt, Artificial Sequence
  Oligomer
gaggcaguugugagacagcaa

SEQ ID NO: 73000 - RNA, 21 nt, Artificial Sequence
  Oligomer
guccagcagauucugagagag

SEQ ID NO: 73001 - RNA, 21 nt, Artificial Sequence
  Oligomer
ggaucugcucauccagaucau

SEQ ID NO: 73002 - RNA, 21 nt, Artificial Sequence
  Oligomer
cagugucuccaggcuguugaa

SEQ ID NO: 73003 - RNA, 21 nt, Artificial Sequence
  Oligomer
ggucacaggaaagcuguccaa

SEQ ID NO: 73004 - RNA, 21 nt, Artificial Sequence
  Oligomer
gcaucucccagauucaagggu

SEQ ID NO: 73005 - RNA, 21 nt, Artificial Sequence
  Oligomer
ggaaaccacaaggaaccagga

SEQ ID NO: 73006 - RNA, 21 nt, Artificial Sequence
  Oligomer
ccagcagauucugagagagau

SEQ ID NO: 73007 - RNA, 21 nt, Artificial Sequence
  Oligomer
gcuguccaaaucugaggucag

SEQ ID NO: 73008 - RNA, 21 nt, Artificial Sequence
  Oligomer
caggugcgaguagaagacaaa

SEQ ID NO: 73009 - RNA, 21 nt, Artificial Sequence
  Oligomer
cacacaguucuugguggugua

SEQ ID NO: 73010 - RNA, 21 nt, Artificial Sequence
  Oligomer
cucauccagaucaucccggaa

SEQ ID NO: 73011 - RNA, 23 nt, Artificial Sequence
  Oligomer
gaaucugcuuugucuucuacucg

SEQ ID NO: 73012 - RNA, 23 nt, Artificial Sequence
  Oligomer
ucaggacccggaaugacaacagc

SEQ ID NO: 73013 - RNA, 23 nt, Artificial Sequence
  Oligomer
gucaggacccggaaugacaacag

SEQ ID NO: 73014 - RNA, 23 nt, Artificial Sequence
  Oligomer
ggucaggacccggaaugacaaca

SEQ ID NO: 73015 - RNA, 23 nt, Artificial Sequence
  Oligomer
uggucaggacccggaaugacaac

SEQ ID NO: 73016 - RNA, 23 nt, Artificial Sequence
  Oligomer
guggucaggacccggaaugacaa

SEQ ID NO: 73017 - RNA, 23 nt, Artificial Sequence
  Oligomer
gaaucugcuggacacgcuaccuc

SEQ ID NO: 73018 - RNA, 23 nt, Artificial Sequence
  Oligomer
aggagaugcuucagaggauucgg

SEQ ID NO: 73019 - RNA, 23 nt, Artificial Sequence
  Oligomer
caggagaugcuucagaggauucg

SEQ ID NO: 73020 - RNA, 23 nt, Artificial Sequence
  Oligomer
gcaggagaugcuucagaggauuc

SEQ ID NO: 73021 - RNA, 23 nt, Artificial Sequence
  Oligomer
cgcaggagaugcuucagaggauu

SEQ ID NO: 73022 - RNA, 23 nt, Artificial Sequence
  Oligomer
ccgcaggagaugcuucagaggau

SEQ ID NO: 73023 - RNA, 23 nt, Artificial Sequence
  Oligomer
caccuuccucacagugacacaca

SEQ ID NO: 73024 - RNA, 23 nt, Artificial Sequence
  Oligomer
ucaccuuccucacagugacacac

SEQ ID NO: 73025 - RNA, 23 nt, Artificial Sequence
  Oligomer
cucaccuuccucacagugacaca

SEQ ID NO: 73026 - RNA, 23 nt, Artificial Sequence
  Oligomer
ggagaugcuucagaggauucgga

SEQ ID NO: 73027 - RNA, 23 nt, Artificial Sequence
  Oligomer
aguucuuugcggccuucgagcgc

SEQ ID NO: 73028 - RNA, 23 nt, Artificial Sequence
  Oligomer
gaguucuuugcggccuucgagcg

SEQ ID NO: 73029 - RNA, 23 nt, Artificial Sequence
  Oligomer
agaccuaccuggaggaagaggca

SEQ ID NO: 73030 - RNA, 23 nt, Artificial Sequence
  Oligomer
gagaccuaccuggaggaagaggc

SEQ ID NO: 73031 - RNA, 23 nt, Artificial Sequence
  Oligomer
ggagaccuaccuggaggaagagg

SEQ ID NO: 73032 - RNA, 23 nt, Artificial Sequence
  Oligomer
uggagaccuaccuggaggaagag

SEQ ID NO: 73033 - RNA, 23 nt, Artificial Sequence
  Oligomer
cuggagaccuaccuggaggaaga

SEQ ID NO: 73034 - RNA, 23 nt, Artificial Sequence
  Oligomer
ccaccuucaagucucuccagugu

SEQ ID NO: 73035 - RNA, 23 nt, Artificial Sequence
  Oligomer
cccaccuucaagucucuccagug

SEQ ID NO: 73036 - RNA, 23 nt, Artificial Sequence
  Oligomer
ccccaccuucaagucucuccagu

SEQ ID NO: 73037 - RNA, 23 nt, Artificial Sequence
  Oligomer
cccccaccuucaagucucuccag

SEQ ID NO: 73038 - RNA, 23 nt, Artificial Sequence
  Oligomer
gcccccaccuucaagucucucca

SEQ ID NO: 73039 - RNA, 23 nt, Artificial Sequence
  Oligomer
cagcgccucgaucucucucagaa

SEQ ID NO: 73040 - RNA, 23 nt, Artificial Sequence
  Oligomer
cuuuuaggcuggcccagauauuc

SEQ ID NO: 73041 - RNA, 23 nt, Artificial Sequence
  Oligomer
acuuuuaggcuggcccagauauu

SEQ ID NO: 73042 - RNA, 23 nt, Artificial Sequence
  Oligomer
gacuuuuaggcuggcccagauau

SEQ ID NO: 73043 - RNA, 23 nt, Artificial Sequence
  Oligomer
agacuuuuaggcuggcccagaua

SEQ ID NO: 73044 - RNA, 23 nt, Artificial Sequence
  Oligomer
cagacuuuuaggcuggcccagau

SEQ ID NO: 73045 - RNA, 23 nt, Artificial Sequence
  Oligomer
cucugacacgguggagauguucg

SEQ ID NO: 73046 - RNA, 23 nt, Artificial Sequence
  Oligomer
ccucugacacgguggagauguuc

SEQ ID NO: 73047 - RNA, 23 nt, Artificial Sequence
  Oligomer
cccucugacacgguggagauguu

SEQ ID NO: 73048 - RNA, 23 nt, Artificial Sequence
  Oligomer
gcaaguaccaggacagcauccga

SEQ ID NO: 73049 - RNA, 23 nt, Artificial Sequence
  Oligomer
cgcaaguaccaggacagcauccg

SEQ ID NO: 73050 - RNA, 23 nt, Artificial Sequence
  Oligomer
ccgcaaguaccaggacagcaucc

SEQ ID NO: 73051 - RNA, 23 nt, Artificial Sequence
  Oligomer
gccgcaaguaccaggacagcauc

SEQ ID NO: 73052 - RNA, 23 nt, Artificial Sequence
  Oligomer
cgccgcaaguaccaggacagcau

SEQ ID NO: 73053 - RNA, 23 nt, Artificial Sequence
  Oligomer
gccgcaggagaugcuucagagga

SEQ ID NO: 73054 - RNA, 23 nt, Artificial Sequence
  Oligomer
uccuuguccugcacagcaaccuc

SEQ ID NO: 73055 - RNA, 23 nt, Artificial Sequence
  Oligomer
cuccuuguccugcacagcaaccu

SEQ ID NO: 73056 - RNA, 23 nt, Artificial Sequence
  Oligomer
gcuccuuguccugcacagcaacc

SEQ ID NO: 73057 - RNA, 23 nt, Artificial Sequence
  Oligomer
ggcuccuuguccugcacagcaac

SEQ ID NO: 73058 - RNA, 23 nt, Artificial Sequence
  Oligomer
cggcuccuuguccugcacagcaa

SEQ ID NO: 73059 - RNA, 23 nt, Artificial Sequence
  Oligomer
cagaaaugcccagacuguuccug

SEQ ID NO: 73060 - RNA, 23 nt, Artificial Sequence
  Oligomer
ccagaaaugcccagacuguuccu

SEQ ID NO: 73061 - RNA, 23 nt, Artificial Sequence
  Oligomer
uccagaaaugcccagacuguucc

SEQ ID NO: 73062 - RNA, 23 nt, Artificial Sequence
  Oligomer
uuccagaaaugcccagacuguuc

SEQ ID NO: 73063 - RNA, 23 nt, Artificial Sequence
  Oligomer
auuccagaaaugcccagacuguu

SEQ ID NO: 73064 - RNA, 23 nt, Artificial Sequence
  Oligomer
cgaguuccgggaugaucuggaug

SEQ ID NO: 73065 - RNA, 23 nt, Artificial Sequence
  Oligomer
acgaguuccgggaugaucuggau

SEQ ID NO: 73066 - RNA, 23 nt, Artificial Sequence
  Oligomer
ggccucuccuuggcacccuugaa

SEQ ID NO: 73067 - RNA, 23 nt, Artificial Sequence
  Oligomer
ucaacagccuggagacacugccg

SEQ ID NO: 73068 - RNA, 23 nt, Artificial Sequence
  Oligomer
uucaacagccuggagacacugcc

SEQ ID NO: 73069 - RNA, 23 nt, Artificial Sequence
  Oligomer
cuucaacagccuggagacacugc

SEQ ID NO: 73070 - RNA, 23 nt, Artificial Sequence
  Oligomer
gcuucaacagccuggagacacug

SEQ ID NO: 73071 - RNA, 23 nt, Artificial Sequence
  Oligomer
agcuucaacagccuggagacacu

SEQ ID NO: 73072 - RNA, 23 nt, Artificial Sequence
  Oligomer
cacgaguuccgggaugaucugga

SEQ ID NO: 73073 - RNA, 23 nt, Artificial Sequence
  Oligomer
gcacgaguuccgggaugaucugg

SEQ ID NO: 73074 - RNA, 23 nt, Artificial Sequence
  Oligomer
ggcacgaguuccgggaugaucug

SEQ ID NO: 73075 - RNA, 23 nt, Artificial Sequence
  Oligomer
cggcacgaguuccgggaugaucu

SEQ ID NO: 73076 - RNA, 23 nt, Artificial Sequence
  Oligomer
caccaagaacugugugggaggcc

SEQ ID NO: 73077 - RNA, 23 nt, Artificial Sequence
  Oligomer
ccaccaagaacugugugggaggc

SEQ ID NO: 73078 - RNA, 23 nt, Artificial Sequence
  Oligomer
accaccaagaacugugugggagg

SEQ ID NO: 73079 - RNA, 23 nt, Artificial Sequence
  Oligomer
caccaccaagaacugugugggag

SEQ ID NO: 73080 - RNA, 23 nt, Artificial Sequence
  Oligomer
ccuuggcacccuugaaucuggga

SEQ ID NO: 73081 - RNA, 23 nt, Artificial Sequence
  Oligomer
uccuuggcacccuugaaucuggg

SEQ ID NO: 73082 - RNA, 23 nt, Artificial Sequence
  Oligomer
cauuccagaaaugcccagacugu

SEQ ID NO: 73083 - RNA, 23 nt, Artificial Sequence
  Oligomer
gucucacaacugccucucugagc

SEQ ID NO: 73084 - RNA, 23 nt, Artificial Sequence
  Oligomer
ugucucacaacugccucucugag

SEQ ID NO: 73085 - RNA, 23 nt, Artificial Sequence
  Oligomer
cugucucacaacugccucucuga

SEQ ID NO: 73086 - RNA, 23 nt, Artificial Sequence
  Oligomer
ucaagucucuccagugugugggg

SEQ ID NO: 73087 - RNA, 23 nt, Artificial Sequence
  Oligomer
uucaagucucuccaguguguggg

SEQ ID NO: 73088 - RNA, 23 nt, Artificial Sequence
  Oligomer
cuucaagucucuccagugugugg

SEQ ID NO: 73089 - RNA, 23 nt, Artificial Sequence
  Oligomer
ccuucaagucucuccagugugug

SEQ ID NO: 73090 - RNA, 23 nt, Artificial Sequence
  Oligomer
accuucaagucucuccagugugu

SEQ ID NO: 73091 - RNA, 23 nt, Artificial Sequence
  Oligomer
acagacuuuuaggcuggcccaga

SEQ ID NO: 73092 - RNA, 23 nt, Artificial Sequence
  Oligomer
cacagacuuuuaggcuggcccag

SEQ ID NO: 73093 - RNA, 23 nt, Artificial Sequence
  Oligomer
ccacagacuuuuaggcuggccca

SEQ ID NO: 73094 - RNA, 23 nt, Artificial Sequence
  Oligomer
aguggcagcccucauuccagaaa

SEQ ID NO: 73095 - RNA, 23 nt, Artificial Sequence
  Oligomer
gauguucgagggcgaagaguucu

SEQ ID NO: 73096 - RNA, 23 nt, Artificial Sequence
  Oligomer
ugagcagauccgucacaugcucu

SEQ ID NO: 73097 - RNA, 23 nt, Artificial Sequence
  Oligomer
augagcagauccgucacaugcuc

SEQ ID NO: 73098 - RNA, 23 nt, Artificial Sequence
  Oligomer
gaugagcagauccgucacaugcu

SEQ ID NO: 73099 - RNA, 23 nt, Artificial Sequence
  Oligomer
ggaugagcagauccgucacaugc

SEQ ID NO: 73100 - RNA, 23 nt, Artificial Sequence
  Oligomer
uggaugagcagauccgucacaug

SEQ ID NO: 73101 - RNA, 23 nt, Artificial Sequence
  Oligomer
ccucaccuuccucacagugacac

SEQ ID NO: 73102 - RNA, 23 nt, Artificial Sequence
  Oligomer
cccucaccuuccucacagugaca

SEQ ID NO: 73103 - RNA, 23 nt, Artificial Sequence
  Oligomer
caccuucaagucucuccagugug

SEQ ID NO: 73104 - RNA, 23 nt, Artificial Sequence
  Oligomer
uuuuaggcuggcccagauauucc

SEQ ID NO: 73105 - RNA, 23 nt, Artificial Sequence
  Oligomer
ugaaucugggagaugccgagacc

SEQ ID NO: 73106 - RNA, 23 nt, Artificial Sequence
  Oligomer
uugaaucugggagaugccgagac

SEQ ID NO: 73107 - RNA, 23 nt, Artificial Sequence
  Oligomer
cuugaaucugggagaugccgaga

SEQ ID NO: 73108 - RNA, 23 nt, Artificial Sequence
  Oligomer
ccuugaaucugggagaugccgag

SEQ ID NO: 73109 - RNA, 23 nt, Artificial Sequence
  Oligomer
uguguggagggcagaaucugcuu

SEQ ID NO: 73110 - RNA, 23 nt, Artificial Sequence
  Oligomer
caucaagcugccgagacuucgag

SEQ ID NO: 73111 - RNA, 23 nt, Artificial Sequence
  Oligomer
ccaucaagcugccgagacuucga

SEQ ID NO: 73112 - RNA, 23 nt, Artificial Sequence
  Oligomer
cccaucaagcugccgagacuucg

SEQ ID NO: 73113 - RNA, 23 nt, Artificial Sequence
  Oligomer
gcccaucaagcugccgagacuuc

SEQ ID NO: 73114 - RNA, 23 nt, Artificial Sequence
  Oligomer
ugcccaucaagcugccgagacuu

SEQ ID NO: 73115 - RNA, 23 nt, Artificial Sequence
  Oligomer
gagggcgaagaguucuuugcggc

SEQ ID NO: 73116 - RNA, 23 nt, Artificial Sequence
  Oligomer
cucauuccagaaaugcccagacu

SEQ ID NO: 73117 - RNA, 23 nt, Artificial Sequence
  Oligomer
ccucauuccagaaaugcccagac

SEQ ID NO: 73118 - RNA, 23 nt, Artificial Sequence
  Oligomer
cccucauuccagaaaugcccaga

SEQ ID NO: 73119 - RNA, 23 nt, Artificial Sequence
  Oligomer
gcccucauuccagaaaugcccag

SEQ ID NO: 73120 - RNA, 23 nt, Artificial Sequence
  Oligomer
ccucacagugacacacaaccgcc

SEQ ID NO: 73121 - RNA, 23 nt, Artificial Sequence
  Oligomer
caaguaccaggacagcauccgac

SEQ ID NO: 73122 - RNA, 23 nt, Artificial Sequence
  Oligomer
uacuggcucugguacaccaccaa

SEQ ID NO: 73123 - RNA, 23 nt, Artificial Sequence
  Oligomer
guacuggcucugguacaccacca

SEQ ID NO: 73124 - RNA, 23 nt, Artificial Sequence
  Oligomer
uguacuggcucugguacaccacc

SEQ ID NO: 73125 - RNA, 23 nt, Artificial Sequence
  Oligomer
cuguacuggcucugguacaccac

SEQ ID NO: 73126 - RNA, 23 nt, Artificial Sequence
  Oligomer
ccuguacuggcucugguacacca

SEQ ID NO: 73127 - RNA, 23 nt, Artificial Sequence
  Oligomer
augcuucagaggauucggacgca

SEQ ID NO: 73128 - RNA, 23 nt, Artificial Sequence
  Oligomer
gaugcuucagaggauucggacgc

SEQ ID NO: 73129 - RNA, 23 nt, Artificial Sequence
  Oligomer
agaugcuucagaggauucggacg

SEQ ID NO: 73130 - RNA, 23 nt, Artificial Sequence
  Oligomer
gagaugcuucagaggauucggac

SEQ ID NO: 73131 - RNA, 23 nt, Artificial Sequence
  Oligomer
ucuugcgucugagcacucacgag

SEQ ID NO: 73132 - RNA, 23 nt, Artificial Sequence
  Oligomer
uucuugcgucugagcacucacga

SEQ ID NO: 73133 - RNA, 23 nt, Artificial Sequence
  Oligomer
auucuugcgucugagcacucacg

SEQ ID NO: 73134 - RNA, 23 nt, Artificial Sequence
  Oligomer
aauucuugcgucugagcacucac

SEQ ID NO: 73135 - RNA, 23 nt, Artificial Sequence
  Oligomer
gaauucuugcgucugagcacuca

SEQ ID NO: 73136 - RNA, 23 nt, Artificial Sequence
  Oligomer
gcccagacuguuccugaccucag

SEQ ID NO: 73137 - RNA, 23 nt, Artificial Sequence
  Oligomer
ugcccagacuguuccugaccuca

SEQ ID NO: 73138 - RNA, 23 nt, Artificial Sequence
  Oligomer
cuguguggagggcagaaucugcu

SEQ ID NO: 73139 - RNA, 23 nt, Artificial Sequence
  Oligomer
ucuggaugagcagauccgucaca

SEQ ID NO: 73140 - RNA, 23 nt, Artificial Sequence
  Oligomer
aucuggaugagcagauccgucac

SEQ ID NO: 73141 - RNA, 23 nt, Artificial Sequence
  Oligomer
gaucuggaugagcagauccguca

SEQ ID NO: 73142 - RNA, 23 nt, Artificial Sequence
  Oligomer
acaucacagcucaggugguccug

SEQ ID NO: 73143 - RNA, 23 nt, Artificial Sequence
  Oligomer
gacaucacagcucaggugguccu

SEQ ID NO: 73144 - RNA, 23 nt, Artificial Sequence
  Oligomer
gcugucucacaacugccucucug

SEQ ID NO: 73145 - RNA, 23 nt, Artificial Sequence
  Oligomer
ugcugucucacaacugccucucu

SEQ ID NO: 73146 - RNA, 23 nt, Artificial Sequence
  Oligomer
ggaauucuugcgucugagcacuc

SEQ ID NO: 73147 - RNA, 23 nt, Artificial Sequence
  Oligomer
acccggaaugacaacagcugggg

SEQ ID NO: 73148 - RNA, 23 nt, Artificial Sequence
  Oligomer
gacccggaaugacaacagcuggg

SEQ ID NO: 73149 - RNA, 23 nt, Artificial Sequence
  Oligomer
ggacccggaaugacaacagcugg

SEQ ID NO: 73150 - RNA, 23 nt, Artificial Sequence
  Oligomer
aggacccggaaugacaacagcug

SEQ ID NO: 73151 - RNA, 23 nt, Artificial Sequence
  Oligomer
caggacccggaaugacaacagcu

SEQ ID NO: 73152 - RNA, 23 nt, Artificial Sequence
  Oligomer
uucagaggauucggacgcagggu

SEQ ID NO: 73153 - RNA, 23 nt, Artificial Sequence
  Oligomer
cuucagaggauucggacgcaggg

SEQ ID NO: 73154 - RNA, 23 nt, Artificial Sequence
  Oligomer
gcuucagaggauucggacgcagg

SEQ ID NO: 73155 - RNA, 23 nt, Artificial Sequence
  Oligomer
ugcuucagaggauucggacgcag

SEQ ID NO: 73156 - RNA, 23 nt, Artificial Sequence
  Oligomer
cuggaugagcagauccgucacau

SEQ ID NO: 73157 - RNA, 23 nt, Artificial Sequence
  Oligomer
cuuucugacgcagagcaaccugc

SEQ ID NO: 73158 - RNA, 23 nt, Artificial Sequence
  Oligomer
uugcugucucacaacugccucuc

SEQ ID NO: 73159 - RNA, 23 nt, Artificial Sequence
  Oligomer
cuugcugucucacaacugccucu

SEQ ID NO: 73160 - RNA, 23 nt, Artificial Sequence
  Oligomer
uuuaggcuggcccagauauuccc

SEQ ID NO: 73161 - RNA, 23 nt, Artificial Sequence
  Oligomer
gagcuucaacagccuggagacac

SEQ ID NO: 73162 - RNA, 23 nt, Artificial Sequence
  Oligomer
ucauuccagaaaugcccagacug

SEQ ID NO: 73163 - RNA, 23 nt, Artificial Sequence
  Oligomer
gcccucaccuuccucacagugac

SEQ ID NO: 73164 - RNA, 23 nt, Artificial Sequence
  Oligomer
agauuuggacagcuuuccuguga

SEQ ID NO: 73165 - RNA, 23 nt, Artificial Sequence
  Oligomer
cagauuuggacagcuuuccugug

SEQ ID NO: 73166 - RNA, 23 nt, Artificial Sequence
  Oligomer
ucagauuuggacagcuuuccugu

SEQ ID NO: 73167 - RNA, 23 nt, Artificial Sequence
  Oligomer
cgcccucaccuuccucacaguga

SEQ ID NO: 73168 - RNA, 23 nt, Artificial Sequence
  Oligomer
ucuugcugucucacaacugccuc

SEQ ID NO: 73169 - RNA, 23 nt, Artificial Sequence
  Oligomer
uuaggcuggcccagauauucccc

SEQ ID NO: 73170 - RNA, 23 nt, Artificial Sequence
  Oligomer
aaaugcccagacuguuccugacc

SEQ ID NO: 73171 - RNA, 23 nt, Artificial Sequence
  Oligomer
gaaaugcccagacuguuccugac

SEQ ID NO: 73172 - RNA, 23 nt, Artificial Sequence
  Oligomer
agaaaugcccagacuguuccuga

SEQ ID NO: 73173 - RNA, 23 nt, Artificial Sequence
  Oligomer
augcccagacuguuccugaccuc

SEQ ID NO: 73174 - RNA, 23 nt, Artificial Sequence
  Oligomer
aaugcccagacuguuccugaccu

SEQ ID NO: 73175 - RNA, 23 nt, Artificial Sequence
  Oligomer
cuaccuccugagauuggaggccu

SEQ ID NO: 73176 - RNA, 23 nt, Artificial Sequence
  Oligomer
cccacagacuuuuaggcuggccc

SEQ ID NO: 73177 - RNA, 23 nt, Artificial Sequence
  Oligomer
ccccacagacuuuuaggcuggcc

SEQ ID NO: 73178 - RNA, 23 nt, Artificial Sequence
  Oligomer
gccccacagacuuuuaggcuggc

SEQ ID NO: 73179 - RNA, 23 nt, Artificial Sequence
  Oligomer
ggccccacagacuuuuaggcugg

SEQ ID NO: 73180 - RNA, 23 nt, Artificial Sequence
  Oligomer
aggccccacagacuuuuaggcug

SEQ ID NO: 73181 - RNA, 23 nt, Artificial Sequence
  Oligomer
aaucugcuuugucuucuacucgc

SEQ ID NO: 73182 - RNA, 23 nt, Artificial Sequence
  Oligomer
gaucucucucagaaucugcugga

SEQ ID NO: 73183 - RNA, 23 nt, Artificial Sequence
  Oligomer
ugccccacuucuccugguuccuu

SEQ ID NO: 73184 - RNA, 23 nt, Artificial Sequence
  Oligomer
cucacagugacacacaaccgccu

SEQ ID NO: 73185 - RNA, 23 nt, Artificial Sequence
  Oligomer
caagucucuccagugugugggga

SEQ ID NO: 73186 - RNA, 23 nt, Artificial Sequence
  Oligomer
aaucugggagaugccgagaccgg

SEQ ID NO: 73187 - RNA, 23 nt, Artificial Sequence
  Oligomer
gaaucugggagaugccgagaccg

SEQ ID NO: 73188 - RNA, 23 nt, Artificial Sequence
  Oligomer
gcccucugacacgguggagaugu

SEQ ID NO: 73189 - RNA, 23 nt, Artificial Sequence
  Oligomer
ucacaugcucuucuccugggcug

SEQ ID NO: 73190 - RNA, 23 nt, Artificial Sequence
  Oligomer
cuuggcacccuugaaucugggag

SEQ ID NO: 73191 - RNA, 23 nt, Artificial Sequence
  Oligomer
aaucugcuggacacgcuaccucc

SEQ ID NO: 73192 - RNA, 23 nt, Artificial Sequence
  Oligomer
aagucucuccaguguguggggac

SEQ ID NO: 73193 - RNA, 23 nt, Artificial Sequence
  Oligomer
agggcgaagaguucuuugcggcc

SEQ ID NO: 73194 - RNA, 23 nt, Artificial Sequence
  Oligomer
uaggcuggcccagauauucccca

SEQ ID NO: 73195 - RNA, 23 nt, Artificial Sequence
  Oligomer
ucacagugacacacaaccgccug

SEQ ID NO: 73196 - RNA, 23 nt, Artificial Sequence
  Oligomer
accaagaacugugugggaggccu

SEQ ID NO: 73197 - RNA, 23 nt, Artificial Sequence
  Oligomer
uuguccugcacagcaaccuccug

SEQ ID NO: 73198 - RNA, 23 nt, Artificial Sequence
  Oligomer
cuuguccugcacagcaaccuccu

SEQ ID NO: 73199 - RNA, 23 nt, Artificial Sequence
  Oligomer
ccuuguccugcacagcaaccucc

SEQ ID NO: 73200 - RNA, 23 nt, Artificial Sequence
  Oligomer
uucugacgcagagcaaccugcug

SEQ ID NO: 73201 - RNA, 23 nt, Artificial Sequence
  Oligomer
uuucugacgcagagcaaccugcu

SEQ ID NO: 73202 - RNA, 23 nt, Artificial Sequence
  Oligomer
aucaagcugccgagacuucgagg

SEQ ID NO: 73203 - RNA, 23 nt, Artificial Sequence
  Oligomer
cugguuccuugugguuucccgcc

SEQ ID NO: 73204 - RNA, 23 nt, Artificial Sequence
  Oligomer
aaguaccaggacagcauccgacg

SEQ ID NO: 73205 - RNA, 23 nt, Artificial Sequence
  Oligomer
uaccuccugagauuggaggccug

SEQ ID NO: 73206 - RNA, 23 nt, Artificial Sequence
  Oligomer
ugguuccuugugguuucccgccc

SEQ ID NO: 73207 - RNA, 23 nt, Artificial Sequence
  Oligomer
cgaguagaagacaaagcagauuc

SEQ ID NO: 73208 - RNA, 23 nt, Artificial Sequence
  Oligomer
gcuguugucauuccggguccuga

SEQ ID NO: 73209 - RNA, 23 nt, Artificial Sequence
  Oligomer
cuguugucauuccggguccugac

SEQ ID NO: 73210 - RNA, 23 nt, Artificial Sequence
  Oligomer
uguugucauuccggguccugacc

SEQ ID NO: 73211 - RNA, 23 nt, Artificial Sequence
  Oligomer
guugucauuccggguccugacca

SEQ ID NO: 73212 - RNA, 23 nt, Artificial Sequence
  Oligomer
uugucauuccggguccugaccac

SEQ ID NO: 73213 - RNA, 23 nt, Artificial Sequence
  Oligomer
gagguagcguguccagcagauuc

SEQ ID NO: 73214 - RNA, 23 nt, Artificial Sequence
  Oligomer
ccgaauccucugaagcaucuccu

SEQ ID NO: 73215 - RNA, 23 nt, Artificial Sequence
  Oligomer
cgaauccucugaagcaucuccug

SEQ ID NO: 73216 - RNA, 23 nt, Artificial Sequence
  Oligomer
gaauccucugaagcaucuccugc

SEQ ID NO: 73217 - RNA, 23 nt, Artificial Sequence
  Oligomer
aauccucugaagcaucuccugcg

SEQ ID NO: 73218 - RNA, 23 nt, Artificial Sequence
  Oligomer
auccucugaagcaucuccugcgg

SEQ ID NO: 73219 - RNA, 23 nt, Artificial Sequence
  Oligomer
ugugugucacugugaggaaggug

SEQ ID NO: 73220 - RNA, 23 nt, Artificial Sequence
  Oligomer
gugugucacugugaggaagguga

SEQ ID NO: 73221 - RNA, 23 nt, Artificial Sequence
  Oligomer
ugugucacugugaggaaggugag

SEQ ID NO: 73222 - RNA, 23 nt, Artificial Sequence
  Oligomer
uccgaauccucugaagcaucucc

SEQ ID NO: 73223 - RNA, 23 nt, Artificial Sequence
  Oligomer
gcgcucgaaggccgcaaagaacu

SEQ ID NO: 73224 - RNA, 23 nt, Artificial Sequence
  Oligomer
cgcucgaaggccgcaaagaacuc

SEQ ID NO: 73225 - RNA, 23 nt, Artificial Sequence
  Oligomer
ugccucuuccuccagguaggucu

SEQ ID NO: 73226 - RNA, 23 nt, Artificial Sequence
  Oligomer
gccucuuccuccagguaggucuc

SEQ ID NO: 73227 - RNA, 23 nt, Artificial Sequence
  Oligomer
ccucuuccuccagguaggucucc

SEQ ID NO: 73228 - RNA, 23 nt, Artificial Sequence
  Oligomer
cucuuccuccagguaggucucca

SEQ ID NO: 73229 - RNA, 23 nt, Artificial Sequence
  Oligomer
ucuuccuccagguaggucuccag

SEQ ID NO: 73230 - RNA, 23 nt, Artificial Sequence
  Oligomer
acacuggagagacuugaaggugg

SEQ ID NO: 73231 - RNA, 23 nt, Artificial Sequence
  Oligomer
cacuggagagacuugaagguggg

SEQ ID NO: 73232 - RNA, 23 nt, Artificial Sequence
  Oligomer
acuggagagacuugaaggugggg

SEQ ID NO: 73233 - RNA, 23 nt, Artificial Sequence
  Oligomer
cuggagagacuugaagguggggg

SEQ ID NO: 73234 - RNA, 23 nt, Artificial Sequence
  Oligomer
uggagagacuugaaggugggggc

SEQ ID NO: 73235 - RNA, 23 nt, Artificial Sequence
  Oligomer
uucugagagagaucgaggcgcug

SEQ ID NO: 73236 - RNA, 23 nt, Artificial Sequence
  Oligomer
gaauaucugggccagccuaaaag

SEQ ID NO: 73237 - RNA, 23 nt, Artificial Sequence
  Oligomer
aauaucugggccagccuaaaagu

SEQ ID NO: 73238 - RNA, 23 nt, Artificial Sequence
  Oligomer
auaucugggccagccuaaaaguc

SEQ ID NO: 73239 - RNA, 23 nt, Artificial Sequence
  Oligomer
uaucugggccagccuaaaagucu

SEQ ID NO: 73240 - RNA, 23 nt, Artificial Sequence
  Oligomer
aucugggccagccuaaaagucug

SEQ ID NO: 73241 - RNA, 23 nt, Artificial Sequence
  Oligomer
cgaacaucuccaccgugucagag

SEQ ID NO: 73242 - RNA, 23 nt, Artificial Sequence
  Oligomer
gaacaucuccaccgugucagagg

SEQ ID NO: 73243 - RNA, 23 nt, Artificial Sequence
  Oligomer
aacaucuccaccgugucagaggg

SEQ ID NO: 73244 - RNA, 23 nt, Artificial Sequence
  Oligomer
ucggaugcuguccugguacuugc

SEQ ID NO: 73245 - RNA, 23 nt, Artificial Sequence
  Oligomer
cggaugcuguccugguacuugcg

SEQ ID NO: 73246 - RNA, 23 nt, Artificial Sequence
  Oligomer
ggaugcuguccugguacuugcgg

SEQ ID NO: 73247 - RNA, 23 nt, Artificial Sequence
  Oligomer
gaugcuguccugguacuugcggc

SEQ ID NO: 73248 - RNA, 23 nt, Artificial Sequence
  Oligomer
augcuguccugguacuugcggcg

SEQ ID NO: 73249 - RNA, 23 nt, Artificial Sequence
  Oligomer
uccucugaagcaucuccugcggc

SEQ ID NO: 73250 - RNA, 23 nt, Artificial Sequence
  Oligomer
gagguugcugugcaggacaagga

SEQ ID NO: 73251 - RNA, 23 nt, Artificial Sequence
  Oligomer
agguugcugugcaggacaaggag

SEQ ID NO: 73252 - RNA, 23 nt, Artificial Sequence
  Oligomer
gguugcugugcaggacaaggagc

SEQ ID NO: 73253 - RNA, 23 nt, Artificial Sequence
  Oligomer
guugcugugcaggacaaggagcc

SEQ ID NO: 73254 - RNA, 23 nt, Artificial Sequence
  Oligomer
uugcugugcaggacaaggagccg

SEQ ID NO: 73255 - RNA, 23 nt, Artificial Sequence
  Oligomer
caggaacagucugggcauuucug

SEQ ID NO: 73256 - RNA, 23 nt, Artificial Sequence
  Oligomer
aggaacagucugggcauuucugg

SEQ ID NO: 73257 - RNA, 23 nt, Artificial Sequence
  Oligomer
ggaacagucugggcauuucugga

SEQ ID NO: 73258 - RNA, 23 nt, Artificial Sequence
  Oligomer
gaacagucugggcauuucuggaa

SEQ ID NO: 73259 - RNA, 23 nt, Artificial Sequence
  Oligomer
aacagucugggcauuucuggaau

SEQ ID NO: 73260 - RNA, 23 nt, Artificial Sequence
  Oligomer
cauccagaucaucccggaacucg

SEQ ID NO: 73261 - RNA, 23 nt, Artificial Sequence
  Oligomer
auccagaucaucccggaacucgu

SEQ ID NO: 73262 - RNA, 23 nt, Artificial Sequence
  Oligomer
uucaagggugccaaggagaggcc

SEQ ID NO: 73263 - RNA, 23 nt, Artificial Sequence
  Oligomer
cggcagugucuccaggcuguuga

SEQ ID NO: 73264 - RNA, 23 nt, Artificial Sequence
  Oligomer
ggcagugucuccaggcuguugaa

SEQ ID NO: 73265 - RNA, 23 nt, Artificial Sequence
  Oligomer
gcagugucuccaggcuguugaag

SEQ ID NO: 73266 - RNA, 23 nt, Artificial Sequence
  Oligomer
cagugucuccaggcuguugaagc

SEQ ID NO: 73267 - RNA, 23 nt, Artificial Sequence
  Oligomer
agugucuccaggcuguugaagcu

SEQ ID NO: 73268 - RNA, 23 nt, Artificial Sequence
  Oligomer
uccagaucaucccggaacucgug

SEQ ID NO: 73269 - RNA, 23 nt, Artificial Sequence
  Oligomer
ccagaucaucccggaacucgugc

SEQ ID NO: 73270 - RNA, 23 nt, Artificial Sequence
  Oligomer
cagaucaucccggaacucgugcc

SEQ ID NO: 73271 - RNA, 23 nt, Artificial Sequence
  Oligomer
agaucaucccggaacucgugccg

SEQ ID NO: 73272 - RNA, 23 nt, Artificial Sequence
  Oligomer
ggccucccacacaguucuuggug

SEQ ID NO: 73273 - RNA, 23 nt, Artificial Sequence
  Oligomer
gccucccacacaguucuuggugg

SEQ ID NO: 73274 - RNA, 23 nt, Artificial Sequence
  Oligomer
ccucccacacaguucuugguggu

SEQ ID NO: 73275 - RNA, 23 nt, Artificial Sequence
  Oligomer
cucccacacaguucuugguggug

SEQ ID NO: 73276 - RNA, 23 nt, Artificial Sequence
  Oligomer
ucccagauucaagggugccaagg

SEQ ID NO: 73277 - RNA, 23 nt, Artificial Sequence
  Oligomer
cccagauucaagggugccaagga

SEQ ID NO: 73278 - RNA, 23 nt, Artificial Sequence
  Oligomer
acagucugggcauuucuggaaug

SEQ ID NO: 73279 - RNA, 23 nt, Artificial Sequence
  Oligomer
gcucagagaggcaguugugagac

SEQ ID NO: 73280 - RNA, 23 nt, Artificial Sequence
  Oligomer
cucagagaggcaguugugagaca

SEQ ID NO: 73281 - RNA, 23 nt, Artificial Sequence
  Oligomer
ucagagaggcaguugugagacag

SEQ ID NO: 73282 - RNA, 23 nt, Artificial Sequence
  Oligomer
ccccacacacuggagagacuuga

SEQ ID NO: 73283 - RNA, 23 nt, Artificial Sequence
  Oligomer
cccacacacuggagagacuugaa

SEQ ID NO: 73284 - RNA, 23 nt, Artificial Sequence
  Oligomer
ccacacacuggagagacuugaag

SEQ ID NO: 73285 - RNA, 23 nt, Artificial Sequence
  Oligomer
cacacacuggagagacuugaagg

SEQ ID NO: 73286 - RNA, 23 nt, Artificial Sequence
  Oligomer
acacacuggagagacuugaaggu

SEQ ID NO: 73287 - RNA, 23 nt, Artificial Sequence
  Oligomer
ucugggccagccuaaaagucugu

SEQ ID NO: 73288 - RNA, 23 nt, Artificial Sequence
  Oligomer
cugggccagccuaaaagucugug

SEQ ID NO: 73289 - RNA, 23 nt, Artificial Sequence
  Oligomer
ugggccagccuaaaagucugugg

SEQ ID NO: 73290 - RNA, 23 nt, Artificial Sequence
  Oligomer
uuucuggaaugagggcugccacu

SEQ ID NO: 73291 - RNA, 23 nt, Artificial Sequence
  Oligomer
agaacucuucgcccucgaacauc

SEQ ID NO: 73292 - RNA, 23 nt, Artificial Sequence
  Oligomer
agagcaugugacggaucugcuca

SEQ ID NO: 73293 - RNA, 23 nt, Artificial Sequence
  Oligomer
gagcaugugacggaucugcucau

SEQ ID NO: 73294 - RNA, 23 nt, Artificial Sequence
  Oligomer
agcaugugacggaucugcucauc

SEQ ID NO: 73295 - RNA, 23 nt, Artificial Sequence
  Oligomer
gcaugugacggaucugcucaucc

SEQ ID NO: 73296 - RNA, 23 nt, Artificial Sequence
  Oligomer
caugugacggaucugcucaucca

SEQ ID NO: 73297 - RNA, 23 nt, Artificial Sequence
  Oligomer
gugucacugugaggaaggugagg

SEQ ID NO: 73298 - RNA, 23 nt, Artificial Sequence
  Oligomer
ugucacugugaggaaggugaggg

SEQ ID NO: 73299 - RNA, 23 nt, Artificial Sequence
  Oligomer
cacacuggagagacuugaaggug

SEQ ID NO: 73300 - RNA, 23 nt, Artificial Sequence
  Oligomer
ggaauaucugggccagccuaaaa

SEQ ID NO: 73301 - RNA, 23 nt, Artificial Sequence
  Oligomer
ggucucggcaucucccagauuca

SEQ ID NO: 73302 - RNA, 23 nt, Artificial Sequence
  Oligomer
gucucggcaucucccagauucaa

SEQ ID NO: 73303 - RNA, 23 nt, Artificial Sequence
  Oligomer
ucucggcaucucccagauucaag

SEQ ID NO: 73304 - RNA, 23 nt, Artificial Sequence
  Oligomer
cucggcaucucccagauucaagg

SEQ ID NO: 73305 - RNA, 23 nt, Artificial Sequence
  Oligomer
aagcagauucugcccuccacaca

SEQ ID NO: 73306 - RNA, 23 nt, Artificial Sequence
  Oligomer
cucgaagucucggcagcuugaug

SEQ ID NO: 73307 - RNA, 23 nt, Artificial Sequence
  Oligomer
ucgaagucucggcagcuugaugg

SEQ ID NO: 73308 - RNA, 23 nt, Artificial Sequence
  Oligomer
cgaagucucggcagcuugauggg

SEQ ID NO: 73309 - RNA, 23 nt, Artificial Sequence
  Oligomer
gaagucucggcagcuugaugggc

SEQ ID NO: 73310 - RNA, 23 nt, Artificial Sequence
  Oligomer
aagucucggcagcuugaugggca

SEQ ID NO: 73311 - RNA, 23 nt, Artificial Sequence
  Oligomer
gccgcaaagaacucuucgcccuc

SEQ ID NO: 73312 - RNA, 23 nt, Artificial Sequence
  Oligomer
agucugggcauuucuggaaugag

SEQ ID NO: 73313 - RNA, 23 nt, Artificial Sequence
  Oligomer
gucugggcauuucuggaaugagg

SEQ ID NO: 73314 - RNA, 23 nt, Artificial Sequence
  Oligomer
ucugggcauuucuggaaugaggg

SEQ ID NO: 73315 - RNA, 23 nt, Artificial Sequence
  Oligomer
cugggcauuucuggaaugagggc

SEQ ID NO: 73316 - RNA, 23 nt, Artificial Sequence
  Oligomer
ggcgguugugugucacugugagg

SEQ ID NO: 73317 - RNA, 23 nt, Artificial Sequence
  Oligomer
gucggaugcuguccugguacuug

SEQ ID NO: 73318 - RNA, 23 nt, Artificial Sequence
  Oligomer
uuggugguguaccagagccagua

SEQ ID NO: 73319 - RNA, 23 nt, Artificial Sequence
  Oligomer
uggugguguaccagagccaguac

SEQ ID NO: 73320 - RNA, 23 nt, Artificial Sequence
  Oligomer
ggugguguaccagagccaguaca

SEQ ID NO: 73321 - RNA, 23 nt, Artificial Sequence
  Oligomer
gugguguaccagagccaguacag

SEQ ID NO: 73322 - RNA, 23 nt, Artificial Sequence
  Oligomer
ugguguaccagagccaguacagg

SEQ ID NO: 73323 - RNA, 23 nt, Artificial Sequence
  Oligomer
ugcguccgaauccucugaagcau

SEQ ID NO: 73324 - RNA, 23 nt, Artificial Sequence
  Oligomer
gcguccgaauccucugaagcauc

SEQ ID NO: 73325 - RNA, 23 nt, Artificial Sequence
  Oligomer
cguccgaauccucugaagcaucu

SEQ ID NO: 73326 - RNA, 23 nt, Artificial Sequence
  Oligomer
guccgaauccucugaagcaucuc

SEQ ID NO: 73327 - RNA, 23 nt, Artificial Sequence
  Oligomer
cucgugagugcucagacgcaaga

SEQ ID NO: 73328 - RNA, 23 nt, Artificial Sequence
  Oligomer
ucgugagugcucagacgcaagaa

SEQ ID NO: 73329 - RNA, 23 nt, Artificial Sequence
  Oligomer
cgugagugcucagacgcaagaau

SEQ ID NO: 73330 - RNA, 23 nt, Artificial Sequence
  Oligomer
gugagugcucagacgcaagaauu

SEQ ID NO: 73331 - RNA, 23 nt, Artificial Sequence
  Oligomer
ugagugcucagacgcaagaauuc

SEQ ID NO: 73332 - RNA, 23 nt, Artificial Sequence
  Oligomer
cugaggucaggaacagucugggc

SEQ ID NO: 73333 - RNA, 23 nt, Artificial Sequence
  Oligomer
ugaggucaggaacagucugggca

SEQ ID NO: 73334 - RNA, 23 nt, Artificial Sequence
  Oligomer
agcagauucugcccuccacacag

SEQ ID NO: 73335 - RNA, 23 nt, Artificial Sequence
  Oligomer
ugugacggaucugcucauccaga

SEQ ID NO: 73336 - RNA, 23 nt, Artificial Sequence
  Oligomer
gugacggaucugcucauccagau

SEQ ID NO: 73337 - RNA, 23 nt, Artificial Sequence
  Oligomer
ugacggaucugcucauccagauc

SEQ ID NO: 73338 - RNA, 23 nt, Artificial Sequence
  Oligomer
caggaccaccugagcugugaugu

SEQ ID NO: 73339 - RNA, 23 nt, Artificial Sequence
  Oligomer
aggaccaccugagcugugauguc

SEQ ID NO: 73340 - RNA, 23 nt, Artificial Sequence
  Oligomer
cagagaggcaguugugagacagc

SEQ ID NO: 73341 - RNA, 23 nt, Artificial Sequence
  Oligomer
agagaggcaguugugagacagca

SEQ ID NO: 73342 - RNA, 23 nt, Artificial Sequence
  Oligomer
gagugcucagacgcaagaauucc

SEQ ID NO: 73343 - RNA, 23 nt, Artificial Sequence
  Oligomer
ccccagcuguugucauuccgggu

SEQ ID NO: 73344 - RNA, 23 nt, Artificial Sequence
  Oligomer
cccagcuguugucauuccggguc

SEQ ID NO: 73345 - RNA, 23 nt, Artificial Sequence
  Oligomer
ccagcuguugucauuccgggucc

SEQ ID NO: 73346 - RNA, 23 nt, Artificial Sequence
  Oligomer
cagcuguugucauuccggguccu

SEQ ID NO: 73347 - RNA, 23 nt, Artificial Sequence
  Oligomer
agcuguugucauuccggguccug

SEQ ID NO: 73348 - RNA, 23 nt, Artificial Sequence
  Oligomer
acccugcguccgaauccucugaa

SEQ ID NO: 73349 - RNA, 23 nt, Artificial Sequence
  Oligomer
cccugcguccgaauccucugaag

SEQ ID NO: 73350 - RNA, 23 nt, Artificial Sequence
  Oligomer
ccugcguccgaauccucugaagc

SEQ ID NO: 73351 - RNA, 23 nt, Artificial Sequence
  Oligomer
cugcguccgaauccucugaagca

SEQ ID NO: 73352 - RNA, 23 nt, Artificial Sequence
  Oligomer
augugacggaucugcucauccag

SEQ ID NO: 73353 - RNA, 23 nt, Artificial Sequence
  Oligomer
gcagguugcucugcgucagaaag

SEQ ID NO: 73354 - RNA, 23 nt, Artificial Sequence
  Oligomer
gagaggcaguugugagacagcaa

SEQ ID NO: 73355 - RNA, 23 nt, Artificial Sequence
  Oligomer
agaggcaguugugagacagcaag

SEQ ID NO: 73356 - RNA, 23 nt, Artificial Sequence
  Oligomer
gggaauaucugggccagccuaaa

SEQ ID NO: 73357 - RNA, 23 nt, Artificial Sequence
  Oligomer
gugucuccaggcuguugaagcuc

SEQ ID NO: 73358 - RNA, 23 nt, Artificial Sequence
  Oligomer
cagucugggcauuucuggaauga

SEQ ID NO: 73359 - RNA, 23 nt, Artificial Sequence
  Oligomer
gucacugugaggaaggugagggc

SEQ ID NO: 73360 - RNA, 23 nt, Artificial Sequence
  Oligomer
ucacaggaaagcuguccaaaucu

SEQ ID NO: 73361 - RNA, 23 nt, Artificial Sequence
  Oligomer
cacaggaaagcuguccaaaucug

SEQ ID NO: 73362 - RNA, 23 nt, Artificial Sequence
  Oligomer
acaggaaagcuguccaaaucuga

SEQ ID NO: 73363 - RNA, 23 nt, Artificial Sequence
  Oligomer
ucacugugaggaaggugagggcg

SEQ ID NO: 73364 - RNA, 23 nt, Artificial Sequence
  Oligomer
gaggcaguugugagacagcaaga

SEQ ID NO: 73365 - RNA, 23 nt, Artificial Sequence
  Oligomer
ggggaauaucugggccagccuaa

SEQ ID NO: 73366 - RNA, 23 nt, Artificial Sequence
  Oligomer
ggucaggaacagucugggcauuu

SEQ ID NO: 73367 - RNA, 23 nt, Artificial Sequence
  Oligomer
gucaggaacagucugggcauuuc

SEQ ID NO: 73368 - RNA, 23 nt, Artificial Sequence
  Oligomer
ucaggaacagucugggcauuucu

SEQ ID NO: 73369 - RNA, 23 nt, Artificial Sequence
  Oligomer
gaggucaggaacagucugggcau

SEQ ID NO: 73370 - RNA, 23 nt, Artificial Sequence
  Oligomer
aggucaggaacagucugggcauu

SEQ ID NO: 73371 - RNA, 23 nt, Artificial Sequence
  Oligomer
aggccuccaaucucaggagguag

SEQ ID NO: 73372 - RNA, 23 nt, Artificial Sequence
  Oligomer
gggccagccuaaaagucuguggg

SEQ ID NO: 73373 - RNA, 23 nt, Artificial Sequence
  Oligomer
ggccagccuaaaagucugugggg

SEQ ID NO: 73374 - RNA, 23 nt, Artificial Sequence
  Oligomer
gccagccuaaaagucuguggggc

SEQ ID NO: 73375 - RNA, 23 nt, Artificial Sequence
  Oligomer
ccagccuaaaagucuguggggcc

SEQ ID NO: 73376 - RNA, 23 nt, Artificial Sequence
  Oligomer
cagccuaaaagucuguggggccu

SEQ ID NO: 73377 - RNA, 23 nt, Artificial Sequence
  Oligomer
gcgaguagaagacaaagcagauu

SEQ ID NO: 73378 - RNA, 23 nt, Artificial Sequence
  Oligomer
uccagcagauucugagagagauc

SEQ ID NO: 73379 - RNA, 23 nt, Artificial Sequence
  Oligomer
aaggaaccaggagaaguggggca

SEQ ID NO: 73380 - RNA, 23 nt, Artificial Sequence
  Oligomer
aggcgguugugugucacugugag

SEQ ID NO: 73381 - RNA, 23 nt, Artificial Sequence
  Oligomer
uccccacacacuggagagacuug

SEQ ID NO: 73382 - RNA, 23 nt, Artificial Sequence
  Oligomer
ccggucucggcaucucccagauu

SEQ ID NO: 73383 - RNA, 23 nt, Artificial Sequence
  Oligomer
cggucucggcaucucccagauuc

SEQ ID NO: 73384 - RNA, 23 nt, Artificial Sequence
  Oligomer
acaucuccaccgugucagagggc

SEQ ID NO: 73385 - RNA, 23 nt, Artificial Sequence
  Oligomer
cagcccaggagaagagcauguga

SEQ ID NO: 73386 - RNA, 23 nt, Artificial Sequence
  Oligomer
cucccagauucaagggugccaag

SEQ ID NO: 73387 - RNA, 23 nt, Artificial Sequence
  Oligomer
ggagguagcguguccagcagauu

SEQ ID NO: 73388 - RNA, 23 nt, Artificial Sequence
  Oligomer
guccccacacacuggagagacuu

SEQ ID NO: 73389 - RNA, 23 nt, Artificial Sequence
  Oligomer
ggccgcaaagaacucuucgcccu

SEQ ID NO: 73390 - RNA, 23 nt, Artificial Sequence
  Oligomer
uggggaauaucugggccagccua

SEQ ID NO: 73391 - RNA, 23 nt, Artificial Sequence
  Oligomer
caggcgguugugugucacuguga

SEQ ID NO: 73392 - RNA, 23 nt, Artificial Sequence
  Oligomer
aggccucccacacaguucuuggu

SEQ ID NO: 73393 - RNA, 23 nt, Artificial Sequence
  Oligomer
caggagguugcugugcaggacaa

SEQ ID NO: 73394 - RNA, 23 nt, Artificial Sequence
  Oligomer
aggagguugcugugcaggacaag

SEQ ID NO: 73395 - RNA, 23 nt, Artificial Sequence
  Oligomer
ggagguugcugugcaggacaagg

SEQ ID NO: 73396 - RNA, 23 nt, Artificial Sequence
  Oligomer
cagcagguugcucugcgucagaa

SEQ ID NO: 73397 - RNA, 23 nt, Artificial Sequence
  Oligomer
agcagguugcucugcgucagaaa

SEQ ID NO: 73398 - RNA, 23 nt, Artificial Sequence
  Oligomer
ccucgaagucucggcagcuugau

SEQ ID NO: 73399 - RNA, 23 nt, Artificial Sequence
  Oligomer
ggcgggaaaccacaaggaaccag

SEQ ID NO: 73400 - RNA, 23 nt, Artificial Sequence
  Oligomer
cgucggaugcuguccugguacuu

SEQ ID NO: 73401 - RNA, 23 nt, Artificial Sequence
  Oligomer
caggccuccaaucucaggaggua

SEQ ID NO: 73402 - RNA, 23 nt, Artificial Sequence
  Oligomer
gggcgggaaaccacaaggaacca

SEQ ID NO: 73403 - RNA, 19 nt, Artificial Sequence
  Oligomer
uguuugugugccugcugga

SEQ ID NO: 73404 - RNA, 19 nt, Artificial Sequence
  Oligomer
cuuuggugccuacuccauu

SEQ ID NO: 73405 - RNA, 19 nt, Artificial Sequence
  Oligomer
cuuuaccaggaauuacuau

SEQ ID NO: 73406 - RNA, 19 nt, Artificial Sequence
  Oligomer
caggaauuacuauguucgg

SEQ ID NO: 73407 - RNA, 19 nt, Artificial Sequence
  Oligomer
uacuuuggugccuacucca

SEQ ID NO: 73408 - RNA, 19 nt, Artificial Sequence
  Oligomer
gguacuuuggugccuacuc

SEQ ID NO: 73409 - RNA, 19 nt, Artificial Sequence
  Oligomer
cacccagugguacuuuggu

SEQ ID NO: 73410 - RNA, 19 nt, Artificial Sequence
  Oligomer
aagcuguucgggcccuuua

SEQ ID NO: 73411 - RNA, 19 nt, Artificial Sequence
  Oligomer
gggacagaaguacaugacc

SEQ ID NO: 73412 - RNA, 19 nt, Artificial Sequence
  Oligomer
acuuuggugccuacuccau

SEQ ID NO: 73413 - RNA, 19 nt, Artificial Sequence
  Oligomer
gaauuacuauguucgggcc

SEQ ID NO: 73414 - RNA, 19 nt, Artificial Sequence
  Oligomer
aagaggaagaagggcucca

SEQ ID NO: 73415 - RNA, 19 nt, Artificial Sequence
  Oligomer
uuugugugccugcuggagu

SEQ ID NO: 73416 - RNA, 19 nt, Artificial Sequence
  Oligomer
gacagaaguacaugaccgc

SEQ ID NO: 73417 - RNA, 19 nt, Artificial Sequence
  Oligomer
aggaauuacuauguucggg

SEQ ID NO: 73418 - RNA, 19 nt, Artificial Sequence
  Oligomer
guacuuuggugccuacucc

SEQ ID NO: 73419 - RNA, 19 nt, Artificial Sequence
  Oligomer
auuacuauguucgggccgu

SEQ ID NO: 73420 - RNA, 19 nt, Artificial Sequence
  Oligomer
cuucacccagugguacuuu

SEQ ID NO: 73421 - RNA, 19 nt, Artificial Sequence
  Oligomer
ugguacuuuggugccuacu

SEQ ID NO: 73422 - RNA, 19 nt, Artificial Sequence
  Oligomer
uucacccagugguacuuug

SEQ ID NO: 73423 - RNA, 19 nt, Artificial Sequence
  Oligomer
uuacuauguucgggccguc

SEQ ID NO: 73424 - RNA, 19 nt, Artificial Sequence
  Oligomer
uggugccuacuccauugug

SEQ ID NO: 73425 - RNA, 19 nt, Artificial Sequence
  Oligomer
uuuaccaggaauuacuaug

SEQ ID NO: 73426 - RNA, 19 nt, Artificial Sequence
  Oligomer
ucacccagugguacuuugg

SEQ ID NO: 73427 - RNA, 19 nt, Artificial Sequence
  Oligomer
aauuacuauguucgggccg

SEQ ID NO: 73428 - RNA, 19 nt, Artificial Sequence
  Oligomer
uuggugccuacuccauugu

SEQ ID NO: 73429 - RNA, 19 nt, Artificial Sequence
  Oligomer
acagaaguacaugaccgcc

SEQ ID NO: 73430 - RNA, 19 nt, Artificial Sequence
  Oligomer
uccagcaggcacacaaaca

SEQ ID NO: 73431 - RNA, 19 nt, Artificial Sequence
  Oligomer
aauggaguaggcaccaaag

SEQ ID NO: 73432 - RNA, 19 nt, Artificial Sequence
  Oligomer
auaguaauuccugguaaag

SEQ ID NO: 73433 - RNA, 19 nt, Artificial Sequence
  Oligomer
ccgaacauaguaauuccug

SEQ ID NO: 73434 - RNA, 19 nt, Artificial Sequence
  Oligomer
uggaguaggcaccaaagua

SEQ ID NO: 73435 - RNA, 19 nt, Artificial Sequence
  Oligomer
gaguaggcaccaaaguacc

SEQ ID NO: 73436 - RNA, 19 nt, Artificial Sequence
  Oligomer
accaaaguaccacugggug

SEQ ID NO: 73437 - RNA, 19 nt, Artificial Sequence
  Oligomer
uaaagggcccgaacagcuu

SEQ ID NO: 73438 - RNA, 19 nt, Artificial Sequence
  Oligomer
ggucauguacuucuguccc

SEQ ID NO: 73439 - RNA, 19 nt, Artificial Sequence
  Oligomer
auggaguaggcaccaaagu

SEQ ID NO: 73440 - RNA, 19 nt, Artificial Sequence
  Oligomer
ggcccgaacauaguaauuc

SEQ ID NO: 73441 - RNA, 19 nt, Artificial Sequence
  Oligomer
uggagcccuucuuccucuu

SEQ ID NO: 73442 - RNA, 19 nt, Artificial Sequence
  Oligomer
acuccagcaggcacacaaa

SEQ ID NO: 73443 - RNA, 19 nt, Artificial Sequence
  Oligomer
gcggucauguacuucuguc

SEQ ID NO: 73444 - RNA, 19 nt, Artificial Sequence
  Oligomer
cccgaacauaguaauuccu

SEQ ID NO: 73445 - RNA, 19 nt, Artificial Sequence
  Oligomer
ggaguaggcaccaaaguac

SEQ ID NO: 73446 - RNA, 19 nt, Artificial Sequence
  Oligomer
acggcccgaacauaguaau

SEQ ID NO: 73447 - RNA, 19 nt, Artificial Sequence
  Oligomer
aaaguaccacugggugaag

SEQ ID NO: 73448 - RNA, 19 nt, Artificial Sequence
  Oligomer
aguaggcaccaaaguacca

SEQ ID NO: 73449 - RNA, 19 nt, Artificial Sequence
  Oligomer
caaaguaccacugggugaa

SEQ ID NO: 73450 - RNA, 19 nt, Artificial Sequence
  Oligomer
gacggcccgaacauaguaa

SEQ ID NO: 73451 - RNA, 19 nt, Artificial Sequence
  Oligomer
cacaauggaguaggcacca

SEQ ID NO: 73452 - RNA, 19 nt, Artificial Sequence
  Oligomer
cauaguaauuccugguaaa

SEQ ID NO: 73453 - RNA, 19 nt, Artificial Sequence
  Oligomer
ccaaaguaccacuggguga

SEQ ID NO: 73454 - RNA, 19 nt, Artificial Sequence
  Oligomer
cggcccgaacauaguaauu

SEQ ID NO: 73455 - RNA, 19 nt, Artificial Sequence
  Oligomer
acaauggaguaggcaccaa

SEQ ID NO: 73456 - RNA, 19 nt, Artificial Sequence
  Oligomer
ggcggucauguacuucugu

SEQ ID NO: 73457 - RNA, 21 nt, Artificial Sequence
  Oligomer
guuugugugccugcuggagua

SEQ ID NO: 73458 - RNA, 21 nt, Artificial Sequence
  Oligomer
cuuuggugccuacuccauugu

SEQ ID NO: 73459 - RNA, 21 nt, Artificial Sequence
  Oligomer
gcuucacccagugguacuuug

SEQ ID NO: 73460 - RNA, 21 nt, Artificial Sequence
  Oligomer
caggaauuacuauguucgggc

SEQ ID NO: 73461 - RNA, 21 nt, Artificial Sequence
  Oligomer
uguuugugugccugcuggagu

SEQ ID NO: 73462 - RNA, 21 nt, Artificial Sequence
  Oligomer
auugcgagcggcaucuaccua

SEQ ID NO: 73463 - RNA, 21 nt, Artificial Sequence
  Oligomer
uacuuuggugccuacuccauu

SEQ ID NO: 73464 - RNA, 21 nt, Artificial Sequence
  Oligomer
uucgggcccuuuaccaggaau

SEQ ID NO: 73465 - RNA, 21 nt, Artificial Sequence
  Oligomer
gaauuacuauguucgggccgu

SEQ ID NO: 73466 - RNA, 21 nt, Artificial Sequence
  Oligomer
agugguacuuuggugccuacu

SEQ ID NO: 73467 - RNA, 21 nt, Artificial Sequence
  Oligomer
ccuuuaccaggaauuacuaug

SEQ ID NO: 73468 - RNA, 21 nt, Artificial Sequence
  Oligomer
ccaggaauuacuauguucggg

SEQ ID NO: 73469 - RNA, 21 nt, Artificial Sequence
  Oligomer
uuaccaggaauuacuauguuc

SEQ ID NO: 73470 - RNA, 21 nt, Artificial Sequence
  Oligomer
cuuuaccaggaauuacuaugu

SEQ ID NO: 73471 - RNA, 21 nt, Artificial Sequence
  Oligomer
gugguacuuuggugccuacuc

SEQ ID NO: 73472 - RNA, 21 nt, Artificial Sequence
  Oligomer
accaggaauuacuauguucgg

SEQ ID NO: 73473 - RNA, 21 nt, Artificial Sequence
  Oligomer
cuucacccagugguacuuugg

SEQ ID NO: 73474 - RNA, 21 nt, Artificial Sequence
  Oligomer
uuacuauguucgggccguccu

SEQ ID NO: 73475 - RNA, 21 nt, Artificial Sequence
  Oligomer
acuuuggugccuacuccauug

SEQ ID NO: 73476 - RNA, 21 nt, Artificial Sequence
  Oligomer
uuuggugccuacuccauugug

SEQ ID NO: 73477 - RNA, 21 nt, Artificial Sequence
  Oligomer
uucacccagugguacuuuggu

SEQ ID NO: 73478 - RNA, 21 nt, Artificial Sequence
  Oligomer
uaccaggaauuacuauguucg

SEQ ID NO: 73479 - RNA, 21 nt, Artificial Sequence
  Oligomer
aggaauuacuauguucgggcc

SEQ ID NO: 73480 - RNA, 21 nt, Artificial Sequence
  Oligomer
aauuacuauguucgggccguc

SEQ ID NO: 73481 - RNA, 21 nt, Artificial Sequence
  Oligomer
ucacccagugguacuuuggug

SEQ ID NO: 73482 - RNA, 21 nt, Artificial Sequence
  Oligomer
uuugugugccugcuggaguac

SEQ ID NO: 73483 - RNA, 21 nt, Artificial Sequence
  Oligomer
ugguacuuuggugccuacucc

SEQ ID NO: 73484 - RNA, 21 nt, Artificial Sequence
  Oligomer
auuacuauguucgggccgucc

SEQ ID NO: 73485 - RNA, 21 nt, Artificial Sequence
  Oligomer
uuggugccuacuccauugugg

SEQ ID NO: 73486 - RNA, 21 nt, Artificial Sequence
  Oligomer
uacuccagcaggcacacaaac

SEQ ID NO: 73487 - RNA, 21 nt, Artificial Sequence
  Oligomer
acaauggaguaggcaccaaag

SEQ ID NO: 73488 - RNA, 21 nt, Artificial Sequence
  Oligomer
caaaguaccacugggugaagc

SEQ ID NO: 73489 - RNA, 21 nt, Artificial Sequence
  Oligomer
gcccgaacauaguaauuccug

SEQ ID NO: 73490 - RNA, 21 nt, Artificial Sequence
  Oligomer
acuccagcaggcacacaaaca

SEQ ID NO: 73491 - RNA, 21 nt, Artificial Sequence
  Oligomer
uagguagaugccgcucgcaau

SEQ ID NO: 73492 - RNA, 21 nt, Artificial Sequence
  Oligomer
aauggaguaggcaccaaagua

SEQ ID NO: 73493 - RNA, 21 nt, Artificial Sequence
  Oligomer
auuccugguaaagggcccgaa

SEQ ID NO: 73494 - RNA, 21 nt, Artificial Sequence
  Oligomer
acggcccgaacauaguaauuc

SEQ ID NO: 73495 - RNA, 21 nt, Artificial Sequence
  Oligomer
aguaggcaccaaaguaccacu

SEQ ID NO: 73496 - RNA, 21 nt, Artificial Sequence
  Oligomer
cauaguaauuccugguaaagg

SEQ ID NO: 73497 - RNA, 21 nt, Artificial Sequence
  Oligomer
cccgaacauaguaauuccugg

SEQ ID NO: 73498 - RNA, 21 nt, Artificial Sequence
  Oligomer
gaacauaguaauuccugguaa

SEQ ID NO: 73499 - RNA, 21 nt, Artificial Sequence
  Oligomer
acauaguaauuccugguaaag

SEQ ID NO: 73500 - RNA, 21 nt, Artificial Sequence
  Oligomer
gaguaggcaccaaaguaccac

SEQ ID NO: 73501 - RNA, 21 nt, Artificial Sequence
  Oligomer
ccgaacauaguaauuccuggu

SEQ ID NO: 73502 - RNA, 21 nt, Artificial Sequence
  Oligomer
ccaaaguaccacugggugaag

SEQ ID NO: 73503 - RNA, 21 nt, Artificial Sequence
  Oligomer
aggacggcccgaacauaguaa

SEQ ID NO: 73504 - RNA, 21 nt, Artificial Sequence
  Oligomer
caauggaguaggcaccaaagu

SEQ ID NO: 73505 - RNA, 21 nt, Artificial Sequence
  Oligomer
cacaauggaguaggcaccaaa

SEQ ID NO: 73506 - RNA, 21 nt, Artificial Sequence
  Oligomer
accaaaguaccacugggugaa

SEQ ID NO: 73507 - RNA, 21 nt, Artificial Sequence
  Oligomer
cgaacauaguaauuccuggua

SEQ ID NO: 73508 - RNA, 21 nt, Artificial Sequence
  Oligomer
ggcccgaacauaguaauuccu

SEQ ID NO: 73509 - RNA, 21 nt, Artificial Sequence
  Oligomer
gacggcccgaacauaguaauu

SEQ ID NO: 73510 - RNA, 21 nt, Artificial Sequence
  Oligomer
caccaaaguaccacuggguga

SEQ ID NO: 73511 - RNA, 21 nt, Artificial Sequence
  Oligomer
guacuccagcaggcacacaaa

SEQ ID NO: 73512 - RNA, 21 nt, Artificial Sequence
  Oligomer
ggaguaggcaccaaaguacca

SEQ ID NO: 73513 - RNA, 21 nt, Artificial Sequence
  Oligomer
ggacggcccgaacauaguaau

SEQ ID NO: 73514 - RNA, 21 nt, Artificial Sequence
  Oligomer
ccacaauggaguaggcaccaa

SEQ ID NO: 73515 - RNA, 23 nt, Artificial Sequence
  Oligomer
aaguacaugaccgccguggugaa

SEQ ID NO: 73516 - RNA, 23 nt, Artificial Sequence
  Oligomer
uguucgggcccuuuaccaggaau

SEQ ID NO: 73517 - RNA, 23 nt, Artificial Sequence
  Oligomer
auugcgagcggcaucuaccuacu

SEQ ID NO: 73518 - RNA, 23 nt, Artificial Sequence
  Oligomer
uucaccacggcggucauguacuu

SEQ ID NO: 73519 - RNA, 23 nt, Artificial Sequence
  Oligomer
auuccugguaaagggcccgaaca

SEQ ID NO: 73520 - RNA, 23 nt, Artificial Sequence
  Oligomer
aguagguagaugccgcucgcaau

SEQ ID NO: 73521 - RNA, 23 nt, Artificial Sequence
  Oligomer
uugugugccugcuggaguacccc

SEQ ID NO: 73522 - RNA, 23 nt, Artificial Sequence
  Oligomer
uuugugugccugcuggaguaccc

SEQ ID NO: 73523 - RNA, 23 nt, Artificial Sequence
  Oligomer
guuugugugccugcuggaguacc

SEQ ID NO: 73524 - RNA, 23 nt, Artificial Sequence
  Oligomer
uguuugugugccugcuggaguac

SEQ ID NO: 73525 - RNA, 23 nt, Artificial Sequence
  Oligomer
guguuugugugccugcuggagua

SEQ ID NO: 73526 - RNA, 23 nt, Artificial Sequence
  Oligomer
cguguuugugugccugcuggagu

SEQ ID NO: 73527 - RNA, 23 nt, Artificial Sequence
  Oligomer
gcguguuugugugccugcuggag

SEQ ID NO: 73528 - RNA, 23 nt, Artificial Sequence
  Oligomer
ggcguguuugugugccugcugga

SEQ ID NO: 73529 - RNA, 23 nt, Artificial Sequence
  Oligomer
cuuuggugccuacuccauugugg

SEQ ID NO: 73530 - RNA, 23 nt, Artificial Sequence
  Oligomer
acuuuggugccuacuccauugug

SEQ ID NO: 73531 - RNA, 23 nt, Artificial Sequence
  Oligomer
uacuuuggugccuacuccauugu

SEQ ID NO: 73532 - RNA, 23 nt, Artificial Sequence
  Oligomer
guacuuuggugccuacuccauug

SEQ ID NO: 73533 - RNA, 23 nt, Artificial Sequence
  Oligomer
gguacuuuggugccuacuccauu

SEQ ID NO: 73534 - RNA, 23 nt, Artificial Sequence
  Oligomer
ugguacuuuggugccuacuccau

SEQ ID NO: 73535 - RNA, 23 nt, Artificial Sequence
  Oligomer
aagcuguucgggcccuuuaccag

SEQ ID NO: 73536 - RNA, 23 nt, Artificial Sequence
  Oligomer
gaagcuguucgggcccuuuacca

SEQ ID NO: 73537 - RNA, 23 nt, Artificial Sequence
  Oligomer
ugaagcuguucgggcccuuuacc

SEQ ID NO: 73538 - RNA, 23 nt, Artificial Sequence
  Oligomer
gugaagcuguucgggcccuuuac

SEQ ID NO: 73539 - RNA, 23 nt, Artificial Sequence
  Oligomer
ggugaagcuguucgggcccuuua

SEQ ID NO: 73540 - RNA, 23 nt, Artificial Sequence
  Oligomer
gaauuacuauguucgggccgucc

SEQ ID NO: 73541 - RNA, 23 nt, Artificial Sequence
  Oligomer
aagaggaagaagggcuccaccau

SEQ ID NO: 73542 - RNA, 23 nt, Artificial Sequence
  Oligomer
gaagaggaagaagggcuccacca

SEQ ID NO: 73543 - RNA, 23 nt, Artificial Sequence
  Oligomer
ggaagaggaagaagggcuccacc

SEQ ID NO: 73544 - RNA, 23 nt, Artificial Sequence
  Oligomer
gggaagaggaagaagggcuccac

SEQ ID NO: 73545 - RNA, 23 nt, Artificial Sequence
  Oligomer
ggggaagaggaagaagggcucca

SEQ ID NO: 73546 - RNA, 23 nt, Artificial Sequence
  Oligomer
uuuggugccuacuccauuguggc

SEQ ID NO: 73547 - RNA, 23 nt, Artificial Sequence
  Oligomer
auuacuauguucgggccguccug

SEQ ID NO: 73548 - RNA, 23 nt, Artificial Sequence
  Oligomer
aauuacuauguucgggccguccu

SEQ ID NO: 73549 - RNA, 23 nt, Artificial Sequence
  Oligomer
uuacuauguucgggccguccugc

SEQ ID NO: 73550 - RNA, 23 nt, Artificial Sequence
  Oligomer
uggugccuacuccauuguggcgg

SEQ ID NO: 73551 - RNA, 23 nt, Artificial Sequence
  Oligomer
uuggugccuacuccauuguggcg

SEQ ID NO: 73552 - RNA, 23 nt, Artificial Sequence
  Oligomer
gggguacuccagcaggcacacaa

SEQ ID NO: 73553 - RNA, 23 nt, Artificial Sequence
  Oligomer
ggguacuccagcaggcacacaaa

SEQ ID NO: 73554 - RNA, 23 nt, Artificial Sequence
  Oligomer
gguacuccagcaggcacacaaac

SEQ ID NO: 73555 - RNA, 23 nt, Artificial Sequence
  Oligomer
guacuccagcaggcacacaaaca

SEQ ID NO: 73556 - RNA, 23 nt, Artificial Sequence
  Oligomer
uacuccagcaggcacacaaacac

SEQ ID NO: 73557 - RNA, 23 nt, Artificial Sequence
  Oligomer
acuccagcaggcacacaaacacg

SEQ ID NO: 73558 - RNA, 23 nt, Artificial Sequence
  Oligomer
cuccagcaggcacacaaacacgc

SEQ ID NO: 73559 - RNA, 23 nt, Artificial Sequence
  Oligomer
uccagcaggcacacaaacacgcc

SEQ ID NO: 73560 - RNA, 23 nt, Artificial Sequence
  Oligomer
ccacaauggaguaggcaccaaag

SEQ ID NO: 73561 - RNA, 23 nt, Artificial Sequence
  Oligomer
cacaauggaguaggcaccaaagu

SEQ ID NO: 73562 - RNA, 23 nt, Artificial Sequence
  Oligomer
acaauggaguaggcaccaaagua

SEQ ID NO: 73563 - RNA, 23 nt, Artificial Sequence
  Oligomer
caauggaguaggcaccaaaguac

SEQ ID NO: 73564 - RNA, 23 nt, Artificial Sequence
  Oligomer
aauggaguaggcaccaaaguacc

SEQ ID NO: 73565 - RNA, 23 nt, Artificial Sequence
  Oligomer
auggaguaggcaccaaaguacca

SEQ ID NO: 73566 - RNA, 23 nt, Artificial Sequence
  Oligomer
cugguaaagggcccgaacagcuu

SEQ ID NO: 73567 - RNA, 23 nt, Artificial Sequence
  Oligomer
ugguaaagggcccgaacagcuuc

SEQ ID NO: 73568 - RNA, 23 nt, Artificial Sequence
  Oligomer
gguaaagggcccgaacagcuuca

SEQ ID NO: 73569 - RNA, 23 nt, Artificial Sequence
  Oligomer
guaaagggcccgaacagcuucac

SEQ ID NO: 73570 - RNA, 23 nt, Artificial Sequence
  Oligomer
uaaagggcccgaacagcuucacc

SEQ ID NO: 73571 - RNA, 23 nt, Artificial Sequence
  Oligomer
ggacggcccgaacauaguaauuc

SEQ ID NO: 73572 - RNA, 23 nt, Artificial Sequence
  Oligomer
augguggagcccuucuuccucuu

SEQ ID NO: 73573 - RNA, 23 nt, Artificial Sequence
  Oligomer
ugguggagcccuucuuccucuuc

SEQ ID NO: 73574 - RNA, 23 nt, Artificial Sequence
  Oligomer
gguggagcccuucuuccucuucc

SEQ ID NO: 73575 - RNA, 23 nt, Artificial Sequence
  Oligomer
guggagcccuucuuccucuuccc

SEQ ID NO: 73576 - RNA, 23 nt, Artificial Sequence
  Oligomer
uggagcccuucuuccucuucccc

SEQ ID NO: 73577 - RNA, 23 nt, Artificial Sequence
  Oligomer
gccacaauggaguaggcaccaaa

SEQ ID NO: 73578 - RNA, 23 nt, Artificial Sequence
  Oligomer
caggacggcccgaacauaguaau

SEQ ID NO: 73579 - RNA, 23 nt, Artificial Sequence
  Oligomer
aggacggcccgaacauaguaauu

SEQ ID NO: 73580 - RNA, 23 nt, Artificial Sequence
  Oligomer
gcaggacggcccgaacauaguaa

SEQ ID NO: 73581 - RNA, 23 nt, Artificial Sequence
  Oligomer
ccgccacaauggaguaggcacca

SEQ ID NO: 73582 - RNA, 23 nt, Artificial Sequence
  Oligomer
cgccacaauggaguaggcaccaa

SEQ ID NO: 73583 - RNA, 19 nt, Artificial Sequence
  Oligomer
cauaucucucccuucuuua

SEQ ID NO: 73584 - RNA, 19 nt, Artificial Sequence
  Oligomer
uuaucucccugcuucauau

SEQ ID NO: 73585 - RNA, 19 nt, Artificial Sequence
  Oligomer
cucccugcuucauaucucu

SEQ ID NO: 73586 - RNA, 19 nt, Artificial Sequence
  Oligomer
gcuucauaucucucccuuc

SEQ ID NO: 73587 - RNA, 19 nt, Artificial Sequence
  Oligomer
cauagugggccuucauuaa

SEQ ID NO: 73588 - RNA, 19 nt, Artificial Sequence
  Oligomer
caacuucccuguucuuuaa

SEQ ID NO: 73589 - RNA, 19 nt, Artificial Sequence
  Oligomer
cuugcacuccugaauuuua

SEQ ID NO: 73590 - RNA, 19 nt, Artificial Sequence
  Oligomer
ggugcaaggagaugucuga

SEQ ID NO: 73591 - RNA, 19 nt, Artificial Sequence
  Oligomer
agugaugccgguaaagaaa

SEQ ID NO: 73592 - RNA, 19 nt, Artificial Sequence
  Oligomer
agggaagaaggcaagccaa

SEQ ID NO: 73593 - RNA, 19 nt, Artificial Sequence
  Oligomer
agucaaggugcucaauaaa

SEQ ID NO: 73594 - RNA, 19 nt, Artificial Sequence
  Oligomer
cguccaucucucucccuua

SEQ ID NO: 73595 - RNA, 19 nt, Artificial Sequence
  Oligomer
ccaacuucccuguucuuua

SEQ ID NO: 73596 - RNA, 19 nt, Artificial Sequence
  Oligomer
ccugcuucauaucucuccc

SEQ ID NO: 73597 - RNA, 19 nt, Artificial Sequence
  Oligomer
guuucccuagacucuguaa

SEQ ID NO: 73598 - RNA, 19 nt, Artificial Sequence
  Oligomer
cucccuucuuuaccuucau

SEQ ID NO: 73599 - RNA, 19 nt, Artificial Sequence
  Oligomer
ugcuucauaucucucccuu

SEQ ID NO: 73600 - RNA, 19 nt, Artificial Sequence
  Oligomer
cuagagugagaguuuggaa

SEQ ID NO: 73601 - RNA, 19 nt, Artificial Sequence
  Oligomer
acucuccuuugauauuaug

SEQ ID NO: 73602 - RNA, 19 nt, Artificial Sequence
  Oligomer
caucgggugccaaauaaau

SEQ ID NO: 73603 - RNA, 19 nt, Artificial Sequence
  Oligomer
cugucuuuuuccuuccuga

SEQ ID NO: 73604 - RNA, 19 nt, Artificial Sequence
  Oligomer
aauggugauuucuugcuaa

SEQ ID NO: 73605 - RNA, 19 nt, Artificial Sequence
  Oligomer
aaaagagggaagaaggcaa

SEQ ID NO: 73606 - RNA, 19 nt, Artificial Sequence
  Oligomer
gacugcacaggaaaugcaa

SEQ ID NO: 73607 - RNA, 19 nt, Artificial Sequence
  Oligomer
aucucucccuucuuuaccu

SEQ ID NO: 73608 - RNA, 19 nt, Artificial Sequence
  Oligomer
cugcuucauaucucucccu

SEQ ID NO: 73609 - RNA, 19 nt, Artificial Sequence
  Oligomer
gaguuuggaagguguccaa

SEQ ID NO: 73610 - RNA, 19 nt, Artificial Sequence
  Oligomer
auaucucucccuucuuuac

SEQ ID NO: 73611 - RNA, 19 nt, Artificial Sequence
  Oligomer
ucucucccuucuuuaccuu

SEQ ID NO: 73612 - RNA, 19 nt, Artificial Sequence
  Oligomer
ccugcacuucauaucuaga

SEQ ID NO: 73613 - RNA, 19 nt, Artificial Sequence
  Oligomer
cucuagucacccucuucaa

SEQ ID NO: 73614 - RNA, 19 nt, Artificial Sequence
  Oligomer
cuuuuauuucagugccaua

SEQ ID NO: 73615 - RNA, 19 nt, Artificial Sequence
  Oligomer
cuugcugcaguguccagaa

SEQ ID NO: 73616 - RNA, 19 nt, Artificial Sequence
  Oligomer
acuuaucaaggaucgggaa

SEQ ID NO: 73617 - RNA, 19 nt, Artificial Sequence
  Oligomer
cgccaucuaugguguggau

SEQ ID NO: 73618 - RNA, 19 nt, Artificial Sequence
  Oligomer
caaugugcacuucacugga

SEQ ID NO: 73619 - RNA, 19 nt, Artificial Sequence
  Oligomer
cauccucaucaucaggaaa

SEQ ID NO: 73620 - RNA, 19 nt, Artificial Sequence
  Oligomer
gcuuaucucccugcuucau

SEQ ID NO: 73621 - RNA, 19 nt, Artificial Sequence
  Oligomer
ccuuuuuguccuagaguga

SEQ ID NO: 73622 - RNA, 19 nt, Artificial Sequence
  Oligomer
aggagagugaugccgguaa

SEQ ID NO: 73623 - RNA, 19 nt, Artificial Sequence
  Oligomer
uucauaucucucccuucuu

SEQ ID NO: 73624 - RNA, 19 nt, Artificial Sequence
  Oligomer
gguugaccaacaagaugga

SEQ ID NO: 73625 - RNA, 19 nt, Artificial Sequence
  Oligomer
agcuuaucucccugcuuca

SEQ ID NO: 73626 - RNA, 19 nt, Artificial Sequence
  Oligomer
acuggaauuucgcucugga

SEQ ID NO: 73627 - RNA, 19 nt, Artificial Sequence
  Oligomer
cauuaguuaagaugucuga

SEQ ID NO: 73628 - RNA, 19 nt, Artificial Sequence
  Oligomer
gugcaaggagaugucugaa

SEQ ID NO: 73629 - RNA, 19 nt, Artificial Sequence
  Oligomer
cuuugaucuucaggaugca

SEQ ID NO: 73630 - RNA, 19 nt, Artificial Sequence
  Oligomer
cuuuuuccuuccugagaaa

SEQ ID NO: 73631 - RNA, 19 nt, Artificial Sequence
  Oligomer
ucugaagaagcaaacauga

SEQ ID NO: 73632 - RNA, 19 nt, Artificial Sequence
  Oligomer
aguuaagaugucugagaga

SEQ ID NO: 73633 - RNA, 19 nt, Artificial Sequence
  Oligomer
caugcauccucaucaucag

SEQ ID NO: 73634 - RNA, 19 nt, Artificial Sequence
  Oligomer
uguugagcgaauuguuaga

SEQ ID NO: 73635 - RNA, 19 nt, Artificial Sequence
  Oligomer
gcugguuaaggugaacgca

SEQ ID NO: 73636 - RNA, 19 nt, Artificial Sequence
  Oligomer
cucaacuugcugccuaaga

SEQ ID NO: 73637 - RNA, 19 nt, Artificial Sequence
  Oligomer
gagguuccugguacaucga

SEQ ID NO: 73638 - RNA, 19 nt, Artificial Sequence
  Oligomer
ccuccagucuguucucaca

SEQ ID NO: 73639 - RNA, 19 nt, Artificial Sequence
  Oligomer
ccuagagugagaguuugga

SEQ ID NO: 73640 - RNA, 19 nt, Artificial Sequence
  Oligomer
gagaugucugaauacugca

SEQ ID NO: 73641 - RNA, 19 nt, Artificial Sequence
  Oligomer
cuuugagugugggacucca

SEQ ID NO: 73642 - RNA, 19 nt, Artificial Sequence
  Oligomer
cccugcuucauaucucucc

SEQ ID NO: 73643 - RNA, 19 nt, Artificial Sequence
  Oligomer
ccagcuccuuuucugugaa

SEQ ID NO: 73644 - RNA, 19 nt, Artificial Sequence
  Oligomer
caggaugcacgguuucugu

SEQ ID NO: 73645 - RNA, 19 nt, Artificial Sequence
  Oligomer
uguuguugagcgaauuguu

SEQ ID NO: 73646 - RNA, 19 nt, Artificial Sequence
  Oligomer
ucucccugcuucauaucuc

SEQ ID NO: 73647 - RNA, 19 nt, Artificial Sequence
  Oligomer
uugugagccuugcugccaa

SEQ ID NO: 73648 - RNA, 19 nt, Artificial Sequence
  Oligomer
aguugaagagccugacaag

SEQ ID NO: 73649 - RNA, 19 nt, Artificial Sequence
  Oligomer
gagagagaaccuuuccacu

SEQ ID NO: 73650 - RNA, 19 nt, Artificial Sequence
  Oligomer
cagacaugauaugcggcua

SEQ ID NO: 73651 - RNA, 19 nt, Artificial Sequence
  Oligomer
guguuucccuagacucugu

SEQ ID NO: 73652 - RNA, 19 nt, Artificial Sequence
  Oligomer
gugagaguuuggaaggugu

SEQ ID NO: 73653 - RNA, 19 nt, Artificial Sequence
  Oligomer
aagugaaguuguaaacaca

SEQ ID NO: 73654 - RNA, 19 nt, Artificial Sequence
  Oligomer
caacuugcugccuaagagg

SEQ ID NO: 73655 - RNA, 19 nt, Artificial Sequence
  Oligomer
agguuuuucagcucuuuga

SEQ ID NO: 73656 - RNA, 19 nt, Artificial Sequence
  Oligomer
aagaaaaguugccgaagau

SEQ ID NO: 73657 - RNA, 19 nt, Artificial Sequence
  Oligomer
gaaacugcuccagcuccaa

SEQ ID NO: 73658 - RNA, 19 nt, Artificial Sequence
  Oligomer
agguuaugcuccuggcaca

SEQ ID NO: 73659 - RNA, 19 nt, Artificial Sequence
  Oligomer
cuuuguuccugcuuucucu

SEQ ID NO: 73660 - RNA, 19 nt, Artificial Sequence
  Oligomer
ugacaauauacacggauua

SEQ ID NO: 73661 - RNA, 19 nt, Artificial Sequence
  Oligomer
aaaugcuaggccuguagua

SEQ ID NO: 73662 - RNA, 19 nt, Artificial Sequence
  Oligomer
ggaucgggaagguuaugcu

SEQ ID NO: 73663 - RNA, 19 nt, Artificial Sequence
  Oligomer
aggacaucaucaccuugga

SEQ ID NO: 73664 - RNA, 19 nt, Artificial Sequence
  Oligomer
ccacaggaggugugauaga

SEQ ID NO: 73665 - RNA, 19 nt, Artificial Sequence
  Oligomer
ggucccuagcaaaaugcua

SEQ ID NO: 73666 - RNA, 19 nt, Artificial Sequence
  Oligomer
aaucaaccugcacuucaua

SEQ ID NO: 73667 - RNA, 19 nt, Artificial Sequence
  Oligomer
ucagagaaggccaggaaga

SEQ ID NO: 73668 - RNA, 19 nt, Artificial Sequence
  Oligomer
cagaauguggaacuccuca

SEQ ID NO: 73669 - RNA, 19 nt, Artificial Sequence
  Oligomer
cuuucuuccuccagucugu

SEQ ID NO: 73670 - RNA, 19 nt, Artificial Sequence
  Oligomer
cuuugggucgacauaguau

SEQ ID NO: 73671 - RNA, 19 nt, Artificial Sequence
  Oligomer
aacucuucaccuugguuua

SEQ ID NO: 73672 - RNA, 19 nt, Artificial Sequence
  Oligomer
ccaacauugccuugcauuu

SEQ ID NO: 73673 - RNA, 19 nt, Artificial Sequence
  Oligomer
ucucccuucuuuaccuuca

SEQ ID NO: 73674 - RNA, 19 nt, Artificial Sequence
  Oligomer
uuuugaugccuucugugaa

SEQ ID NO: 73675 - RNA, 19 nt, Artificial Sequence
  Oligomer
aaacaugacuagagacgca

SEQ ID NO: 73676 - RNA, 19 nt, Artificial Sequence
  Oligomer
uauucaccaucauguacca

SEQ ID NO: 73677 - RNA, 19 nt, Artificial Sequence
  Oligomer
uggaaaugagggagcucau

SEQ ID NO: 73678 - RNA, 19 nt, Artificial Sequence
  Oligomer
uguggaccacaguacucua

SEQ ID NO: 73679 - RNA, 19 nt, Artificial Sequence
  Oligomer
gccaaagugggcaguuuca

SEQ ID NO: 73680 - RNA, 19 nt, Artificial Sequence
  Oligomer
acauugccuugcauuugua

SEQ ID NO: 73681 - RNA, 19 nt, Artificial Sequence
  Oligomer
caggauauugggagugugu

SEQ ID NO: 73682 - RNA, 19 nt, Artificial Sequence
  Oligomer
cugagagaccaucuccuau

SEQ ID NO: 73683 - RNA, 19 nt, Artificial Sequence
  Oligomer
uccugagaaacguccaucu

SEQ ID NO: 73684 - RNA, 19 nt, Artificial Sequence
  Oligomer
cuuacuauucccacuuuca

SEQ ID NO: 73685 - RNA, 19 nt, Artificial Sequence
  Oligomer
gcuuuuauuucagugccau

SEQ ID NO: 73686 - RNA, 19 nt, Artificial Sequence
  Oligomer
gagaaacguccaucucucu

SEQ ID NO: 73687 - RNA, 19 nt, Artificial Sequence
  Oligomer
agacauaucaugugugaga

SEQ ID NO: 73688 - RNA, 19 nt, Artificial Sequence
  Oligomer
auagugggccuucauuaaa

SEQ ID NO: 73689 - RNA, 19 nt, Artificial Sequence
  Oligomer
ugguguugagcaaugugca

SEQ ID NO: 73690 - RNA, 19 nt, Artificial Sequence
  Oligomer
agaaggcaagccaaccuua

SEQ ID NO: 73691 - RNA, 19 nt, Artificial Sequence
  Oligomer
guguggaugggaaacugcu

SEQ ID NO: 73692 - RNA, 19 nt, Artificial Sequence
  Oligomer
caucauguaccaagugcuu

SEQ ID NO: 73693 - RNA, 19 nt, Artificial Sequence
  Oligomer
agauggaaagaaccacgca

SEQ ID NO: 73694 - RNA, 19 nt, Artificial Sequence
  Oligomer
caguauuaaacucuccuuu

SEQ ID NO: 73695 - RNA, 19 nt, Artificial Sequence
  Oligomer
uuguuugggugguuuguga

SEQ ID NO: 73696 - RNA, 19 nt, Artificial Sequence
  Oligomer
gaaacugcagaauuuugca

SEQ ID NO: 73697 - RNA, 19 nt, Artificial Sequence
  Oligomer
uguguggcaugcauccuca

SEQ ID NO: 73698 - RNA, 19 nt, Artificial Sequence
  Oligomer
auuuuuagcuccuugaaga

SEQ ID NO: 73699 - RNA, 19 nt, Artificial Sequence
  Oligomer
uggagaugagacugaucgu

SEQ ID NO: 73700 - RNA, 19 nt, Artificial Sequence
  Oligomer
uuaugcuccuggcacagaa

SEQ ID NO: 73701 - RNA, 19 nt, Artificial Sequence
  Oligomer
uggaccuauugccaggaau

SEQ ID NO: 73702 - RNA, 19 nt, Artificial Sequence
  Oligomer
caucucucucccuuacuau

SEQ ID NO: 73703 - RNA, 19 nt, Artificial Sequence
  Oligomer
ggcuuuuauuucagugcca

SEQ ID NO: 73704 - RNA, 19 nt, Artificial Sequence
  Oligomer
gccagcuccuuuucuguga

SEQ ID NO: 73705 - RNA, 19 nt, Artificial Sequence
  Oligomer
caucuucuggagaaggaca

SEQ ID NO: 73706 - RNA, 19 nt, Artificial Sequence
  Oligomer
aguauggaaguauuugaga

SEQ ID NO: 73707 - RNA, 19 nt, Artificial Sequence
  Oligomer
cagugccauacauguuauu

SEQ ID NO: 73708 - RNA, 19 nt, Artificial Sequence
  Oligomer
ucuagaauccugcuuuaca

SEQ ID NO: 73709 - RNA, 19 nt, Artificial Sequence
  Oligomer
aaaugagggcagaaaccuu

SEQ ID NO: 73710 - RNA, 19 nt, Artificial Sequence
  Oligomer
acuuguuuccugugcccau

SEQ ID NO: 73711 - RNA, 19 nt, Artificial Sequence
  Oligomer
cuuccuucacaucucccau

SEQ ID NO: 73712 - RNA, 19 nt, Artificial Sequence
  Oligomer
aaugguguguuucccuaga

SEQ ID NO: 73713 - RNA, 19 nt, Artificial Sequence
  Oligomer
caaccuuagcuacaauccu

SEQ ID NO: 73714 - RNA, 19 nt, Artificial Sequence
  Oligomer
gauuucuugcuaagcucca

SEQ ID NO: 73715 - RNA, 19 nt, Artificial Sequence
  Oligomer
caaggagaugucugaauac

SEQ ID NO: 73716 - RNA, 19 nt, Artificial Sequence
  Oligomer
cacggauuauuauuuguac

SEQ ID NO: 73717 - RNA, 19 nt, Artificial Sequence
  Oligomer
gcuccaagagguuuuucag

SEQ ID NO: 73718 - RNA, 19 nt, Artificial Sequence
  Oligomer
gaugugggaaucucccaga

SEQ ID NO: 73719 - RNA, 19 nt, Artificial Sequence
  Oligomer
cguggagaugagacugauc

SEQ ID NO: 73720 - RNA, 19 nt, Artificial Sequence
  Oligomer
acagaauuccaccggugca

SEQ ID NO: 73721 - RNA, 19 nt, Artificial Sequence
  Oligomer
uucugagcgggcuugugau

SEQ ID NO: 73722 - RNA, 19 nt, Artificial Sequence
  Oligomer
uggcaugcauccucaucau

SEQ ID NO: 73723 - RNA, 19 nt, Artificial Sequence
  Oligomer
ucauccacgccaaguggaa

SEQ ID NO: 73724 - RNA, 19 nt, Artificial Sequence
  Oligomer
caaagaucuuucguugguu

SEQ ID NO: 73725 - RNA, 19 nt, Artificial Sequence
  Oligomer
agaugagacugaucguggg

SEQ ID NO: 73726 - RNA, 19 nt, Artificial Sequence
  Oligomer
cugagaaacguccaucucu

SEQ ID NO: 73727 - RNA, 19 nt, Artificial Sequence
  Oligomer
agagaaggccaggaagaau

SEQ ID NO: 73728 - RNA, 19 nt, Artificial Sequence
  Oligomer
aguagucaaggugcucaau

SEQ ID NO: 73729 - RNA, 19 nt, Artificial Sequence
  Oligomer
ucugagagaccaucuccua

SEQ ID NO: 73730 - RNA, 19 nt, Artificial Sequence
  Oligomer
acgcgcucagacaugauau

SEQ ID NO: 73731 - RNA, 19 nt, Artificial Sequence
  Oligomer
guuucagccagaaugugga

SEQ ID NO: 73732 - RNA, 19 nt, Artificial Sequence
  Oligomer
agaagcaaacaugacuaga

SEQ ID NO: 73733 - RNA, 19 nt, Artificial Sequence
  Oligomer
ggauauugggagugugugg

SEQ ID NO: 73734 - RNA, 19 nt, Artificial Sequence
  Oligomer
cuuccugagaaacguccau

SEQ ID NO: 73735 - RNA, 19 nt, Artificial Sequence
  Oligomer
cagaacaaaccaaaaaugu

SEQ ID NO: 73736 - RNA, 19 nt, Artificial Sequence
  Oligomer
cuuccucaagucuugacaa

SEQ ID NO: 73737 - RNA, 19 nt, Artificial Sequence
  Oligomer
ucugagcgggcuugugaua

SEQ ID NO: 73738 - RNA, 19 nt, Artificial Sequence
  Oligomer
auuaucuuuuggcucugaa

SEQ ID NO: 73739 - RNA, 19 nt, Artificial Sequence
  Oligomer
cuuuguuacugaaaugagc

SEQ ID NO: 73740 - RNA, 19 nt, Artificial Sequence
  Oligomer
aaccuuuaucccugcuuau

SEQ ID NO: 73741 - RNA, 19 nt, Artificial Sequence
  Oligomer
aucucccugcuucauaucu

SEQ ID NO: 73742 - RNA, 19 nt, Artificial Sequence
  Oligomer
cauggucccuagcaaaaug

SEQ ID NO: 73743 - RNA, 19 nt, Artificial Sequence
  Oligomer
gaaacuucccaacuucccu

SEQ ID NO: 73744 - RNA, 19 nt, Artificial Sequence
  Oligomer
guaccaagugcuuggcaca

SEQ ID NO: 73745 - RNA, 19 nt, Artificial Sequence
  Oligomer
agagugaugccgguaaaga

SEQ ID NO: 73746 - RNA, 19 nt, Artificial Sequence
  Oligomer
cacugccaggauuuuguau

SEQ ID NO: 73747 - RNA, 19 nt, Artificial Sequence
  Oligomer
uauucccacuuucauucaa

SEQ ID NO: 73748 - RNA, 19 nt, Artificial Sequence
  Oligomer
cccauggaagucucaaaga

SEQ ID NO: 73749 - RNA, 19 nt, Artificial Sequence
  Oligomer
gaagguuaugcuccuggca

SEQ ID NO: 73750 - RNA, 19 nt, Artificial Sequence
  Oligomer
guuuggaagguguccaaau

SEQ ID NO: 73751 - RNA, 19 nt, Artificial Sequence
  Oligomer
guguucaguuccagcuuuu

SEQ ID NO: 73752 - RNA, 19 nt, Artificial Sequence
  Oligomer
gagagugaugccgguaaag

SEQ ID NO: 73753 - RNA, 19 nt, Artificial Sequence
  Oligomer
ugaucuuugcccauggaag

SEQ ID NO: 73754 - RNA, 19 nt, Artificial Sequence
  Oligomer
guggcaugcauccucauca

SEQ ID NO: 73755 - RNA, 19 nt, Artificial Sequence
  Oligomer
gagagagagaaccuuucca

SEQ ID NO: 73756 - RNA, 19 nt, Artificial Sequence
  Oligomer
gacaauauacacggauuau

SEQ ID NO: 73757 - RNA, 19 nt, Artificial Sequence
  Oligomer
uggaaagaaccacgcagga

SEQ ID NO: 73758 - RNA, 19 nt, Artificial Sequence
  Oligomer
caugcggaacaccaaacga

SEQ ID NO: 73759 - RNA, 19 nt, Artificial Sequence
  Oligomer
gagugagaguuuggaaggu

SEQ ID NO: 73760 - RNA, 19 nt, Artificial Sequence
  Oligomer
guguggcaugcauccucau

SEQ ID NO: 73761 - RNA, 19 nt, Artificial Sequence
  Oligomer
ucuucaccuugguuuauga

SEQ ID NO: 73762 - RNA, 19 nt, Artificial Sequence
  Oligomer
uguuucagcugcaguugaa

SEQ ID NO: 73763 - RNA, 19 nt, Artificial Sequence
  Oligomer
aguuuggaagguguccaaa

SEQ ID NO: 73764 - RNA, 19 nt, Artificial Sequence
  Oligomer
ggaaucucccagacuuguu

SEQ ID NO: 73765 - RNA, 19 nt, Artificial Sequence
  Oligomer
cauucuuucuuccuccagu

SEQ ID NO: 73766 - RNA, 19 nt, Artificial Sequence
  Oligomer
aaaaguugccgaagaugag

SEQ ID NO: 73767 - RNA, 19 nt, Artificial Sequence
  Oligomer
cuuuugaugccuucuguga

SEQ ID NO: 73768 - RNA, 19 nt, Artificial Sequence
  Oligomer
cacgcgcucagacaugaua

SEQ ID NO: 73769 - RNA, 19 nt, Artificial Sequence
  Oligomer
uuauccacuggcauuuuua

SEQ ID NO: 73770 - RNA, 19 nt, Artificial Sequence
  Oligomer
ucagugccauacauguuau

SEQ ID NO: 73771 - RNA, 19 nt, Artificial Sequence
  Oligomer
cuucuuuaccuucauuuca

SEQ ID NO: 73772 - RNA, 19 nt, Artificial Sequence
  Oligomer
aaaugagggagcucaucca

SEQ ID NO: 73773 - RNA, 19 nt, Artificial Sequence
  Oligomer
ccuugaagacauaucaugu

SEQ ID NO: 73774 - RNA, 19 nt, Artificial Sequence
  Oligomer
gaccacaggaggugugaua

SEQ ID NO: 73775 - RNA, 19 nt, Artificial Sequence
  Oligomer
ccuuuaucccugcuuaucu

SEQ ID NO: 73776 - RNA, 19 nt, Artificial Sequence
  Oligomer
gcccaucaucucugccuuu

SEQ ID NO: 73777 - RNA, 19 nt, Artificial Sequence
  Oligomer
agacaugauaugcggcuau

SEQ ID NO: 73778 - RNA, 19 nt, Artificial Sequence
  Oligomer
uuuuuguccuagagugaga

SEQ ID NO: 73779 - RNA, 19 nt, Artificial Sequence
  Oligomer
uauggaaguauuugagaga

SEQ ID NO: 73780 - RNA, 19 nt, Artificial Sequence
  Oligomer
ccuuccugagaaacgucca

SEQ ID NO: 73781 - RNA, 19 nt, Artificial Sequence
  Oligomer
ccuaccaggcuguaaauga

SEQ ID NO: 73782 - RNA, 19 nt, Artificial Sequence
  Oligomer
uaucucccugcuucauauc

SEQ ID NO: 73783 - RNA, 19 nt, Artificial Sequence
  Oligomer
ucuuuuuccuuccugagaa

SEQ ID NO: 73784 - RNA, 19 nt, Artificial Sequence
  Oligomer
cugugcguucccuucagua

SEQ ID NO: 73785 - RNA, 19 nt, Artificial Sequence
  Oligomer
uucaguuccagcuuuugua

SEQ ID NO: 73786 - RNA, 19 nt, Artificial Sequence
  Oligomer
ccuucacaucucccauggu

SEQ ID NO: 73787 - RNA, 19 nt, Artificial Sequence
  Oligomer
gucuuuuuccuuccugaga

SEQ ID NO: 73788 - RNA, 19 nt, Artificial Sequence
  Oligomer
gaaagaacuggaauuucgc

SEQ ID NO: 73789 - RNA, 19 nt, Artificial Sequence
  Oligomer
cagaauuuugcacaguuac

SEQ ID NO: 73790 - RNA, 19 nt, Artificial Sequence
  Oligomer
uguaaaugagggcagaaac

SEQ ID NO: 73791 - RNA, 19 nt, Artificial Sequence
  Oligomer
uguuucccuagacucugua

SEQ ID NO: 73792 - RNA, 19 nt, Artificial Sequence
  Oligomer
uuuugacaauauacacgga

SEQ ID NO: 73793 - RNA, 19 nt, Artificial Sequence
  Oligomer
cucugaagaagcaaacaug

SEQ ID NO: 73794 - RNA, 19 nt, Artificial Sequence
  Oligomer
agucuguucucacauaaca

SEQ ID NO: 73795 - RNA, 19 nt, Artificial Sequence
  Oligomer
cccauauuuguguucaguu

SEQ ID NO: 73796 - RNA, 19 nt, Artificial Sequence
  Oligomer
cuggaauuucgcucuggag

SEQ ID NO: 73797 - RNA, 19 nt, Artificial Sequence
  Oligomer
acugcccaagccuacagaa

SEQ ID NO: 73798 - RNA, 19 nt, Artificial Sequence
  Oligomer
augugcacuucacuggaga

SEQ ID NO: 73799 - RNA, 19 nt, Artificial Sequence
  Oligomer
cguucccuucaguacugca

SEQ ID NO: 73800 - RNA, 19 nt, Artificial Sequence
  Oligomer
aggaaaugcaagagaaacu

SEQ ID NO: 73801 - RNA, 19 nt, Artificial Sequence
  Oligomer
cauuuuuagcuccuugaag

SEQ ID NO: 73802 - RNA, 19 nt, Artificial Sequence
  Oligomer
cucuccuuugauauuaugu

SEQ ID NO: 73803 - RNA, 19 nt, Artificial Sequence
  Oligomer
gugggaaucucccagacuu

SEQ ID NO: 73804 - RNA, 19 nt, Artificial Sequence
  Oligomer
cgcgcucagacaugauaug

SEQ ID NO: 73805 - RNA, 19 nt, Artificial Sequence
  Oligomer
agcgggcuugugauaugca

SEQ ID NO: 73806 - RNA, 19 nt, Artificial Sequence
  Oligomer
gaaccuuuccacucccacu

SEQ ID NO: 73807 - RNA, 19 nt, Artificial Sequence
  Oligomer
auugccaucgggugccaaa

SEQ ID NO: 73808 - RNA, 19 nt, Artificial Sequence
  Oligomer
cagccaacauugccuugca

SEQ ID NO: 73809 - RNA, 19 nt, Artificial Sequence
  Oligomer
gaccaacaagauggaaaga

SEQ ID NO: 73810 - RNA, 19 nt, Artificial Sequence
  Oligomer
cauggaagucucaaagauc

SEQ ID NO: 73811 - RNA, 19 nt, Artificial Sequence
  Oligomer
caaccugcacuucauaucu

SEQ ID NO: 73812 - RNA, 19 nt, Artificial Sequence
  Oligomer
aggccaggaagaauggugu

SEQ ID NO: 73813 - RNA, 19 nt, Artificial Sequence
  Oligomer
acuucacuggagagaaaga

SEQ ID NO: 73814 - RNA, 19 nt, Artificial Sequence
  Oligomer
cauguucuaugugaccaga

SEQ ID NO: 73815 - RNA, 19 nt, Artificial Sequence
  Oligomer
uguucuaugugaccagacu

SEQ ID NO: 73816 - RNA, 19 nt, Artificial Sequence
  Oligomer
gagccuuugaucuucagga

SEQ ID NO: 73817 - RNA, 19 nt, Artificial Sequence
  Oligomer
gcuaggccuguaguaguca

SEQ ID NO: 73818 - RNA, 19 nt, Artificial Sequence
  Oligomer
caagccaaccuuagcuaca

SEQ ID NO: 73819 - RNA, 19 nt, Artificial Sequence
  Oligomer
auauuuguguucaguucca

SEQ ID NO: 73820 - RNA, 19 nt, Artificial Sequence
  Oligomer
aguauuaaacucuccuuug

SEQ ID NO: 73821 - RNA, 19 nt, Artificial Sequence
  Oligomer
uguccuagagugagaguuu

SEQ ID NO: 73822 - RNA, 19 nt, Artificial Sequence
  Oligomer
cuuauugaucuuugcccau

SEQ ID NO: 73823 - RNA, 19 nt, Artificial Sequence
  Oligomer
gagcaaugugcacuucacu

SEQ ID NO: 73824 - RNA, 19 nt, Artificial Sequence
  Oligomer
caagcuuuugggcuaugac

SEQ ID NO: 73825 - RNA, 19 nt, Artificial Sequence
  Oligomer
gaaugguguguuucccuag

SEQ ID NO: 73826 - RNA, 19 nt, Artificial Sequence
  Oligomer
aucuuuuggcucugaagaa

SEQ ID NO: 73827 - RNA, 19 nt, Artificial Sequence
  Oligomer
cuccuuugauauuaugugg

SEQ ID NO: 73828 - RNA, 19 nt, Artificial Sequence
  Oligomer
ugagaaacguccaucucuc

SEQ ID NO: 73829 - RNA, 19 nt, Artificial Sequence
  Oligomer
acauaucaugugugagaua

SEQ ID NO: 73830 - RNA, 19 nt, Artificial Sequence
  Oligomer
cagccugucagccaacauu

SEQ ID NO: 73831 - RNA, 19 nt, Artificial Sequence
  Oligomer
guugaccaacaagauggaa

SEQ ID NO: 73832 - RNA, 19 nt, Artificial Sequence
  Oligomer
cucaaagauguaauguagu

SEQ ID NO: 73833 - RNA, 19 nt, Artificial Sequence
  Oligomer
cuuccuagcuuaucucccu

SEQ ID NO: 73834 - RNA, 19 nt, Artificial Sequence
  Oligomer
gggcuugugauaugcacgu

SEQ ID NO: 73835 - RNA, 19 nt, Artificial Sequence
  Oligomer
uaaagaagggagagauaug

SEQ ID NO: 73836 - RNA, 19 nt, Artificial Sequence
  Oligomer
auaugaagcagggagauaa

SEQ ID NO: 73837 - RNA, 19 nt, Artificial Sequence
  Oligomer
agagauaugaagcagggag

SEQ ID NO: 73838 - RNA, 19 nt, Artificial Sequence
  Oligomer
gaagggagagauaugaagc

SEQ ID NO: 73839 - RNA, 19 nt, Artificial Sequence
  Oligomer
uuaaugaaggcccacuaug

SEQ ID NO: 73840 - RNA, 19 nt, Artificial Sequence
  Oligomer
uuaaagaacagggaaguug

SEQ ID NO: 73841 - RNA, 19 nt, Artificial Sequence
  Oligomer
uaaaauucaggagugcaag

SEQ ID NO: 73842 - RNA, 19 nt, Artificial Sequence
  Oligomer
ucagacaucuccuugcacc

SEQ ID NO: 73843 - RNA, 19 nt, Artificial Sequence
  Oligomer
uuucuuuaccggcaucacu

SEQ ID NO: 73844 - RNA, 19 nt, Artificial Sequence
  Oligomer
uuggcuugccuucuucccu

SEQ ID NO: 73845 - RNA, 19 nt, Artificial Sequence
  Oligomer
uuuauugagcaccuugacu

SEQ ID NO: 73846 - RNA, 19 nt, Artificial Sequence
  Oligomer
uaagggagagagauggacg

SEQ ID NO: 73847 - RNA, 19 nt, Artificial Sequence
  Oligomer
uaaagaacagggaaguugg

SEQ ID NO: 73848 - RNA, 19 nt, Artificial Sequence
  Oligomer
gggagagauaugaagcagg

SEQ ID NO: 73849 - RNA, 19 nt, Artificial Sequence
  Oligomer
uuacagagucuagggaaac

SEQ ID NO: 73850 - RNA, 19 nt, Artificial Sequence
  Oligomer
augaagguaaagaagggag

SEQ ID NO: 73851 - RNA, 19 nt, Artificial Sequence
  Oligomer
aagggagagauaugaagca

SEQ ID NO: 73852 - RNA, 19 nt, Artificial Sequence
  Oligomer
uuccaaacucucacucuag

SEQ ID NO: 73853 - RNA, 19 nt, Artificial Sequence
  Oligomer
cauaauaucaaaggagagu

SEQ ID NO: 73854 - RNA, 19 nt, Artificial Sequence
  Oligomer
auuuauuuggcacccgaug

SEQ ID NO: 73855 - RNA, 19 nt, Artificial Sequence
  Oligomer
ucaggaaggaaaaagacag

SEQ ID NO: 73856 - RNA, 19 nt, Artificial Sequence
  Oligomer
uuagcaagaaaucaccauu

SEQ ID NO: 73857 - RNA, 19 nt, Artificial Sequence
  Oligomer
uugccuucuucccucuuuu

SEQ ID NO: 73858 - RNA, 19 nt, Artificial Sequence
  Oligomer
uugcauuuccugugcaguc

SEQ ID NO: 73859 - RNA, 19 nt, Artificial Sequence
  Oligomer
agguaaagaagggagagau

SEQ ID NO: 73860 - RNA, 19 nt, Artificial Sequence
  Oligomer
agggagagauaugaagcag

SEQ ID NO: 73861 - RNA, 19 nt, Artificial Sequence
  Oligomer
uuggacaccuuccaaacuc

SEQ ID NO: 73862 - RNA, 19 nt, Artificial Sequence
  Oligomer
guaaagaagggagagauau

SEQ ID NO: 73863 - RNA, 19 nt, Artificial Sequence
  Oligomer
aagguaaagaagggagaga

SEQ ID NO: 73864 - RNA, 19 nt, Artificial Sequence
  Oligomer
ucuagauaugaagugcagg

SEQ ID NO: 73865 - RNA, 19 nt, Artificial Sequence
  Oligomer
uugaagagggugacuagag

SEQ ID NO: 73866 - RNA, 19 nt, Artificial Sequence
  Oligomer
uauggcacugaaauaaaag

SEQ ID NO: 73867 - RNA, 19 nt, Artificial Sequence
  Oligomer
uucuggacacugcagcaag

SEQ ID NO: 73868 - RNA, 19 nt, Artificial Sequence
  Oligomer
uucccgauccuugauaagu

SEQ ID NO: 73869 - RNA, 19 nt, Artificial Sequence
  Oligomer
auccacaccauagauggcg

SEQ ID NO: 73870 - RNA, 19 nt, Artificial Sequence
  Oligomer
uccagugaagugcacauug

SEQ ID NO: 73871 - RNA, 19 nt, Artificial Sequence
  Oligomer
uuuccugaugaugaggaug

SEQ ID NO: 73872 - RNA, 19 nt, Artificial Sequence
  Oligomer
augaagcagggagauaagc

SEQ ID NO: 73873 - RNA, 19 nt, Artificial Sequence
  Oligomer
ucacucuaggacaaaaagg

SEQ ID NO: 73874 - RNA, 19 nt, Artificial Sequence
  Oligomer
uuaccggcaucacucuccu

SEQ ID NO: 73875 - RNA, 19 nt, Artificial Sequence
  Oligomer
aagaagggagagauaugaa

SEQ ID NO: 73876 - RNA, 19 nt, Artificial Sequence
  Oligomer
uccaucuuguuggucaacc

SEQ ID NO: 73877 - RNA, 19 nt, Artificial Sequence
  Oligomer
ugaagcagggagauaagcu

SEQ ID NO: 73878 - RNA, 19 nt, Artificial Sequence
  Oligomer
uccagagcgaaauuccagu

SEQ ID NO: 73879 - RNA, 19 nt, Artificial Sequence
  Oligomer
ucagacaucuuaacuaaug

SEQ ID NO: 73880 - RNA, 19 nt, Artificial Sequence
  Oligomer
uucagacaucuccuugcac

SEQ ID NO: 73881 - RNA, 19 nt, Artificial Sequence
  Oligomer
ugcauccugaagaucaaag

SEQ ID NO: 73882 - RNA, 19 nt, Artificial Sequence
  Oligomer
uuucucaggaaggaaaaag

SEQ ID NO: 73883 - RNA, 19 nt, Artificial Sequence
  Oligomer
ucauguuugcuucuucaga

SEQ ID NO: 73884 - RNA, 19 nt, Artificial Sequence
  Oligomer
ucucucagacaucuuaacu

SEQ ID NO: 73885 - RNA, 19 nt, Artificial Sequence
  Oligomer
cugaugaugaggaugcaug

SEQ ID NO: 73886 - RNA, 19 nt, Artificial Sequence
  Oligomer
ucuaacaauucgcucaaca

SEQ ID NO: 73887 - RNA, 19 nt, Artificial Sequence
  Oligomer
ugcguucaccuuaaccagc

SEQ ID NO: 73888 - RNA, 19 nt, Artificial Sequence
  Oligomer
ucuuaggcagcaaguugag

SEQ ID NO: 73889 - RNA, 19 nt, Artificial Sequence
  Oligomer
ucgauguaccaggaaccuc

SEQ ID NO: 73890 - RNA, 19 nt, Artificial Sequence
  Oligomer
ugugagaacagacuggagg

SEQ ID NO: 73891 - RNA, 19 nt, Artificial Sequence
  Oligomer
uccaaacucucacucuagg

SEQ ID NO: 73892 - RNA, 19 nt, Artificial Sequence
  Oligomer
ugcaguauucagacaucuc

SEQ ID NO: 73893 - RNA, 19 nt, Artificial Sequence
  Oligomer
uggagucccacacucaaag

SEQ ID NO: 73894 - RNA, 19 nt, Artificial Sequence
  Oligomer
ggagagauaugaagcaggg

SEQ ID NO: 73895 - RNA, 19 nt, Artificial Sequence
  Oligomer
uucacagaaaaggagcugg

SEQ ID NO: 73896 - RNA, 19 nt, Artificial Sequence
  Oligomer
acagaaaccgugcauccug

SEQ ID NO: 73897 - RNA, 19 nt, Artificial Sequence
  Oligomer
aacaauucgcucaacaaca

SEQ ID NO: 73898 - RNA, 19 nt, Artificial Sequence
  Oligomer
gagauaugaagcagggaga

SEQ ID NO: 73899 - RNA, 19 nt, Artificial Sequence
  Oligomer
uuggcagcaaggcucacaa

SEQ ID NO: 73900 - RNA, 19 nt, Artificial Sequence
  Oligomer
cuugucaggcucuucaacu

SEQ ID NO: 73901 - RNA, 19 nt, Artificial Sequence
  Oligomer
aguggaaagguucucucuc

SEQ ID NO: 73902 - RNA, 19 nt, Artificial Sequence
  Oligomer
uagccgcauaucaugucug

SEQ ID NO: 73903 - RNA, 19 nt, Artificial Sequence
  Oligomer
acagagucuagggaaacac

SEQ ID NO: 73904 - RNA, 19 nt, Artificial Sequence
  Oligomer
acaccuuccaaacucucac

SEQ ID NO: 73905 - RNA, 19 nt, Artificial Sequence
  Oligomer
uguguuuacaacuucacuu

SEQ ID NO: 73906 - RNA, 19 nt, Artificial Sequence
  Oligomer
ccucuuaggcagcaaguug

SEQ ID NO: 73907 - RNA, 19 nt, Artificial Sequence
  Oligomer
ucaaagagcugaaaaaccu

SEQ ID NO: 73908 - RNA, 19 nt, Artificial Sequence
  Oligomer
aucuucggcaacuuuucuu

SEQ ID NO: 73909 - RNA, 19 nt, Artificial Sequence
  Oligomer
uuggagcuggagcaguuuc

SEQ ID NO: 73910 - RNA, 19 nt, Artificial Sequence
  Oligomer
ugugccaggagcauaaccu

SEQ ID NO: 73911 - RNA, 19 nt, Artificial Sequence
  Oligomer
agagaaagcaggaacaaag

SEQ ID NO: 73912 - RNA, 19 nt, Artificial Sequence
  Oligomer
uaauccguguauauuguca

SEQ ID NO: 73913 - RNA, 19 nt, Artificial Sequence
  Oligomer
uacuacaggccuagcauuu

SEQ ID NO: 73914 - RNA, 19 nt, Artificial Sequence
  Oligomer
agcauaaccuucccgaucc

SEQ ID NO: 73915 - RNA, 19 nt, Artificial Sequence
  Oligomer
uccaaggugaugauguccu

SEQ ID NO: 73916 - RNA, 19 nt, Artificial Sequence
  Oligomer
ucuaucacaccuccugugg

SEQ ID NO: 73917 - RNA, 19 nt, Artificial Sequence
  Oligomer
uagcauuuugcuagggacc

SEQ ID NO: 73918 - RNA, 19 nt, Artificial Sequence
  Oligomer
uaugaagugcagguugauu

SEQ ID NO: 73919 - RNA, 19 nt, Artificial Sequence
  Oligomer
ucuuccuggccuucucuga

SEQ ID NO: 73920 - RNA, 19 nt, Artificial Sequence
  Oligomer
ugaggaguuccacauucug

SEQ ID NO: 73921 - RNA, 19 nt, Artificial Sequence
  Oligomer
acagacuggaggaagaaag

SEQ ID NO: 73922 - RNA, 19 nt, Artificial Sequence
  Oligomer
auacuaugucgacccaaag

SEQ ID NO: 73923 - RNA, 19 nt, Artificial Sequence
  Oligomer
uaaaccaaggugaagaguu

SEQ ID NO: 73924 - RNA, 19 nt, Artificial Sequence
  Oligomer
aaaugcaaggcaauguugg

SEQ ID NO: 73925 - RNA, 19 nt, Artificial Sequence
  Oligomer
ugaagguaaagaagggaga

SEQ ID NO: 73926 - RNA, 19 nt, Artificial Sequence
  Oligomer
uucacagaaggcaucaaaa

SEQ ID NO: 73927 - RNA, 19 nt, Artificial Sequence
  Oligomer
ugcgucucuagucauguuu

SEQ ID NO: 73928 - RNA, 19 nt, Artificial Sequence
  Oligomer
ugguacaugauggugaaua

SEQ ID NO: 73929 - RNA, 19 nt, Artificial Sequence
  Oligomer
augagcucccucauuucca

SEQ ID NO: 73930 - RNA, 19 nt, Artificial Sequence
  Oligomer
uagaguacugugguccaca

SEQ ID NO: 73931 - RNA, 19 nt, Artificial Sequence
  Oligomer
ugaaacugcccacuuuggc

SEQ ID NO: 73932 - RNA, 19 nt, Artificial Sequence
  Oligomer
uacaaaugcaaggcaaugu

SEQ ID NO: 73933 - RNA, 19 nt, Artificial Sequence
  Oligomer
acacacucccaauauccug

SEQ ID NO: 73934 - RNA, 19 nt, Artificial Sequence
  Oligomer
auaggagauggucucucag

SEQ ID NO: 73935 - RNA, 19 nt, Artificial Sequence
  Oligomer
agauggacguuucucagga

SEQ ID NO: 73936 - RNA, 19 nt, Artificial Sequence
  Oligomer
ugaaagugggaauaguaag

SEQ ID NO: 73937 - RNA, 19 nt, Artificial Sequence
  Oligomer
auggcacugaaauaaaagc

SEQ ID NO: 73938 - RNA, 19 nt, Artificial Sequence
  Oligomer
agagagauggacguuucuc

SEQ ID NO: 73939 - RNA, 19 nt, Artificial Sequence
  Oligomer
ucucacacaugauaugucu

SEQ ID NO: 73940 - RNA, 19 nt, Artificial Sequence
  Oligomer
uuuaaugaaggcccacuau

SEQ ID NO: 73941 - RNA, 19 nt, Artificial Sequence
  Oligomer
ugcacauugcucaacacca

SEQ ID NO: 73942 - RNA, 19 nt, Artificial Sequence
  Oligomer
uaagguuggcuugccuucu

SEQ ID NO: 73943 - RNA, 19 nt, Artificial Sequence
  Oligomer
agcaguuucccauccacac

SEQ ID NO: 73944 - RNA, 19 nt, Artificial Sequence
  Oligomer
aagcacuugguacaugaug

SEQ ID NO: 73945 - RNA, 19 nt, Artificial Sequence
  Oligomer
ugcgugguucuuuccaucu

SEQ ID NO: 73946 - RNA, 19 nt, Artificial Sequence
  Oligomer
aaaggagaguuuaauacug

SEQ ID NO: 73947 - RNA, 19 nt, Artificial Sequence
  Oligomer
ucacaaaccacccaaacaa

SEQ ID NO: 73948 - RNA, 19 nt, Artificial Sequence
  Oligomer
ugcaaaauucugcaguuuc

SEQ ID NO: 73949 - RNA, 19 nt, Artificial Sequence
  Oligomer
ugaggaugcaugccacaca

SEQ ID NO: 73950 - RNA, 19 nt, Artificial Sequence
  Oligomer
ucuucaaggagcuaaaaau

SEQ ID NO: 73951 - RNA, 19 nt, Artificial Sequence
  Oligomer
acgaucagucucaucucca

SEQ ID NO: 73952 - RNA, 19 nt, Artificial Sequence
  Oligomer
uucugugccaggagcauaa

SEQ ID NO: 73953 - RNA, 19 nt, Artificial Sequence
  Oligomer
auuccuggcaauaggucca

SEQ ID NO: 73954 - RNA, 19 nt, Artificial Sequence
  Oligomer
auaguaagggagagagaug

SEQ ID NO: 73955 - RNA, 19 nt, Artificial Sequence
  Oligomer
uggcacugaaauaaaagcc

SEQ ID NO: 73956 - RNA, 19 nt, Artificial Sequence
  Oligomer
ucacagaaaaggagcuggc

SEQ ID NO: 73957 - RNA, 19 nt, Artificial Sequence
  Oligomer
uguccuucuccagaagaug

SEQ ID NO: 73958 - RNA, 19 nt, Artificial Sequence
  Oligomer
ucucaaauacuuccauacu

SEQ ID NO: 73959 - RNA, 19 nt, Artificial Sequence
  Oligomer
aauaacauguauggcacug

SEQ ID NO: 73960 - RNA, 19 nt, Artificial Sequence
  Oligomer
uguaaagcaggauucuaga

SEQ ID NO: 73961 - RNA, 19 nt, Artificial Sequence
  Oligomer
aagguuucugcccucauuu

SEQ ID NO: 73962 - RNA, 19 nt, Artificial Sequence
  Oligomer
augggcacaggaaacaagu

SEQ ID NO: 73963 - RNA, 19 nt, Artificial Sequence
  Oligomer
augggagaugugaaggaag

SEQ ID NO: 73964 - RNA, 19 nt, Artificial Sequence
  Oligomer
ucuagggaaacacaccauu

SEQ ID NO: 73965 - RNA, 19 nt, Artificial Sequence
  Oligomer
aggauuguagcuaagguug

SEQ ID NO: 73966 - RNA, 19 nt, Artificial Sequence
  Oligomer
uggagcuuagcaagaaauc

SEQ ID NO: 73967 - RNA, 19 nt, Artificial Sequence
  Oligomer
guauucagacaucuccuug

SEQ ID NO: 73968 - RNA, 19 nt, Artificial Sequence
  Oligomer
guacaaauaauaauccgug

SEQ ID NO: 73969 - RNA, 19 nt, Artificial Sequence
  Oligomer
cugaaaaaccucuuggagc

SEQ ID NO: 73970 - RNA, 19 nt, Artificial Sequence
  Oligomer
ucugggagauucccacauc

SEQ ID NO: 73971 - RNA, 19 nt, Artificial Sequence
  Oligomer
gaucagucucaucuccacg

SEQ ID NO: 73972 - RNA, 19 nt, Artificial Sequence
  Oligomer
ugcaccgguggaauucugu

SEQ ID NO: 73973 - RNA, 19 nt, Artificial Sequence
  Oligomer
aucacaagcccgcucagaa

SEQ ID NO: 73974 - RNA, 19 nt, Artificial Sequence
  Oligomer
augaugaggaugcaugcca

SEQ ID NO: 73975 - RNA, 19 nt, Artificial Sequence
  Oligomer
uuccacuuggcguggauga

SEQ ID NO: 73976 - RNA, 19 nt, Artificial Sequence
  Oligomer
aaccaacgaaagaucuuug

SEQ ID NO: 73977 - RNA, 19 nt, Artificial Sequence
  Oligomer
cccacgaucagucucaucu

SEQ ID NO: 73978 - RNA, 19 nt, Artificial Sequence
  Oligomer
agagauggacguuucucag

SEQ ID NO: 73979 - RNA, 19 nt, Artificial Sequence
  Oligomer
auucuuccuggccuucucu

SEQ ID NO: 73980 - RNA, 19 nt, Artificial Sequence
  Oligomer
auugagcaccuugacuacu

SEQ ID NO: 73981 - RNA, 19 nt, Artificial Sequence
  Oligomer
uaggagauggucucucaga

SEQ ID NO: 73982 - RNA, 19 nt, Artificial Sequence
  Oligomer
auaucaugucugagcgcgu

SEQ ID NO: 73983 - RNA, 19 nt, Artificial Sequence
  Oligomer
uccacauucuggcugaaac

SEQ ID NO: 73984 - RNA, 19 nt, Artificial Sequence
  Oligomer
ucuagucauguuugcuucu

SEQ ID NO: 73985 - RNA, 19 nt, Artificial Sequence
  Oligomer
ccacacacucccaauaucc

SEQ ID NO: 73986 - RNA, 19 nt, Artificial Sequence
  Oligomer
auggacguuucucaggaag

SEQ ID NO: 73987 - RNA, 19 nt, Artificial Sequence
  Oligomer
acauuuuugguuuguucug

SEQ ID NO: 73988 - RNA, 19 nt, Artificial Sequence
  Oligomer
uugucaagacuugaggaag

SEQ ID NO: 73989 - RNA, 19 nt, Artificial Sequence
  Oligomer
uaucacaagcccgcucaga

SEQ ID NO: 73990 - RNA, 19 nt, Artificial Sequence
  Oligomer
uucagagccaaaagauaau

SEQ ID NO: 73991 - RNA, 19 nt, Artificial Sequence
  Oligomer
gcucauuucaguaacaaag

SEQ ID NO: 73992 - RNA, 19 nt, Artificial Sequence
  Oligomer
auaagcagggauaaagguu

SEQ ID NO: 73993 - RNA, 19 nt, Artificial Sequence
  Oligomer
agauaugaagcagggagau

SEQ ID NO: 73994 - RNA, 19 nt, Artificial Sequence
  Oligomer
cauuuugcuagggaccaug

SEQ ID NO: 73995 - RNA, 19 nt, Artificial Sequence
  Oligomer
agggaaguugggaaguuuc

SEQ ID NO: 73996 - RNA, 19 nt, Artificial Sequence
  Oligomer
ugugccaagcacuugguac

SEQ ID NO: 73997 - RNA, 19 nt, Artificial Sequence
  Oligomer
ucuuuaccggcaucacucu

SEQ ID NO: 73998 - RNA, 19 nt, Artificial Sequence
  Oligomer
auacaaaauccuggcagug

SEQ ID NO: 73999 - RNA, 19 nt, Artificial Sequence
  Oligomer
uugaaugaaagugggaaua

SEQ ID NO: 74000 - RNA, 19 nt, Artificial Sequence
  Oligomer
ucuuugagacuuccauggg

SEQ ID NO: 74001 - RNA, 19 nt, Artificial Sequence
  Oligomer
ugccaggagcauaaccuuc

SEQ ID NO: 74002 - RNA, 19 nt, Artificial Sequence
  Oligomer
auuuggacaccuuccaaac

SEQ ID NO: 74003 - RNA, 19 nt, Artificial Sequence
  Oligomer
aaaagcuggaacugaacac

SEQ ID NO: 74004 - RNA, 19 nt, Artificial Sequence
  Oligomer
cuuuaccggcaucacucuc

SEQ ID NO: 74005 - RNA, 19 nt, Artificial Sequence
  Oligomer
cuuccaugggcaaagauca

SEQ ID NO: 74006 - RNA, 19 nt, Artificial Sequence
  Oligomer
ugaugaggaugcaugccac

SEQ ID NO: 74007 - RNA, 19 nt, Artificial Sequence
  Oligomer
uggaaagguucucucucuc

SEQ ID NO: 74008 - RNA, 19 nt, Artificial Sequence
  Oligomer
auaauccguguauauuguc

SEQ ID NO: 74009 - RNA, 19 nt, Artificial Sequence
  Oligomer
uccugcgugguucuuucca

SEQ ID NO: 74010 - RNA, 19 nt, Artificial Sequence
  Oligomer
ucguuugguguuccgcaug

SEQ ID NO: 74011 - RNA, 19 nt, Artificial Sequence
  Oligomer
accuuccaaacucucacuc

SEQ ID NO: 74012 - RNA, 19 nt, Artificial Sequence
  Oligomer
augaggaugcaugccacac

SEQ ID NO: 74013 - RNA, 19 nt, Artificial Sequence
  Oligomer
ucauaaaccaaggugaaga

SEQ ID NO: 74014 - RNA, 19 nt, Artificial Sequence
  Oligomer
uucaacugcagcugaaaca

SEQ ID NO: 74015 - RNA, 19 nt, Artificial Sequence
  Oligomer
uuuggacaccuuccaaacu

SEQ ID NO: 74016 - RNA, 19 nt, Artificial Sequence
  Oligomer
aacaagucugggagauucc

SEQ ID NO: 74017 - RNA, 19 nt, Artificial Sequence
  Oligomer
acuggaggaagaaagaaug

SEQ ID NO: 74018 - RNA, 19 nt, Artificial Sequence
  Oligomer
cucaucuucggcaacuuuu

SEQ ID NO: 74019 - RNA, 19 nt, Artificial Sequence
  Oligomer
ucacagaaggcaucaaaag

SEQ ID NO: 74020 - RNA, 19 nt, Artificial Sequence
  Oligomer
uaucaugucugagcgcgug

SEQ ID NO: 74021 - RNA, 19 nt, Artificial Sequence
  Oligomer
uaaaaaugccaguggauaa

SEQ ID NO: 74022 - RNA, 19 nt, Artificial Sequence
  Oligomer
auaacauguauggcacuga

SEQ ID NO: 74023 - RNA, 19 nt, Artificial Sequence
  Oligomer
ugaaaugaagguaaagaag

SEQ ID NO: 74024 - RNA, 19 nt, Artificial Sequence
  Oligomer
uggaugagcucccucauuu

SEQ ID NO: 74025 - RNA, 19 nt, Artificial Sequence
  Oligomer
acaugauaugucuucaagg

SEQ ID NO: 74026 - RNA, 19 nt, Artificial Sequence
  Oligomer
uaucacaccuccugugguc

SEQ ID NO: 74027 - RNA, 19 nt, Artificial Sequence
  Oligomer
agauaagcagggauaaagg

SEQ ID NO: 74028 - RNA, 19 nt, Artificial Sequence
  Oligomer
aaaggcagagaugaugggc

SEQ ID NO: 74029 - RNA, 19 nt, Artificial Sequence
  Oligomer
auagccgcauaucaugucu

SEQ ID NO: 74030 - RNA, 19 nt, Artificial Sequence
  Oligomer
ucucacucuaggacaaaaa

SEQ ID NO: 74031 - RNA, 19 nt, Artificial Sequence
  Oligomer
ucucucaaauacuuccaua

SEQ ID NO: 74032 - RNA, 19 nt, Artificial Sequence
  Oligomer
uggacguuucucaggaagg

SEQ ID NO: 74033 - RNA, 19 nt, Artificial Sequence
  Oligomer
ucauuuacagccugguagg

SEQ ID NO: 74034 - RNA, 19 nt, Artificial Sequence
  Oligomer
gauaugaagcagggagaua

SEQ ID NO: 74035 - RNA, 19 nt, Artificial Sequence
  Oligomer
uucucaggaaggaaaaaga

SEQ ID NO: 74036 - RNA, 19 nt, Artificial Sequence
  Oligomer
uacugaagggaacgcacag

SEQ ID NO: 74037 - RNA, 19 nt, Artificial Sequence
  Oligomer
uacaaaagcuggaacugaa

SEQ ID NO: 74038 - RNA, 19 nt, Artificial Sequence
  Oligomer
accaugggagaugugaagg

SEQ ID NO: 74039 - RNA, 19 nt, Artificial Sequence
  Oligomer
ucucaggaaggaaaaagac

SEQ ID NO: 74040 - RNA, 19 nt, Artificial Sequence
  Oligomer
gcgaaauuccaguucuuuc

SEQ ID NO: 74041 - RNA, 19 nt, Artificial Sequence
  Oligomer
guaacugugcaaaauucug

SEQ ID NO: 74042 - RNA, 19 nt, Artificial Sequence
  Oligomer
guuucugcccucauuuaca

SEQ ID NO: 74043 - RNA, 19 nt, Artificial Sequence
  Oligomer
uacagagucuagggaaaca

SEQ ID NO: 74044 - RNA, 19 nt, Artificial Sequence
  Oligomer
uccguguauauugucaaaa

SEQ ID NO: 74045 - RNA, 19 nt, Artificial Sequence
  Oligomer
cauguuugcuucuucagag

SEQ ID NO: 74046 - RNA, 19 nt, Artificial Sequence
  Oligomer
uguuaugugagaacagacu

SEQ ID NO: 74047 - RNA, 19 nt, Artificial Sequence
  Oligomer
aacugaacacaaauauggg

SEQ ID NO: 74048 - RNA, 19 nt, Artificial Sequence
  Oligomer
cuccagagcgaaauuccag

SEQ ID NO: 74049 - RNA, 19 nt, Artificial Sequence
  Oligomer
uucuguaggcuugggcagu

SEQ ID NO: 74050 - RNA, 19 nt, Artificial Sequence
  Oligomer
ucuccagugaagugcacau

SEQ ID NO: 74051 - RNA, 19 nt, Artificial Sequence
  Oligomer
ugcaguacugaagggaacg

SEQ ID NO: 74052 - RNA, 19 nt, Artificial Sequence
  Oligomer
aguuucucuugcauuuccu

SEQ ID NO: 74053 - RNA, 19 nt, Artificial Sequence
  Oligomer
cuucaaggagcuaaaaaug

SEQ ID NO: 74054 - RNA, 19 nt, Artificial Sequence
  Oligomer
acauaauaucaaaggagag

SEQ ID NO: 74055 - RNA, 19 nt, Artificial Sequence
  Oligomer
aagucugggagauucccac

SEQ ID NO: 74056 - RNA, 19 nt, Artificial Sequence
  Oligomer
cauaucaugucugagcgcg

SEQ ID NO: 74057 - RNA, 19 nt, Artificial Sequence
  Oligomer
ugcauaucacaagcccgcu

SEQ ID NO: 74058 - RNA, 19 nt, Artificial Sequence
  Oligomer
agugggaguggaaagguuc

SEQ ID NO: 74059 - RNA, 19 nt, Artificial Sequence
  Oligomer
uuuggcacccgauggcaau

SEQ ID NO: 74060 - RNA, 19 nt, Artificial Sequence
  Oligomer
ugcaaggcaauguuggcug

SEQ ID NO: 74061 - RNA, 19 nt, Artificial Sequence
  Oligomer
ucuuuccaucuuguugguc

SEQ ID NO: 74062 - RNA, 19 nt, Artificial Sequence
  Oligomer
gaucuuugagacuuccaug

SEQ ID NO: 74063 - RNA, 19 nt, Artificial Sequence
  Oligomer
agauaugaagugcagguug

SEQ ID NO: 74064 - RNA, 19 nt, Artificial Sequence
  Oligomer
acaccauucuuccuggccu

SEQ ID NO: 74065 - RNA, 19 nt, Artificial Sequence
  Oligomer
ucuuucucuccagugaagu

SEQ ID NO: 74066 - RNA, 19 nt, Artificial Sequence
  Oligomer
ucuggucacauagaacaug

SEQ ID NO: 74067 - RNA, 19 nt, Artificial Sequence
  Oligomer
agucuggucacauagaaca

SEQ ID NO: 74068 - RNA, 19 nt, Artificial Sequence
  Oligomer
uccugaagaucaaaggcuc

SEQ ID NO: 74069 - RNA, 19 nt, Artificial Sequence
  Oligomer
ugacuacuacaggccuagc

SEQ ID NO: 74070 - RNA, 19 nt, Artificial Sequence
  Oligomer
uguagcuaagguuggcuug

SEQ ID NO: 74071 - RNA, 19 nt, Artificial Sequence
  Oligomer
uggaacugaacacaaauau

SEQ ID NO: 74072 - RNA, 19 nt, Artificial Sequence
  Oligomer
caaaggagaguuuaauacu

SEQ ID NO: 74073 - RNA, 19 nt, Artificial Sequence
  Oligomer
aaacucucacucuaggaca

SEQ ID NO: 74074 - RNA, 19 nt, Artificial Sequence
  Oligomer
augggcaaagaucaauaag

SEQ ID NO: 74075 - RNA, 19 nt, Artificial Sequence
  Oligomer
agugaagugcacauugcuc

SEQ ID NO: 74076 - RNA, 19 nt, Artificial Sequence
  Oligomer
gucauagcccaaaagcuug

SEQ ID NO: 74077 - RNA, 19 nt, Artificial Sequence
  Oligomer
cuagggaaacacaccauuc

SEQ ID NO: 74078 - RNA, 19 nt, Artificial Sequence
  Oligomer
uucuucagagccaaaagau

SEQ ID NO: 74079 - RNA, 19 nt, Artificial Sequence
  Oligomer
ccacauaauaucaaaggag

SEQ ID NO: 74080 - RNA, 19 nt, Artificial Sequence
  Oligomer
gagagauggacguuucuca

SEQ ID NO: 74081 - RNA, 19 nt, Artificial Sequence
  Oligomer
uaucucacacaugauaugu

SEQ ID NO: 74082 - RNA, 19 nt, Artificial Sequence
  Oligomer
aauguuggcugacaggcug

SEQ ID NO: 74083 - RNA, 19 nt, Artificial Sequence
  Oligomer
uuccaucuuguuggucaac

SEQ ID NO: 74084 - RNA, 19 nt, Artificial Sequence
  Oligomer
acuacauuacaucuuugag

SEQ ID NO: 74085 - RNA, 19 nt, Artificial Sequence
  Oligomer
agggagauaagcuaggaag

SEQ ID NO: 74086 - RNA, 19 nt, Artificial Sequence
  Oligomer
acgugcauaucacaagccc

SEQ ID NO: 74087 - RNA, 21 nt, Artificial Sequence
  Oligomer
gcuucauaucucucccuucuu

SEQ ID NO: 74088 - RNA, 21 nt, Artificial Sequence
  Oligomer
gcuuaucucccugcuucauau

SEQ ID NO: 74089 - RNA, 21 nt, Artificial Sequence
  Oligomer
uucauaucucucccuucuuua

SEQ ID NO: 74090 - RNA, 21 nt, Artificial Sequence
  Oligomer
caguauuaaacucuccuuuga

SEQ ID NO: 74091 - RNA, 21 nt, Artificial Sequence
  Oligomer
gguugaccaacaagauggaaa

SEQ ID NO: 74092 - RNA, 21 nt, Artificial Sequence
  Oligomer
cuucauaucucucccuucuuu

SEQ ID NO: 74093 - RNA, 21 nt, Artificial Sequence
  Oligomer
cuagcuuaucucccugcuuca

SEQ ID NO: 74094 - RNA, 21 nt, Artificial Sequence
  Oligomer
ggugcaaggagaugucugaau

SEQ ID NO: 74095 - RNA, 21 nt, Artificial Sequence
  Oligomer
ccuuuaucccugcuuaucuga

SEQ ID NO: 74096 - RNA, 21 nt, Artificial Sequence
  Oligomer
uauugaucuuugcccauggaa

SEQ ID NO: 74097 - RNA, 21 nt, Artificial Sequence
  Oligomer
caacauugccuugcauuugua

SEQ ID NO: 74098 - RNA, 21 nt, Artificial Sequence
  Oligomer
ccgacaugcugguuaagguga

SEQ ID NO: 74099 - RNA, 21 nt, Artificial Sequence
  Oligomer
cucccauggucccuagcaaaa

SEQ ID NO: 74100 - RNA, 21 nt, Artificial Sequence
  Oligomer
cugcuucauaucucucccuuc

SEQ ID NO: 74101 - RNA, 21 nt, Artificial Sequence
  Oligomer
ggcuuuuauuucagugccaua

SEQ ID NO: 74102 - RNA, 21 nt, Artificial Sequence
  Oligomer
ucauaucucucccuucuuuac

SEQ ID NO: 74103 - RNA, 21 nt, Artificial Sequence
  Oligomer
uguugagcaaugugcacuuca

SEQ ID NO: 74104 - RNA, 21 nt, Artificial Sequence
  Oligomer
cauagugggccuucauuaaau

SEQ ID NO: 74105 - RNA, 21 nt, Artificial Sequence
  Oligomer
caucagagaaggccaggaaga

SEQ ID NO: 74106 - RNA, 21 nt, Artificial Sequence
  Oligomer
agcuuaucucccugcuucaua

SEQ ID NO: 74107 - RNA, 21 nt, Artificial Sequence
  Oligomer
cggugcaaggagaugucugaa

SEQ ID NO: 74108 - RNA, 21 nt, Artificial Sequence
  Oligomer
ucucucccuucuuuaccuuca

SEQ ID NO: 74109 - RNA, 21 nt, Artificial Sequence
  Oligomer
cagacugcacaggaaaugcaa

SEQ ID NO: 74110 - RNA, 21 nt, Artificial Sequence
  Oligomer
ugccaucgggugccaaauaaa

SEQ ID NO: 74111 - RNA, 21 nt, Artificial Sequence
  Oligomer
cuuaucucccugcuucauauc

SEQ ID NO: 74112 - RNA, 21 nt, Artificial Sequence
  Oligomer
uaaggugaacgcacuuaucaa

SEQ ID NO: 74113 - RNA, 21 nt, Artificial Sequence
  Oligomer
guuagaacaucuucuggagaa

SEQ ID NO: 74114 - RNA, 21 nt, Artificial Sequence
  Oligomer
cuuuaucccugcuuaucugaa

SEQ ID NO: 74115 - RNA, 21 nt, Artificial Sequence
  Oligomer
uuaucucccugcuucauaucu

SEQ ID NO: 74116 - RNA, 21 nt, Artificial Sequence
  Oligomer
cucccuucuuuaccuucauuu

SEQ ID NO: 74117 - RNA, 21 nt, Artificial Sequence
  Oligomer
gaauguuucagcugcaguuga

SEQ ID NO: 74118 - RNA, 21 nt, Artificial Sequence
  Oligomer
ccauauuuguguucaguucca

SEQ ID NO: 74119 - RNA, 21 nt, Artificial Sequence
  Oligomer
cguccaucucucucccuuacu

SEQ ID NO: 74120 - RNA, 21 nt, Artificial Sequence
  Oligomer
auaucucucccuucuuuaccu

SEQ ID NO: 74121 - RNA, 21 nt, Artificial Sequence
  Oligomer
guguguggcaugcauccucau

SEQ ID NO: 74122 - RNA, 21 nt, Artificial Sequence
  Oligomer
aggacaucaucaccuuggaaa

SEQ ID NO: 74123 - RNA, 21 nt, Artificial Sequence
  Oligomer
uaucucucccuucuuuaccuu

SEQ ID NO: 74124 - RNA, 21 nt, Artificial Sequence
  Oligomer
cuuucaguauuaaacucuccu

SEQ ID NO: 74125 - RNA, 21 nt, Artificial Sequence
  Oligomer
gagugagaguuuggaaggugu

SEQ ID NO: 74126 - RNA, 21 nt, Artificial Sequence
  Oligomer
uagucaaggugcucaauaaau

SEQ ID NO: 74127 - RNA, 21 nt, Artificial Sequence
  Oligomer
cacuggagagaaagaacugga

SEQ ID NO: 74128 - RNA, 21 nt, Artificial Sequence
  Oligomer
gaagaaggcaagccaaccuua

SEQ ID NO: 74129 - RNA, 21 nt, Artificial Sequence
  Oligomer
guauugccaucgggugccaaa

SEQ ID NO: 74130 - RNA, 21 nt, Artificial Sequence
  Oligomer
cauuaguuaagaugucugaga

SEQ ID NO: 74131 - RNA, 21 nt, Artificial Sequence
  Oligomer
aggccaaagugggcaguuuca

SEQ ID NO: 74132 - RNA, 21 nt, Artificial Sequence
  Oligomer
gagaguuuggaagguguccaa

SEQ ID NO: 74133 - RNA, 21 nt, Artificial Sequence
  Oligomer
cuggcauuuuuagcuccuuga

SEQ ID NO: 74134 - RNA, 21 nt, Artificial Sequence
  Oligomer
ugcuaggccuguaguagucaa

SEQ ID NO: 74135 - RNA, 21 nt, Artificial Sequence
  Oligomer
ccaacaagauggaaagaacca

SEQ ID NO: 74136 - RNA, 21 nt, Artificial Sequence
  Oligomer
ggaaaugcaagagaaacugca

SEQ ID NO: 74137 - RNA, 21 nt, Artificial Sequence
  Oligomer
cucccugcuucauaucucucc

SEQ ID NO: 74138 - RNA, 21 nt, Artificial Sequence
  Oligomer
guuuguugaauaaaagaggga

SEQ ID NO: 74139 - RNA, 21 nt, Artificial Sequence
  Oligomer
caucauccacgccaaguggaa

SEQ ID NO: 74140 - RNA, 21 nt, Artificial Sequence
  Oligomer
gacugcacaggaaaugcaaga

SEQ ID NO: 74141 - RNA, 21 nt, Artificial Sequence
  Oligomer
gguuuuucagcucuuugacaa

SEQ ID NO: 74142 - RNA, 21 nt, Artificial Sequence
  Oligomer
ccaucucucucccuuacuauu

SEQ ID NO: 74143 - RNA, 21 nt, Artificial Sequence
  Oligomer
gaguuuggaagguguccaaau

SEQ ID NO: 74144 - RNA, 21 nt, Artificial Sequence
  Oligomer
caaagaucuuucguugguugu

SEQ ID NO: 74145 - RNA, 21 nt, Artificial Sequence
  Oligomer
ccaacuucccuguucuuuaag

SEQ ID NO: 74146 - RNA, 21 nt, Artificial Sequence
  Oligomer
gaaaaguugccgaagaugaga

SEQ ID NO: 74147 - RNA, 21 nt, Artificial Sequence
  Oligomer
uauggaaguauuugagagaga

SEQ ID NO: 74148 - RNA, 21 nt, Artificial Sequence
  Oligomer
agacauaucaugugugagaua

SEQ ID NO: 74149 - RNA, 21 nt, Artificial Sequence
  Oligomer
aucucccugcuucauaucucu

SEQ ID NO: 74150 - RNA, 21 nt, Artificial Sequence
  Oligomer
ucucccugcuucauaucucuc

SEQ ID NO: 74151 - RNA, 21 nt, Artificial Sequence
  Oligomer
aagugggcaguuucagccaga

SEQ ID NO: 74152 - RNA, 21 nt, Artificial Sequence
  Oligomer
ugaccaacaagauggaaagaa

SEQ ID NO: 74153 - RNA, 21 nt, Artificial Sequence
  Oligomer
uaucaaggaucgggaagguua

SEQ ID NO: 74154 - RNA, 21 nt, Artificial Sequence
  Oligomer
uaguagucaaggugcucaaua

SEQ ID NO: 74155 - RNA, 21 nt, Artificial Sequence
  Oligomer
gugaagccuugcacuccugaa

SEQ ID NO: 74156 - RNA, 21 nt, Artificial Sequence
  Oligomer
gaagacauaucaugugugaga

SEQ ID NO: 74157 - RNA, 21 nt, Artificial Sequence
  Oligomer
cugagaaacguccaucucucu

SEQ ID NO: 74158 - RNA, 21 nt, Artificial Sequence
  Oligomer
acaggaucauguaaaugcuca

SEQ ID NO: 74159 - RNA, 21 nt, Artificial Sequence
  Oligomer
auaaaagagggaagaaggcaa

SEQ ID NO: 74160 - RNA, 21 nt, Artificial Sequence
  Oligomer
aucucucccuucuuuaccuuc

SEQ ID NO: 74161 - RNA, 21 nt, Artificial Sequence
  Oligomer
uguucaguuccagcuuuugua

SEQ ID NO: 74162 - RNA, 21 nt, Artificial Sequence
  Oligomer
uccucaacuugcugccuaaga

SEQ ID NO: 74163 - RNA, 21 nt, Artificial Sequence
  Oligomer
cccaacuucccuguucuuuaa

SEQ ID NO: 74164 - RNA, 21 nt, Artificial Sequence
  Oligomer
caucuaugguguggaugggaa

SEQ ID NO: 74165 - RNA, 21 nt, Artificial Sequence
  Oligomer
ugguguggaugggaaacugcu

SEQ ID NO: 74166 - RNA, 21 nt, Artificial Sequence
  Oligomer
aacguccaucucucucccuua

SEQ ID NO: 74167 - RNA, 21 nt, Artificial Sequence
  Oligomer
ugacguccauguucuauguga

SEQ ID NO: 74168 - RNA, 21 nt, Artificial Sequence
  Oligomer
cuugcacuccugaauuuuauc

SEQ ID NO: 74169 - RNA, 21 nt, Artificial Sequence
  Oligomer
ugcuucauaucucucccuucu

SEQ ID NO: 74170 - RNA, 21 nt, Artificial Sequence
  Oligomer
guugaagagccugacaaguga

SEQ ID NO: 74171 - RNA, 21 nt, Artificial Sequence
  Oligomer
gugauuucuugcuaagcucca

SEQ ID NO: 74172 - RNA, 21 nt, Artificial Sequence
  Oligomer
acuuguuuccugugcccauca

SEQ ID NO: 74173 - RNA, 21 nt, Artificial Sequence
  Oligomer
cugucuuuuuccuuccugaga

SEQ ID NO: 74174 - RNA, 21 nt, Artificial Sequence
  Oligomer
gucuuuuuccuuccugagaaa

SEQ ID NO: 74175 - RNA, 21 nt, Artificial Sequence
  Oligomer
cuccagucuguucucacauaa

SEQ ID NO: 74176 - RNA, 21 nt, Artificial Sequence
  Oligomer
aaugcaagagaaacugcagaa

SEQ ID NO: 74177 - RNA, 21 nt, Artificial Sequence
  Oligomer
aagaaaaguugccgaagauga

SEQ ID NO: 74178 - RNA, 21 nt, Artificial Sequence
  Oligomer
uugcacuccugaauuuuauca

SEQ ID NO: 74179 - RNA, 21 nt, Artificial Sequence
  Oligomer
cucucccuucuuuaccuucau

SEQ ID NO: 74180 - RNA, 21 nt, Artificial Sequence
  Oligomer
cauaucucucccuucuuuacc

SEQ ID NO: 74181 - RNA, 21 nt, Artificial Sequence
  Oligomer
gauagagccuuugaucuucag

SEQ ID NO: 74182 - RNA, 21 nt, Artificial Sequence
  Oligomer
guuugugagccuugcugccaa

SEQ ID NO: 74183 - RNA, 21 nt, Artificial Sequence
  Oligomer
ugucuagaauccugcuuuaca

SEQ ID NO: 74184 - RNA, 21 nt, Artificial Sequence
  Oligomer
gaagguuaugcuccuggcaca

SEQ ID NO: 74185 - RNA, 21 nt, Artificial Sequence
  Oligomer
aacuccucaacuugcugccua

SEQ ID NO: 74186 - RNA, 21 nt, Artificial Sequence
  Oligomer
guuguugagcgaauuguuaga

SEQ ID NO: 74187 - RNA, 21 nt, Artificial Sequence
  Oligomer
uacucuagucacccucuucaa

SEQ ID NO: 74188 - RNA, 21 nt, Artificial Sequence
  Oligomer
agaacaucuucuggagaagga

SEQ ID NO: 74189 - RNA, 21 nt, Artificial Sequence
  Oligomer
caaggagaugucugaauacug

SEQ ID NO: 74190 - RNA, 21 nt, Artificial Sequence
  Oligomer
ggaaaugagggagcucaucca

SEQ ID NO: 74191 - RNA, 21 nt, Artificial Sequence
  Oligomer
gaaacguccaucucucucccu

SEQ ID NO: 74192 - RNA, 21 nt, Artificial Sequence
  Oligomer
ccaucuaugguguggauggga

SEQ ID NO: 74193 - RNA, 21 nt, Artificial Sequence
  Oligomer
caugcauccucaucaucagga

SEQ ID NO: 74194 - RNA, 21 nt, Artificial Sequence
  Oligomer
ggugaacgcacuuaucaagga

SEQ ID NO: 74195 - RNA, 21 nt, Artificial Sequence
  Oligomer
ccaagagguuuuucagcucuu

SEQ ID NO: 74196 - RNA, 21 nt, Artificial Sequence
  Oligomer
gucugagagaccaucuccuau

SEQ ID NO: 74197 - RNA, 21 nt, Artificial Sequence
  Oligomer
uugacaacgccaacugcccaa

SEQ ID NO: 74198 - RNA, 21 nt, Artificial Sequence
  Oligomer
cuuuugacaauauacacggau

SEQ ID NO: 74199 - RNA, 21 nt, Artificial Sequence
  Oligomer
gccaggauuugguuguuuaaa

SEQ ID NO: 74200 - RNA, 21 nt, Artificial Sequence
  Oligomer
uguuguugagcgaauuguuag

SEQ ID NO: 74201 - RNA, 21 nt, Artificial Sequence
  Oligomer
agguuaugcuccuggcacaga

SEQ ID NO: 74202 - RNA, 21 nt, Artificial Sequence
  Oligomer
ccuauugccaggaauguuuca

SEQ ID NO: 74203 - RNA, 21 nt, Artificial Sequence
  Oligomer
gauuuuguauugccaucgggu

SEQ ID NO: 74204 - RNA, 21 nt, Artificial Sequence
  Oligomer
ggcacauagugggccuucauu

SEQ ID NO: 74205 - RNA, 21 nt, Artificial Sequence
  Oligomer
gauggaaagaaccacgcagga

SEQ ID NO: 74206 - RNA, 21 nt, Artificial Sequence
  Oligomer
uaaagaaaaguugccgaagau

SEQ ID NO: 74207 - RNA, 21 nt, Artificial Sequence
  Oligomer
caucgaggcucuugcucaagu

SEQ ID NO: 74208 - RNA, 21 nt, Artificial Sequence
  Oligomer
gcuuuugggcuaugacgucca

SEQ ID NO: 74209 - RNA, 21 nt, Artificial Sequence
  Oligomer
ugaagagccugacaagugaag

SEQ ID NO: 74210 - RNA, 21 nt, Artificial Sequence
  Oligomer
gugcaaggagaugucugaaua

SEQ ID NO: 74211 - RNA, 21 nt, Artificial Sequence
  Oligomer
uuucguugguuguuucucuga

SEQ ID NO: 74212 - RNA, 21 nt, Artificial Sequence
  Oligomer
aguauggaaguauuugagaga

SEQ ID NO: 74213 - RNA, 21 nt, Artificial Sequence
  Oligomer
aucagagaaggccaggaagaa

SEQ ID NO: 74214 - RNA, 21 nt, Artificial Sequence
  Oligomer
cuuccugagaaacguccaucu

SEQ ID NO: 74215 - RNA, 21 nt, Artificial Sequence
  Oligomer
acaucuucuggagaaggacau

SEQ ID NO: 74216 - RNA, 21 nt, Artificial Sequence
  Oligomer
agagguuuuucagcucuuuga

SEQ ID NO: 74217 - RNA, 21 nt, Artificial Sequence
  Oligomer
gaccacaggaggugugauaga

SEQ ID NO: 74218 - RNA, 21 nt, Artificial Sequence
  Oligomer
cuuucauucaaucaaccugca

SEQ ID NO: 74219 - RNA, 21 nt, Artificial Sequence
  Oligomer
ucuucaccuugguuuaugaga

SEQ ID NO: 74220 - RNA, 21 nt, Artificial Sequence
  Oligomer
uguuggcugcugccaccaaau

SEQ ID NO: 74221 - RNA, 21 nt, Artificial Sequence
  Oligomer
aaacguccaucucucucccuu

SEQ ID NO: 74222 - RNA, 21 nt, Artificial Sequence
  Oligomer
cuagaauccugcuuuacagga

SEQ ID NO: 74223 - RNA, 21 nt, Artificial Sequence
  Oligomer
caaacacacuuccagcuggca

SEQ ID NO: 74224 - RNA, 21 nt, Artificial Sequence
  Oligomer
ccagcuggcauauagguugca

SEQ ID NO: 74225 - RNA, 21 nt, Artificial Sequence
  Oligomer
caaacagcuguuguugagcga

SEQ ID NO: 74226 - RNA, 21 nt, Artificial Sequence
  Oligomer
ucucccauggucccuagcaaa

SEQ ID NO: 74227 - RNA, 21 nt, Artificial Sequence
  Oligomer
gugcacuucacuggagagaaa

SEQ ID NO: 74228 - RNA, 21 nt, Artificial Sequence
  Oligomer
acuauucccacuuucauucaa

SEQ ID NO: 74229 - RNA, 21 nt, Artificial Sequence
  Oligomer
guuuucugagcgggcuuguga

SEQ ID NO: 74230 - RNA, 21 nt, Artificial Sequence
  Oligomer
guugagcgaauuguuagaaca

SEQ ID NO: 74231 - RNA, 21 nt, Artificial Sequence
  Oligomer
cuuuuggcucugaagaagcaa

SEQ ID NO: 74232 - RNA, 21 nt, Artificial Sequence
  Oligomer
cuuggaaaugagggagcucau

SEQ ID NO: 74233 - RNA, 21 nt, Artificial Sequence
  Oligomer
auuucagugccauacauguua

SEQ ID NO: 74234 - RNA, 21 nt, Artificial Sequence
  Oligomer
acucuccuuugauauuaugug

SEQ ID NO: 74235 - RNA, 21 nt, Artificial Sequence
  Oligomer
cucucucccuuacuauuccca

SEQ ID NO: 74236 - RNA, 21 nt, Artificial Sequence
  Oligomer
ccuagagugagaguuuggaag

SEQ ID NO: 74237 - RNA, 21 nt, Artificial Sequence
  Oligomer
gcucugaagaagcaaacauga

SEQ ID NO: 74238 - RNA, 21 nt, Artificial Sequence
  Oligomer
ucuuugcccauggaagucuca

SEQ ID NO: 74239 - RNA, 21 nt, Artificial Sequence
  Oligomer
uuaucuuuuggcucugaagaa

SEQ ID NO: 74240 - RNA, 21 nt, Artificial Sequence
  Oligomer
aggccagcuccuuuucuguga

SEQ ID NO: 74241 - RNA, 21 nt, Artificial Sequence
  Oligomer
ccagacugcacaggaaaugca

SEQ ID NO: 74242 - RNA, 21 nt, Artificial Sequence
  Oligomer
gguguguuucccuagacucug

SEQ ID NO: 74243 - RNA, 21 nt, Artificial Sequence
  Oligomer
cauguguuuugcuuuuaucca

SEQ ID NO: 74244 - RNA, 21 nt, Artificial Sequence
  Oligomer
ugcccaagccuacagaacaaa

SEQ ID NO: 74245 - RNA, 21 nt, Artificial Sequence
  Oligomer
ccuucuuccucaagucuugac

SEQ ID NO: 74246 - RNA, 21 nt, Artificial Sequence
  Oligomer
auucaaucaaccugcacuuca

SEQ ID NO: 74247 - RNA, 21 nt, Artificial Sequence
  Oligomer
cacacuuccagcuggcauaua

SEQ ID NO: 74248 - RNA, 21 nt, Artificial Sequence
  Oligomer
uguugaauaaaagagggaaga

SEQ ID NO: 74249 - RNA, 21 nt, Artificial Sequence
  Oligomer
cuugguuuaugagaacugguu

SEQ ID NO: 74250 - RNA, 21 nt, Artificial Sequence
  Oligomer
agaguuuggaagguguccaaa

SEQ ID NO: 74251 - RNA, 21 nt, Artificial Sequence
  Oligomer
cagccaacauugccuugcauu

SEQ ID NO: 74252 - RNA, 21 nt, Artificial Sequence
  Oligomer
uguuagaacaucuucuggaga

SEQ ID NO: 74253 - RNA, 21 nt, Artificial Sequence
  Oligomer
caguuucagccagaaugugga

SEQ ID NO: 74254 - RNA, 21 nt, Artificial Sequence
  Oligomer
uccugagaaacguccaucucu

SEQ ID NO: 74255 - RNA, 21 nt, Artificial Sequence
  Oligomer
gugugauagagccuuugaucu

SEQ ID NO: 74256 - RNA, 21 nt, Artificial Sequence
  Oligomer
cccacugccaggauuuuguau

SEQ ID NO: 74257 - RNA, 21 nt, Artificial Sequence
  Oligomer
caccaaacgagguuccuggua

SEQ ID NO: 74258 - RNA, 21 nt, Artificial Sequence
  Oligomer
cucugucuuuuuccuuccuga

SEQ ID NO: 74259 - RNA, 21 nt, Artificial Sequence
  Oligomer
cucugaagaagcaaacaugac

SEQ ID NO: 74260 - RNA, 21 nt, Artificial Sequence
  Oligomer
caagccaaccuuagcuacaau

SEQ ID NO: 74261 - RNA, 21 nt, Artificial Sequence
  Oligomer
gagagaaccuuuccacuccca

SEQ ID NO: 74262 - RNA, 21 nt, Artificial Sequence
  Oligomer
cuuacuauucccacuuucauu

SEQ ID NO: 74263 - RNA, 21 nt, Artificial Sequence
  Oligomer
gaaacugcuccagcuccaaga

SEQ ID NO: 74264 - RNA, 21 nt, Artificial Sequence
  Oligomer
aaaugagggcagaaaccuugu

SEQ ID NO: 74265 - RNA, 21 nt, Artificial Sequence
  Oligomer
cauguaaaugcucaaagaugu

SEQ ID NO: 74266 - RNA, 21 nt, Artificial Sequence
  Oligomer
caacuucccuguucuuuaaga

SEQ ID NO: 74267 - RNA, 21 nt, Artificial Sequence
  Oligomer
gaauccugcuuuacaggauca

SEQ ID NO: 74268 - RNA, 21 nt, Artificial Sequence
  Oligomer
aaaugcaagagaaacugcaga

SEQ ID NO: 74269 - RNA, 21 nt, Artificial Sequence
  Oligomer
cuuugcccauggaagucucaa

SEQ ID NO: 74270 - RNA, 21 nt, Artificial Sequence
  Oligomer
caaagugggcaguuucagcca

SEQ ID NO: 74271 - RNA, 21 nt, Artificial Sequence
  Oligomer
aaaugcuaggccuguaguagu

SEQ ID NO: 74272 - RNA, 21 nt, Artificial Sequence
  Oligomer
aaauggugauuucuugcuaag

SEQ ID NO: 74273 - RNA, 21 nt, Artificial Sequence
  Oligomer
cacuuaucaaggaucgggaag

SEQ ID NO: 74274 - RNA, 21 nt, Artificial Sequence
  Oligomer
cccuucuuuaccuucauuuca

SEQ ID NO: 74275 - RNA, 21 nt, Artificial Sequence
  Oligomer
uguuuuuccauguguuuugcu

SEQ ID NO: 74276 - RNA, 21 nt, Artificial Sequence
  Oligomer
gugucugucaccacaucuugu

SEQ ID NO: 74277 - RNA, 21 nt, Artificial Sequence
  Oligomer
agaaaaguugccgaagaugag

SEQ ID NO: 74278 - RNA, 21 nt, Artificial Sequence
  Oligomer
gcuccuugaagacauaucaug

SEQ ID NO: 74279 - RNA, 21 nt, Artificial Sequence
  Oligomer
ugcuuaucugaaacuucccaa

SEQ ID NO: 74280 - RNA, 21 nt, Artificial Sequence
  Oligomer
ccacgcgcucagacaugauau

SEQ ID NO: 74281 - RNA, 21 nt, Artificial Sequence
  Oligomer
ccuugaaccucauuaaauggu

SEQ ID NO: 74282 - RNA, 21 nt, Artificial Sequence
  Oligomer
auuccaccggugcaaggagau

SEQ ID NO: 74283 - RNA, 21 nt, Artificial Sequence
  Oligomer
uugugauaugcacguggccga

SEQ ID NO: 74284 - RNA, 21 nt, Artificial Sequence
  Oligomer
uuguguucaguuccagcuuuu

SEQ ID NO: 74285 - RNA, 21 nt, Artificial Sequence
  Oligomer
cuuuguuacugaaaugagccu

SEQ ID NO: 74286 - RNA, 21 nt, Artificial Sequence
  Oligomer
uucccuagacucuguaaccac

SEQ ID NO: 74287 - RNA, 21 nt, Artificial Sequence
  Oligomer
gaaggacaucaucaccuugga

SEQ ID NO: 74288 - RNA, 21 nt, Artificial Sequence
  Oligomer
auuuguuugggugguuuguga

SEQ ID NO: 74289 - RNA, 21 nt, Artificial Sequence
  Oligomer
gcaagccaaccuuagcuacaa

SEQ ID NO: 74290 - RNA, 21 nt, Artificial Sequence
  Oligomer
aggugguguccuucuuccuca

SEQ ID NO: 74291 - RNA, 21 nt, Artificial Sequence
  Oligomer
acgagguuccugguacaucga

SEQ ID NO: 74292 - RNA, 21 nt, Artificial Sequence
  Oligomer
uaaccaccucucugucuuuuu

SEQ ID NO: 74293 - RNA, 21 nt, Artificial Sequence
  Oligomer
agguuuuucagcucuuugaca

SEQ ID NO: 74294 - RNA, 21 nt, Artificial Sequence
  Oligomer
aaccugcacuucauaucuaga

SEQ ID NO: 74295 - RNA, 21 nt, Artificial Sequence
  Oligomer
cagugccauacauguuauugu

SEQ ID NO: 74296 - RNA, 21 nt, Artificial Sequence
  Oligomer
uggaagguguccaaauuuaau

SEQ ID NO: 74297 - RNA, 21 nt, Artificial Sequence
  Oligomer
ugauagagccuuugaucuuca

SEQ ID NO: 74298 - RNA, 21 nt, Artificial Sequence
  Oligomer
aagugaaguuguaaacacagu

SEQ ID NO: 74299 - RNA, 21 nt, Artificial Sequence
  Oligomer
cuaugacguccauguucuaug

SEQ ID NO: 74300 - RNA, 21 nt, Artificial Sequence
  Oligomer
ccaucgggugccaaauaaaug

SEQ ID NO: 74301 - RNA, 21 nt, Artificial Sequence
  Oligomer
agugaugccgguaaagaaaag

SEQ ID NO: 74302 - RNA, 21 nt, Artificial Sequence
  Oligomer
gagaaagaacuggaauuucgc

SEQ ID NO: 74303 - RNA, 21 nt, Artificial Sequence
  Oligomer
accuugcugcaguguccagaa

SEQ ID NO: 74304 - RNA, 21 nt, Artificial Sequence
  Oligomer
uggcauuuuuagcuccuugaa

SEQ ID NO: 74305 - RNA, 21 nt, Artificial Sequence
  Oligomer
cucaacuugcugccuaagagg

SEQ ID NO: 74306 - RNA, 21 nt, Artificial Sequence
  Oligomer
cuugguuggaccuauugccag

SEQ ID NO: 74307 - RNA, 21 nt, Artificial Sequence
  Oligomer
ucagcucuuugacaacgccaa

SEQ ID NO: 74308 - RNA, 21 nt, Artificial Sequence
  Oligomer
cuuccauucuuucuuccucca

SEQ ID NO: 74309 - RNA, 21 nt, Artificial Sequence
  Oligomer
gcuccagcuccaagagguuuu

SEQ ID NO: 74310 - RNA, 21 nt, Artificial Sequence
  Oligomer
uuuucugagcgggcuugugau

SEQ ID NO: 74311 - RNA, 21 nt, Artificial Sequence
  Oligomer
caagcuuuugggcuaugacgu

SEQ ID NO: 74312 - RNA, 21 nt, Artificial Sequence
  Oligomer
aaacagcuguuguugagcgaa

SEQ ID NO: 74313 - RNA, 21 nt, Artificial Sequence
  Oligomer
uugccaucgggugccaaauaa

SEQ ID NO: 74314 - RNA, 21 nt, Artificial Sequence
  Oligomer
uggcaugcauccucaucauca

SEQ ID NO: 74315 - RNA, 21 nt, Artificial Sequence
  Oligomer
aguggucuccucucagcuucu

SEQ ID NO: 74316 - RNA, 21 nt, Artificial Sequence
  Oligomer
ccagucuguucucacauaaca

SEQ ID NO: 74317 - RNA, 21 nt, Artificial Sequence
  Oligomer
guacucuagucacccucuuca

SEQ ID NO: 74318 - RNA, 21 nt, Artificial Sequence
  Oligomer
guccaucucucucccuuacua

SEQ ID NO: 74319 - RNA, 21 nt, Artificial Sequence
  Oligomer
cuucugugucugucaccacau

SEQ ID NO: 74320 - RNA, 21 nt, Artificial Sequence
  Oligomer
cagagaaggccaggaagaaug

SEQ ID NO: 74321 - RNA, 21 nt, Artificial Sequence
  Oligomer
caagugaaguuguaaacacag

SEQ ID NO: 74322 - RNA, 21 nt, Artificial Sequence
  Oligomer
uucucugagcuuuguuacuga

SEQ ID NO: 74323 - RNA, 21 nt, Artificial Sequence
  Oligomer
ugugauagagccuuugaucuu

SEQ ID NO: 74324 - RNA, 21 nt, Artificial Sequence
  Oligomer
aacacacuuccagcuggcaua

SEQ ID NO: 74325 - RNA, 21 nt, Artificial Sequence
  Oligomer
uguggaugggaaacugcucca

SEQ ID NO: 74326 - RNA, 21 nt, Artificial Sequence
  Oligomer
agucuguucucacauaacaga

SEQ ID NO: 74327 - RNA, 21 nt, Artificial Sequence
  Oligomer
uagugggccuucauuaaaugu

SEQ ID NO: 74328 - RNA, 21 nt, Artificial Sequence
  Oligomer
uguccuucuuccucaagucuu

SEQ ID NO: 74329 - RNA, 21 nt, Artificial Sequence
  Oligomer
cuuguuuccugugcccaucau

SEQ ID NO: 74330 - RNA, 21 nt, Artificial Sequence
  Oligomer
gacauaucaugugugagauaa

SEQ ID NO: 74331 - RNA, 21 nt, Artificial Sequence
  Oligomer
ugcaguugaagagccugacaa

SEQ ID NO: 74332 - RNA, 21 nt, Artificial Sequence
  Oligomer
aauaaaagagggaagaaggca

SEQ ID NO: 74333 - RNA, 21 nt, Artificial Sequence
  Oligomer
aagaagggagagauaugaagc

SEQ ID NO: 74334 - RNA, 21 nt, Artificial Sequence
  Oligomer
auaugaagcagggagauaagc

SEQ ID NO: 74335 - RNA, 21 nt, Artificial Sequence
  Oligomer
uaaagaagggagagauaugaa

SEQ ID NO: 74336 - RNA, 21 nt, Artificial Sequence
  Oligomer
ucaaaggagaguuuaauacug

SEQ ID NO: 74337 - RNA, 21 nt, Artificial Sequence
  Oligomer
uuuccaucuuguuggucaacc

SEQ ID NO: 74338 - RNA, 21 nt, Artificial Sequence
  Oligomer
aaagaagggagagauaugaag

SEQ ID NO: 74339 - RNA, 21 nt, Artificial Sequence
  Oligomer
ugaagcagggagauaagcuag

SEQ ID NO: 74340 - RNA, 21 nt, Artificial Sequence
  Oligomer
auucagacaucuccuugcacc

SEQ ID NO: 74341 - RNA, 21 nt, Artificial Sequence
  Oligomer
ucagauaagcagggauaaagg

SEQ ID NO: 74342 - RNA, 21 nt, Artificial Sequence
  Oligomer
uuccaugggcaaagaucaaua

SEQ ID NO: 74343 - RNA, 21 nt, Artificial Sequence
  Oligomer
uacaaaugcaaggcaauguug

SEQ ID NO: 74344 - RNA, 21 nt, Artificial Sequence
  Oligomer
ucaccuuaaccagcaugucgg

SEQ ID NO: 74345 - RNA, 21 nt, Artificial Sequence
  Oligomer
uuuugcuagggaccaugggag

SEQ ID NO: 74346 - RNA, 21 nt, Artificial Sequence
  Oligomer
gaagggagagauaugaagcag

SEQ ID NO: 74347 - RNA, 21 nt, Artificial Sequence
  Oligomer
uauggcacugaaauaaaagcc

SEQ ID NO: 74348 - RNA, 21 nt, Artificial Sequence
  Oligomer
guaaagaagggagagauauga

SEQ ID NO: 74349 - RNA, 21 nt, Artificial Sequence
  Oligomer
ugaagugcacauugcucaaca

SEQ ID NO: 74350 - RNA, 21 nt, Artificial Sequence
  Oligomer
auuuaaugaaggcccacuaug

SEQ ID NO: 74351 - RNA, 21 nt, Artificial Sequence
  Oligomer
ucuuccuggccuucucugaug

SEQ ID NO: 74352 - RNA, 21 nt, Artificial Sequence
  Oligomer
uaugaagcagggagauaagcu

SEQ ID NO: 74353 - RNA, 21 nt, Artificial Sequence
  Oligomer
uucagacaucuccuugcaccg

SEQ ID NO: 74354 - RNA, 21 nt, Artificial Sequence
  Oligomer
ugaagguaaagaagggagaga

SEQ ID NO: 74355 - RNA, 21 nt, Artificial Sequence
  Oligomer
uugcauuuccugugcagucug

SEQ ID NO: 74356 - RNA, 21 nt, Artificial Sequence
  Oligomer
uuuauuuggcacccgauggca

SEQ ID NO: 74357 - RNA, 21 nt, Artificial Sequence
  Oligomer
gauaugaagcagggagauaag

SEQ ID NO: 74358 - RNA, 21 nt, Artificial Sequence
  Oligomer
uugauaagugcguucaccuua

SEQ ID NO: 74359 - RNA, 21 nt, Artificial Sequence
  Oligomer
uucuccagaagauguucuaac

SEQ ID NO: 74360 - RNA, 21 nt, Artificial Sequence
  Oligomer
uucagauaagcagggauaaag

SEQ ID NO: 74361 - RNA, 21 nt, Artificial Sequence
  Oligomer
agauaugaagcagggagauaa

SEQ ID NO: 74362 - RNA, 21 nt, Artificial Sequence
  Oligomer
aaaugaagguaaagaagggag

SEQ ID NO: 74363 - RNA, 21 nt, Artificial Sequence
  Oligomer
ucaacugcagcugaaacauuc

SEQ ID NO: 74364 - RNA, 21 nt, Artificial Sequence
  Oligomer
uggaacugaacacaaauaugg

SEQ ID NO: 74365 - RNA, 21 nt, Artificial Sequence
  Oligomer
aguaagggagagagauggacg

SEQ ID NO: 74366 - RNA, 21 nt, Artificial Sequence
  Oligomer
agguaaagaagggagagauau

SEQ ID NO: 74367 - RNA, 21 nt, Artificial Sequence
  Oligomer
augaggaugcaugccacacac

SEQ ID NO: 74368 - RNA, 21 nt, Artificial Sequence
  Oligomer
uuuccaaggugaugauguccu

SEQ ID NO: 74369 - RNA, 21 nt, Artificial Sequence
  Oligomer
aagguaaagaagggagagaua

SEQ ID NO: 74370 - RNA, 21 nt, Artificial Sequence
  Oligomer
aggagaguuuaauacugaaag

SEQ ID NO: 74371 - RNA, 21 nt, Artificial Sequence
  Oligomer
acaccuuccaaacucucacuc

SEQ ID NO: 74372 - RNA, 21 nt, Artificial Sequence
  Oligomer
auuuauugagcaccuugacua

SEQ ID NO: 74373 - RNA, 21 nt, Artificial Sequence
  Oligomer
uccaguucuuucucuccagug

SEQ ID NO: 74374 - RNA, 21 nt, Artificial Sequence
  Oligomer
uaagguuggcuugccuucuuc

SEQ ID NO: 74375 - RNA, 21 nt, Artificial Sequence
  Oligomer
uuuggcacccgauggcaauac

SEQ ID NO: 74376 - RNA, 21 nt, Artificial Sequence
  Oligomer
ucucagacaucuuaacuaaug

SEQ ID NO: 74377 - RNA, 21 nt, Artificial Sequence
  Oligomer
ugaaacugcccacuuuggccu

SEQ ID NO: 74378 - RNA, 21 nt, Artificial Sequence
  Oligomer
uuggacaccuuccaaacucuc

SEQ ID NO: 74379 - RNA, 21 nt, Artificial Sequence
  Oligomer
ucaaggagcuaaaaaugccag

SEQ ID NO: 74380 - RNA, 21 nt, Artificial Sequence
  Oligomer
uugacuacuacaggccuagca

SEQ ID NO: 74381 - RNA, 21 nt, Artificial Sequence
  Oligomer
ugguucuuuccaucuuguugg

SEQ ID NO: 74382 - RNA, 21 nt, Artificial Sequence
  Oligomer
ugcaguuucucuugcauuucc

SEQ ID NO: 74383 - RNA, 21 nt, Artificial Sequence
  Oligomer
ggagagauaugaagcagggag

SEQ ID NO: 74384 - RNA, 21 nt, Artificial Sequence
  Oligomer
ucccucuuuuauucaacaaac

SEQ ID NO: 74385 - RNA, 21 nt, Artificial Sequence
  Oligomer
uuccacuuggcguggaugaug

SEQ ID NO: 74386 - RNA, 21 nt, Artificial Sequence
  Oligomer
ucuugcauuuccugugcaguc

SEQ ID NO: 74387 - RNA, 21 nt, Artificial Sequence
  Oligomer
uugucaaagagcugaaaaacc

SEQ ID NO: 74388 - RNA, 21 nt, Artificial Sequence
  Oligomer
aauaguaagggagagagaugg

SEQ ID NO: 74389 - RNA, 21 nt, Artificial Sequence
  Oligomer
auuuggacaccuuccaaacuc

SEQ ID NO: 74390 - RNA, 21 nt, Artificial Sequence
  Oligomer
acaaccaacgaaagaucuuug

SEQ ID NO: 74391 - RNA, 21 nt, Artificial Sequence
  Oligomer
cuuaaagaacagggaaguugg

SEQ ID NO: 74392 - RNA, 21 nt, Artificial Sequence
  Oligomer
ucucaucuucggcaacuuuuc

SEQ ID NO: 74393 - RNA, 21 nt, Artificial Sequence
  Oligomer
ucucucucaaauacuuccaua

SEQ ID NO: 74394 - RNA, 21 nt, Artificial Sequence
  Oligomer
uaucucacacaugauaugucu

SEQ ID NO: 74395 - RNA, 21 nt, Artificial Sequence
  Oligomer
agagauaugaagcagggagau

SEQ ID NO: 74396 - RNA, 21 nt, Artificial Sequence
  Oligomer
gagagauaugaagcagggaga

SEQ ID NO: 74397 - RNA, 21 nt, Artificial Sequence
  Oligomer
ucuggcugaaacugcccacuu

SEQ ID NO: 74398 - RNA, 21 nt, Artificial Sequence
  Oligomer
uucuuuccaucuuguugguca

SEQ ID NO: 74399 - RNA, 21 nt, Artificial Sequence
  Oligomer
uaaccuucccgauccuugaua

SEQ ID NO: 74400 - RNA, 21 nt, Artificial Sequence
  Oligomer
uauugagcaccuugacuacua

SEQ ID NO: 74401 - RNA, 21 nt, Artificial Sequence
  Oligomer
uucaggagugcaaggcuucac

SEQ ID NO: 74402 - RNA, 21 nt, Artificial Sequence
  Oligomer
ucucacacaugauaugucuuc

SEQ ID NO: 74403 - RNA, 21 nt, Artificial Sequence
  Oligomer
agagagauggacguuucucag

SEQ ID NO: 74404 - RNA, 21 nt, Artificial Sequence
  Oligomer
ugagcauuuacaugauccugu

SEQ ID NO: 74405 - RNA, 21 nt, Artificial Sequence
  Oligomer
uugccuucuucccucuuuuau

SEQ ID NO: 74406 - RNA, 21 nt, Artificial Sequence
  Oligomer
gaagguaaagaagggagagau

SEQ ID NO: 74407 - RNA, 21 nt, Artificial Sequence
  Oligomer
uacaaaagcuggaacugaaca

SEQ ID NO: 74408 - RNA, 21 nt, Artificial Sequence
  Oligomer
ucuuaggcagcaaguugagga

SEQ ID NO: 74409 - RNA, 21 nt, Artificial Sequence
  Oligomer
uuaaagaacagggaaguuggg

SEQ ID NO: 74410 - RNA, 21 nt, Artificial Sequence
  Oligomer
uucccauccacaccauagaug

SEQ ID NO: 74411 - RNA, 21 nt, Artificial Sequence
  Oligomer
agcaguuucccauccacacca

SEQ ID NO: 74412 - RNA, 21 nt, Artificial Sequence
  Oligomer
uaagggagagagauggacguu

SEQ ID NO: 74413 - RNA, 21 nt, Artificial Sequence
  Oligomer
ucacauagaacauggacguca

SEQ ID NO: 74414 - RNA, 21 nt, Artificial Sequence
  Oligomer
gauaaaauucaggagugcaag

SEQ ID NO: 74415 - RNA, 21 nt, Artificial Sequence
  Oligomer
agaagggagagauaugaagca

SEQ ID NO: 74416 - RNA, 21 nt, Artificial Sequence
  Oligomer
ucacuugucaggcucuucaac

SEQ ID NO: 74417 - RNA, 21 nt, Artificial Sequence
  Oligomer
uggagcuuagcaagaaaucac

SEQ ID NO: 74418 - RNA, 21 nt, Artificial Sequence
  Oligomer
ugaugggcacaggaaacaagu

SEQ ID NO: 74419 - RNA, 21 nt, Artificial Sequence
  Oligomer
ucucaggaaggaaaaagacag

SEQ ID NO: 74420 - RNA, 21 nt, Artificial Sequence
  Oligomer
uuucucaggaaggaaaaagac

SEQ ID NO: 74421 - RNA, 21 nt, Artificial Sequence
  Oligomer
uuaugugagaacagacuggag

SEQ ID NO: 74422 - RNA, 21 nt, Artificial Sequence
  Oligomer
uucugcaguuucucuugcauu

SEQ ID NO: 74423 - RNA, 21 nt, Artificial Sequence
  Oligomer
ucaucuucggcaacuuuucuu

SEQ ID NO: 74424 - RNA, 21 nt, Artificial Sequence
  Oligomer
ugauaaaauucaggagugcaa

SEQ ID NO: 74425 - RNA, 21 nt, Artificial Sequence
  Oligomer
augaagguaaagaagggagag

SEQ ID NO: 74426 - RNA, 21 nt, Artificial Sequence
  Oligomer
gguaaagaagggagagauaug

SEQ ID NO: 74427 - RNA, 21 nt, Artificial Sequence
  Oligomer
cugaagaucaaaggcucuauc

SEQ ID NO: 74428 - RNA, 21 nt, Artificial Sequence
  Oligomer
uuggcagcaaggcucacaaac

SEQ ID NO: 74429 - RNA, 21 nt, Artificial Sequence
  Oligomer
uguaaagcaggauucuagaca

SEQ ID NO: 74430 - RNA, 21 nt, Artificial Sequence
  Oligomer
ugugccaggagcauaaccuuc

SEQ ID NO: 74431 - RNA, 21 nt, Artificial Sequence
  Oligomer
uaggcagcaaguugaggaguu

SEQ ID NO: 74432 - RNA, 21 nt, Artificial Sequence
  Oligomer
ucuaacaauucgcucaacaac

SEQ ID NO: 74433 - RNA, 21 nt, Artificial Sequence
  Oligomer
uugaagagggugacuagagua

SEQ ID NO: 74434 - RNA, 21 nt, Artificial Sequence
  Oligomer
uccuucuccagaagauguucu

SEQ ID NO: 74435 - RNA, 21 nt, Artificial Sequence
  Oligomer
caguauucagacaucuccuug

SEQ ID NO: 74436 - RNA, 21 nt, Artificial Sequence
  Oligomer
uggaugagcucccucauuucc

SEQ ID NO: 74437 - RNA, 21 nt, Artificial Sequence
  Oligomer
agggagagagauggacguuuc

SEQ ID NO: 74438 - RNA, 21 nt, Artificial Sequence
  Oligomer
ucccauccacaccauagaugg

SEQ ID NO: 74439 - RNA, 21 nt, Artificial Sequence
  Oligomer
uccugaugaugaggaugcaug

SEQ ID NO: 74440 - RNA, 21 nt, Artificial Sequence
  Oligomer
uccuugauaagugcguucacc

SEQ ID NO: 74441 - RNA, 21 nt, Artificial Sequence
  Oligomer
aagagcugaaaaaccucuugg

SEQ ID NO: 74442 - RNA, 21 nt, Artificial Sequence
  Oligomer
auaggagauggucucucagac

SEQ ID NO: 74443 - RNA, 21 nt, Artificial Sequence
  Oligomer
uugggcaguuggcguugucaa

SEQ ID NO: 74444 - RNA, 21 nt, Artificial Sequence
  Oligomer
auccguguauauugucaaaag

SEQ ID NO: 74445 - RNA, 21 nt, Artificial Sequence
  Oligomer
uuuaaacaaccaaauccuggc

SEQ ID NO: 74446 - RNA, 21 nt, Artificial Sequence
  Oligomer
cuaacaauucgcucaacaaca

SEQ ID NO: 74447 - RNA, 21 nt, Artificial Sequence
  Oligomer
ucugugccaggagcauaaccu

SEQ ID NO: 74448 - RNA, 21 nt, Artificial Sequence
  Oligomer
ugaaacauuccuggcaauagg

SEQ ID NO: 74449 - RNA, 21 nt, Artificial Sequence
  Oligomer
acccgauggcaauacaaaauc

SEQ ID NO: 74450 - RNA, 21 nt, Artificial Sequence
  Oligomer
aaugaaggcccacuaugugcc

SEQ ID NO: 74451 - RNA, 21 nt, Artificial Sequence
  Oligomer
uccugcgugguucuuuccauc

SEQ ID NO: 74452 - RNA, 21 nt, Artificial Sequence
  Oligomer
aucuucggcaacuuuucuuua

SEQ ID NO: 74453 - RNA, 21 nt, Artificial Sequence
  Oligomer
acuugagcaagagccucgaug

SEQ ID NO: 74454 - RNA, 21 nt, Artificial Sequence
  Oligomer
uggacgucauagcccaaaagc

SEQ ID NO: 74455 - RNA, 21 nt, Artificial Sequence
  Oligomer
cuucacuugucaggcucuuca

SEQ ID NO: 74456 - RNA, 21 nt, Artificial Sequence
  Oligomer
uauucagacaucuccuugcac

SEQ ID NO: 74457 - RNA, 21 nt, Artificial Sequence
  Oligomer
ucagagaaacaaccaacgaaa

SEQ ID NO: 74458 - RNA, 21 nt, Artificial Sequence
  Oligomer
ucucucaaauacuuccauacu

SEQ ID NO: 74459 - RNA, 21 nt, Artificial Sequence
  Oligomer
uucuuccuggccuucucugau

SEQ ID NO: 74460 - RNA, 21 nt, Artificial Sequence
  Oligomer
agauggacguuucucaggaag

SEQ ID NO: 74461 - RNA, 21 nt, Artificial Sequence
  Oligomer
auguccuucuccagaagaugu

SEQ ID NO: 74462 - RNA, 21 nt, Artificial Sequence
  Oligomer
ucaaagagcugaaaaaccucu

SEQ ID NO: 74463 - RNA, 21 nt, Artificial Sequence
  Oligomer
ucuaucacaccuccugugguc

SEQ ID NO: 74464 - RNA, 21 nt, Artificial Sequence
  Oligomer
ugcagguugauugaaugaaag

SEQ ID NO: 74465 - RNA, 21 nt, Artificial Sequence
  Oligomer
ucucauaaaccaaggugaaga

SEQ ID NO: 74466 - RNA, 21 nt, Artificial Sequence
  Oligomer
auuugguggcagcagccaaca

SEQ ID NO: 74467 - RNA, 21 nt, Artificial Sequence
  Oligomer
aagggagagagauggacguuu

SEQ ID NO: 74468 - RNA, 21 nt, Artificial Sequence
  Oligomer
uccuguaaagcaggauucuag

SEQ ID NO: 74469 - RNA, 21 nt, Artificial Sequence
  Oligomer
ugccagcuggaaguguguuug

SEQ ID NO: 74470 - RNA, 21 nt, Artificial Sequence
  Oligomer
ugcaaccuauaugccagcugg

SEQ ID NO: 74471 - RNA, 21 nt, Artificial Sequence
  Oligomer
ucgcucaacaacagcuguuug

SEQ ID NO: 74472 - RNA, 21 nt, Artificial Sequence
  Oligomer
uuugcuagggaccaugggaga

SEQ ID NO: 74473 - RNA, 21 nt, Artificial Sequence
  Oligomer
uuucucuccagugaagugcac

SEQ ID NO: 74474 - RNA, 21 nt, Artificial Sequence
  Oligomer
uugaaugaaagugggaauagu

SEQ ID NO: 74475 - RNA, 21 nt, Artificial Sequence
  Oligomer
ucacaagcccgcucagaaaac

SEQ ID NO: 74476 - RNA, 21 nt, Artificial Sequence
  Oligomer
uguucuaacaauucgcucaac

SEQ ID NO: 74477 - RNA, 21 nt, Artificial Sequence
  Oligomer
uugcuucuucagagccaaaag

SEQ ID NO: 74478 - RNA, 21 nt, Artificial Sequence
  Oligomer
augagcucccucauuuccaag

SEQ ID NO: 74479 - RNA, 21 nt, Artificial Sequence
  Oligomer
uaacauguauggcacugaaau

SEQ ID NO: 74480 - RNA, 21 nt, Artificial Sequence
  Oligomer
cacauaauaucaaaggagagu

SEQ ID NO: 74481 - RNA, 21 nt, Artificial Sequence
  Oligomer
ugggaauaguaagggagagag

SEQ ID NO: 74482 - RNA, 21 nt, Artificial Sequence
  Oligomer
cuuccaaacucucacucuagg

SEQ ID NO: 74483 - RNA, 21 nt, Artificial Sequence
  Oligomer
ucauguuugcuucuucagagc

SEQ ID NO: 74484 - RNA, 21 nt, Artificial Sequence
  Oligomer
ugagacuuccaugggcaaaga

SEQ ID NO: 74485 - RNA, 21 nt, Artificial Sequence
  Oligomer
uucuucagagccaaaagauaa

SEQ ID NO: 74486 - RNA, 21 nt, Artificial Sequence
  Oligomer
ucacagaaaaggagcuggccu

SEQ ID NO: 74487 - RNA, 21 nt, Artificial Sequence
  Oligomer
ugcauuuccugugcagucugg

SEQ ID NO: 74488 - RNA, 21 nt, Artificial Sequence
  Oligomer
cagagucuagggaaacacacc

SEQ ID NO: 74489 - RNA, 21 nt, Artificial Sequence
  Oligomer
uggauaaaagcaaaacacaug

SEQ ID NO: 74490 - RNA, 21 nt, Artificial Sequence
  Oligomer
uuuguucuguaggcuugggca

SEQ ID NO: 74491 - RNA, 21 nt, Artificial Sequence
  Oligomer
gucaagacuugaggaagaagg

SEQ ID NO: 74492 - RNA, 21 nt, Artificial Sequence
  Oligomer
ugaagugcagguugauugaau

SEQ ID NO: 74493 - RNA, 21 nt, Artificial Sequence
  Oligomer
uauaugccagcuggaagugug

SEQ ID NO: 74494 - RNA, 21 nt, Artificial Sequence
  Oligomer
ucuucccucuuuuauucaaca

SEQ ID NO: 74495 - RNA, 21 nt, Artificial Sequence
  Oligomer
aaccaguucucauaaaccaag

SEQ ID NO: 74496 - RNA, 21 nt, Artificial Sequence
  Oligomer
uuuggacaccuuccaaacucu

SEQ ID NO: 74497 - RNA, 21 nt, Artificial Sequence
  Oligomer
aaugcaaggcaauguuggcug

SEQ ID NO: 74498 - RNA, 21 nt, Artificial Sequence
  Oligomer
ucuccagaagauguucuaaca

SEQ ID NO: 74499 - RNA, 21 nt, Artificial Sequence
  Oligomer
uccacauucuggcugaaacug

SEQ ID NO: 74500 - RNA, 21 nt, Artificial Sequence
  Oligomer
agagauggacguuucucagga

SEQ ID NO: 74501 - RNA, 21 nt, Artificial Sequence
  Oligomer
agaucaaaggcucuaucacac

SEQ ID NO: 74502 - RNA, 21 nt, Artificial Sequence
  Oligomer
auacaaaauccuggcaguggg

SEQ ID NO: 74503 - RNA, 21 nt, Artificial Sequence
  Oligomer
uaccaggaaccucguuuggug

SEQ ID NO: 74504 - RNA, 21 nt, Artificial Sequence
  Oligomer
ucaggaaggaaaaagacagag

SEQ ID NO: 74505 - RNA, 21 nt, Artificial Sequence
  Oligomer
gucauguuugcuucuucagag

SEQ ID NO: 74506 - RNA, 21 nt, Artificial Sequence
  Oligomer
auuguagcuaagguuggcuug

SEQ ID NO: 74507 - RNA, 21 nt, Artificial Sequence
  Oligomer
ugggaguggaaagguucucuc

SEQ ID NO: 74508 - RNA, 21 nt, Artificial Sequence
  Oligomer
aaugaaagugggaauaguaag

SEQ ID NO: 74509 - RNA, 21 nt, Artificial Sequence
  Oligomer
ucuuggagcuggagcaguuuc

SEQ ID NO: 74510 - RNA, 21 nt, Artificial Sequence
  Oligomer
acaagguuucugcccucauuu

SEQ ID NO: 74511 - RNA, 21 nt, Artificial Sequence
  Oligomer
acaucuuugagcauuuacaug

SEQ ID NO: 74512 - RNA, 21 nt, Artificial Sequence
  Oligomer
ucuuaaagaacagggaaguug

SEQ ID NO: 74513 - RNA, 21 nt, Artificial Sequence
  Oligomer
ugauccuguaaagcaggauuc

SEQ ID NO: 74514 - RNA, 21 nt, Artificial Sequence
  Oligomer
ucugcaguuucucuugcauuu

SEQ ID NO: 74515 - RNA, 21 nt, Artificial Sequence
  Oligomer
uugagacuuccaugggcaaag

SEQ ID NO: 74516 - RNA, 21 nt, Artificial Sequence
  Oligomer
uggcugaaacugcccacuuug

SEQ ID NO: 74517 - RNA, 21 nt, Artificial Sequence
  Oligomer
acuacuacaggccuagcauuu

SEQ ID NO: 74518 - RNA, 21 nt, Artificial Sequence
  Oligomer
cuuagcaagaaaucaccauuu

SEQ ID NO: 74519 - RNA, 21 nt, Artificial Sequence
  Oligomer
cuucccgauccuugauaagug

SEQ ID NO: 74520 - RNA, 21 nt, Artificial Sequence
  Oligomer
ugaaaugaagguaaagaaggg

SEQ ID NO: 74521 - RNA, 21 nt, Artificial Sequence
  Oligomer
agcaaaacacauggaaaaaca

SEQ ID NO: 74522 - RNA, 21 nt, Artificial Sequence
  Oligomer
acaagauguggugacagacac

SEQ ID NO: 74523 - RNA, 21 nt, Artificial Sequence
  Oligomer
cucaucuucggcaacuuuucu

SEQ ID NO: 74524 - RNA, 21 nt, Artificial Sequence
  Oligomer
caugauaugucuucaaggagc

SEQ ID NO: 74525 - RNA, 21 nt, Artificial Sequence
  Oligomer
uugggaaguuucagauaagca

SEQ ID NO: 74526 - RNA, 21 nt, Artificial Sequence
  Oligomer
auaucaugucugagcgcgugg

SEQ ID NO: 74527 - RNA, 21 nt, Artificial Sequence
  Oligomer
accauuuaaugagguucaagg

SEQ ID NO: 74528 - RNA, 21 nt, Artificial Sequence
  Oligomer
aucuccuugcaccgguggaau

SEQ ID NO: 74529 - RNA, 21 nt, Artificial Sequence
  Oligomer
ucggccacgugcauaucacaa

SEQ ID NO: 74530 - RNA, 21 nt, Artificial Sequence
  Oligomer
aaaagcuggaacugaacacaa

SEQ ID NO: 74531 - RNA, 21 nt, Artificial Sequence
  Oligomer
aggcucauuucaguaacaaag

SEQ ID NO: 74532 - RNA, 21 nt, Artificial Sequence
  Oligomer
gugguuacagagucuagggaa

SEQ ID NO: 74533 - RNA, 21 nt, Artificial Sequence
  Oligomer
uccaaggugaugauguccuuc

SEQ ID NO: 74534 - RNA, 21 nt, Artificial Sequence
  Oligomer
ucacaaaccacccaaacaaau

SEQ ID NO: 74535 - RNA, 21 nt, Artificial Sequence
  Oligomer
uuguagcuaagguuggcuugc

SEQ ID NO: 74536 - RNA, 21 nt, Artificial Sequence
  Oligomer
ugaggaagaaggacaccaccu

SEQ ID NO: 74537 - RNA, 21 nt, Artificial Sequence
  Oligomer
ucgauguaccaggaaccucgu

SEQ ID NO: 74538 - RNA, 21 nt, Artificial Sequence
  Oligomer
aaaaagacagagaggugguua

SEQ ID NO: 74539 - RNA, 21 nt, Artificial Sequence
  Oligomer
ugucaaagagcugaaaaaccu

SEQ ID NO: 74540 - RNA, 21 nt, Artificial Sequence
  Oligomer
ucuagauaugaagugcagguu

SEQ ID NO: 74541 - RNA, 21 nt, Artificial Sequence
  Oligomer
acaauaacauguauggcacug

SEQ ID NO: 74542 - RNA, 21 nt, Artificial Sequence
  Oligomer
auuaaauuuggacaccuucca

SEQ ID NO: 74543 - RNA, 21 nt, Artificial Sequence
  Oligomer
ugaagaucaaaggcucuauca

SEQ ID NO: 74544 - RNA, 21 nt, Artificial Sequence
  Oligomer
acuguguuuacaacuucacuu

SEQ ID NO: 74545 - RNA, 21 nt, Artificial Sequence
  Oligomer
cauagaacauggacgucauag

SEQ ID NO: 74546 - RNA, 21 nt, Artificial Sequence
  Oligomer
cauuuauuuggcacccgaugg

SEQ ID NO: 74547 - RNA, 21 nt, Artificial Sequence
  Oligomer
cuuuucuuuaccggcaucacu

SEQ ID NO: 74548 - RNA, 21 nt, Artificial Sequence
  Oligomer
gcgaaauuccaguucuuucuc

SEQ ID NO: 74549 - RNA, 21 nt, Artificial Sequence
  Oligomer
uucuggacacugcagcaaggu

SEQ ID NO: 74550 - RNA, 21 nt, Artificial Sequence
  Oligomer
uucaaggagcuaaaaaugcca

SEQ ID NO: 74551 - RNA, 21 nt, Artificial Sequence
  Oligomer
ccucuuaggcagcaaguugag

SEQ ID NO: 74552 - RNA, 21 nt, Artificial Sequence
  Oligomer
cuggcaauagguccaaccaag

SEQ ID NO: 74553 - RNA, 21 nt, Artificial Sequence
  Oligomer
uuggcguugucaaagagcuga

SEQ ID NO: 74554 - RNA, 21 nt, Artificial Sequence
  Oligomer
uggaggaagaaagaauggaag

SEQ ID NO: 74555 - RNA, 21 nt, Artificial Sequence
  Oligomer
aaaaccucuuggagcuggagc

SEQ ID NO: 74556 - RNA, 21 nt, Artificial Sequence
  Oligomer
aucacaagcccgcucagaaaa

SEQ ID NO: 74557 - RNA, 21 nt, Artificial Sequence
  Oligomer
acgucauagcccaaaagcuug

SEQ ID NO: 74558 - RNA, 21 nt, Artificial Sequence
  Oligomer
uucgcucaacaacagcuguuu

SEQ ID NO: 74559 - RNA, 21 nt, Artificial Sequence
  Oligomer
uuauuuggcacccgauggcaa

SEQ ID NO: 74560 - RNA, 21 nt, Artificial Sequence
  Oligomer
ugaugaugaggaugcaugcca

SEQ ID NO: 74561 - RNA, 21 nt, Artificial Sequence
  Oligomer
agaagcugagaggagaccacu

SEQ ID NO: 74562 - RNA, 21 nt, Artificial Sequence
  Oligomer
uguuaugugagaacagacugg

SEQ ID NO: 74563 - RNA, 21 nt, Artificial Sequence
  Oligomer
ugaagagggugacuagaguac

SEQ ID NO: 74564 - RNA, 21 nt, Artificial Sequence
  Oligomer
uaguaagggagagagauggac

SEQ ID NO: 74565 - RNA, 21 nt, Artificial Sequence
  Oligomer
auguggugacagacacagaag

SEQ ID NO: 74566 - RNA, 21 nt, Artificial Sequence
  Oligomer
cauucuuccuggccuucucug

SEQ ID NO: 74567 - RNA, 21 nt, Artificial Sequence
  Oligomer
cuguguuuacaacuucacuug

SEQ ID NO: 74568 - RNA, 21 nt, Artificial Sequence
  Oligomer
ucaguaacaaagcucagagaa

SEQ ID NO: 74569 - RNA, 21 nt, Artificial Sequence
  Oligomer
aagaucaaaggcucuaucaca

SEQ ID NO: 74570 - RNA, 21 nt, Artificial Sequence
  Oligomer
uaugccagcuggaaguguguu

SEQ ID NO: 74571 - RNA, 21 nt, Artificial Sequence
  Oligomer
uggagcaguuucccauccaca

SEQ ID NO: 74572 - RNA, 21 nt, Artificial Sequence
  Oligomer
ucuguuaugugagaacagacu

SEQ ID NO: 74573 - RNA, 21 nt, Artificial Sequence
  Oligomer
acauuuaaugaaggcccacua

SEQ ID NO: 74574 - RNA, 21 nt, Artificial Sequence
  Oligomer
aagacuugaggaagaaggaca

SEQ ID NO: 74575 - RNA, 21 nt, Artificial Sequence
  Oligomer
augaugggcacaggaaacaag

SEQ ID NO: 74576 - RNA, 21 nt, Artificial Sequence
  Oligomer
uuaucucacacaugauauguc

SEQ ID NO: 74577 - RNA, 21 nt, Artificial Sequence
  Oligomer
uugucaggcucuucaacugca

SEQ ID NO: 74578 - RNA, 21 nt, Artificial Sequence
  Oligomer
ugccuucuucccucuuuuauu

SEQ ID NO: 74579 - RNA, 23 nt, Artificial Sequence
  Oligomer
gaauuuuaucaaacacacuucca

SEQ ID NO: 74580 - RNA, 23 nt, Artificial Sequence
  Oligomer
cuuugacaacgccaacugcccaa

SEQ ID NO: 74581 - RNA, 23 nt, Artificial Sequence
  Oligomer
caaagugggcaguuucagccaga

SEQ ID NO: 74582 - RNA, 23 nt, Artificial Sequence
  Oligomer
ggaaaugcaagagaaacugcaga

SEQ ID NO: 74583 - RNA, 23 nt, Artificial Sequence
  Oligomer
cauguuauuguuuucaaccuaga

SEQ ID NO: 74584 - RNA, 23 nt, Artificial Sequence
  Oligomer
gauagagccuuugaucuucagga

SEQ ID NO: 74585 - RNA, 23 nt, Artificial Sequence
  Oligomer
ucuuuuggcucugaagaagcaaa

SEQ ID NO: 74586 - RNA, 23 nt, Artificial Sequence
  Oligomer
cugugaagcccuuugccuguaga

SEQ ID NO: 74587 - RNA, 23 nt, Artificial Sequence
  Oligomer
cuaugugaccagacugcacagga

SEQ ID NO: 74588 - RNA, 23 nt, Artificial Sequence
  Oligomer
uuguuagaacaucuucuggagaa

SEQ ID NO: 74589 - RNA, 23 nt, Artificial Sequence
  Oligomer
ucuugguccaccuuccagcacaa

SEQ ID NO: 74590 - RNA, 23 nt, Artificial Sequence
  Oligomer
uuguauugccaucgggugccaaa

SEQ ID NO: 74591 - RNA, 23 nt, Artificial Sequence
  Oligomer
cauuuguaccuuauugaucuuug

SEQ ID NO: 74592 - RNA, 23 nt, Artificial Sequence
  Oligomer
agaauuccaccggugcaaggaga

SEQ ID NO: 74593 - RNA, 23 nt, Artificial Sequence
  Oligomer
guguuuucugagcgggcuuguga

SEQ ID NO: 74594 - RNA, 23 nt, Artificial Sequence
  Oligomer
guauugccaucgggugccaaaua

SEQ ID NO: 74595 - RNA, 23 nt, Artificial Sequence
  Oligomer
uauugggaguguguggcaugcau

SEQ ID NO: 74596 - RNA, 23 nt, Artificial Sequence
  Oligomer
uaugcggcuaugccugccucaaa

SEQ ID NO: 74597 - RNA, 23 nt, Artificial Sequence
  Oligomer
cugaauuuuaucaaacacacuuc

SEQ ID NO: 74598 - RNA, 23 nt, Artificial Sequence
  Oligomer
gauaacuuccuucacaucuccca

SEQ ID NO: 74599 - RNA, 23 nt, Artificial Sequence
  Oligomer
caggaaaugcaagagaaacugca

SEQ ID NO: 74600 - RNA, 23 nt, Artificial Sequence
  Oligomer
ucagcugcaguugaagagccuga

SEQ ID NO: 74601 - RNA, 23 nt, Artificial Sequence
  Oligomer
gaccuauugccaggaauguuuca

SEQ ID NO: 74602 - RNA, 23 nt, Artificial Sequence
  Oligomer
gaauuguuagaacaucuucugga

SEQ ID NO: 74603 - RNA, 23 nt, Artificial Sequence
  Oligomer
gcucuugcucaaguguuuucuga

SEQ ID NO: 74604 - RNA, 23 nt, Artificial Sequence
  Oligomer
agaaccgaguggugcuagccaaa

SEQ ID NO: 74605 - RNA, 23 nt, Artificial Sequence
  Oligomer
uugguuggaccuauugccaggaa

SEQ ID NO: 74606 - RNA, 23 nt, Artificial Sequence
  Oligomer
aaagaaccgaguggugcuagcca

SEQ ID NO: 74607 - RNA, 23 nt, Artificial Sequence
  Oligomer
cuuucauucaaucaaccugcacu

SEQ ID NO: 74608 - RNA, 23 nt, Artificial Sequence
  Oligomer
caucucugccuuugaguguggga

SEQ ID NO: 74609 - RNA, 23 nt, Artificial Sequence
  Oligomer
aguauuugagagagagaaccuuu

SEQ ID NO: 74610 - RNA, 23 nt, Artificial Sequence
  Oligomer
uguuuucaaccuagaaaccuuua

SEQ ID NO: 74611 - RNA, 23 nt, Artificial Sequence
  Oligomer
cuuguuuguuuuauucaccauca

SEQ ID NO: 74612 - RNA, 23 nt, Artificial Sequence
  Oligomer
cacuuucauucaaucaaccugca

SEQ ID NO: 74613 - RNA, 23 nt, Artificial Sequence
  Oligomer
caauaaauauuuguuuggguggu

SEQ ID NO: 74614 - RNA, 23 nt, Artificial Sequence
  Oligomer
acauguuauuguuuucaaccuag

SEQ ID NO: 74615 - RNA, 23 nt, Artificial Sequence
  Oligomer
ccaagagguuuuucagcucuuug

SEQ ID NO: 74616 - RNA, 23 nt, Artificial Sequence
  Oligomer
acacuuccagcuggcauauaggu

SEQ ID NO: 74617 - RNA, 23 nt, Artificial Sequence
  Oligomer
guuuguuuuauucaccaucaugu

SEQ ID NO: 74618 - RNA, 23 nt, Artificial Sequence
  Oligomer
aguggugcuagccaaacagcugu

SEQ ID NO: 74619 - RNA, 23 nt, Artificial Sequence
  Oligomer
gacauaucaugugugagauaacu

SEQ ID NO: 74620 - RNA, 23 nt, Artificial Sequence
  Oligomer
ccuuuugacaauauacacggauu

SEQ ID NO: 74621 - RNA, 23 nt, Artificial Sequence
  Oligomer
gaucuuucguugguuguuucucu

SEQ ID NO: 74622 - RNA, 23 nt, Artificial Sequence
  Oligomer
agcuuuugggcuaugacguccau

SEQ ID NO: 74623 - RNA, 23 nt, Artificial Sequence
  Oligomer
cuuuugggcuaugacguccaugu

SEQ ID NO: 74624 - RNA, 23 nt, Artificial Sequence
  Oligomer
guucuaugugaccagacugcaca

SEQ ID NO: 74625 - RNA, 23 nt, Artificial Sequence
  Oligomer
cuuguuuccugugcccaucaucu

SEQ ID NO: 74626 - RNA, 23 nt, Artificial Sequence
  Oligomer
gagagaaccuuuccacucccacu

SEQ ID NO: 74627 - RNA, 23 nt, Artificial Sequence
  Oligomer
cucuguaaccaccucucugucuu

SEQ ID NO: 74628 - RNA, 23 nt, Artificial Sequence
  Oligomer
uuagaacaucuucuggagaagga

SEQ ID NO: 74629 - RNA, 23 nt, Artificial Sequence
  Oligomer
aagaaccgaguggugcuagccaa

SEQ ID NO: 74630 - RNA, 23 nt, Artificial Sequence
  Oligomer
ccauauuuguguucaguuccagc

SEQ ID NO: 74631 - RNA, 23 nt, Artificial Sequence
  Oligomer
ugaauuuuaucaaacacacuucc

SEQ ID NO: 74632 - RNA, 23 nt, Artificial Sequence
  Oligomer
cauauuuguguucaguuccagcu

SEQ ID NO: 74633 - RNA, 23 nt, Artificial Sequence
  Oligomer
caccuuggaaaugagggagcuca

SEQ ID NO: 74634 - RNA, 23 nt, Artificial Sequence
  Oligomer
gaauuccaccggugcaaggagau

SEQ ID NO: 74635 - RNA, 23 nt, Artificial Sequence
  Oligomer
cuguaaccaccucucugucuuuu

SEQ ID NO: 74636 - RNA, 23 nt, Artificial Sequence
  Oligomer
cuacuucugugucugucaccaca

SEQ ID NO: 74637 - RNA, 23 nt, Artificial Sequence
  Oligomer
ucuagucacccucuucaagcuuu

SEQ ID NO: 74638 - RNA, 23 nt, Artificial Sequence
  Oligomer
ugugauagagccuuugaucuuca

SEQ ID NO: 74639 - RNA, 23 nt, Artificial Sequence
  Oligomer
cccucauuuaaaauguaaacucu

SEQ ID NO: 74640 - RNA, 23 nt, Artificial Sequence
  Oligomer
aucuuugcccauggaagucucaa

SEQ ID NO: 74641 - RNA, 23 nt, Artificial Sequence
  Oligomer
aauuuuaucaaacacacuuccag

SEQ ID NO: 74642 - RNA, 23 nt, Artificial Sequence
  Oligomer
agaaacguccaucucucucccuu

SEQ ID NO: 74643 - RNA, 23 nt, Artificial Sequence
  Oligomer
acaccuggccaggauuugguugu

SEQ ID NO: 74644 - RNA, 23 nt, Artificial Sequence
  Oligomer
auaugcggcuaugccugccucaa

SEQ ID NO: 74645 - RNA, 23 nt, Artificial Sequence
  Oligomer
ucauuaaauggugauuucuugcu

SEQ ID NO: 74646 - RNA, 23 nt, Artificial Sequence
  Oligomer
ccagcuggcauauagguugcagu

SEQ ID NO: 74647 - RNA, 23 nt, Artificial Sequence
  Oligomer
uguauugccaucgggugccaaau

SEQ ID NO: 74648 - RNA, 23 nt, Artificial Sequence
  Oligomer
cauauagguugcagucucggccu

SEQ ID NO: 74649 - RNA, 23 nt, Artificial Sequence
  Oligomer
acucuuggcucguuugggcucaa

SEQ ID NO: 74650 - RNA, 23 nt, Artificial Sequence
  Oligomer
uguuuugcuuuuauccacuggca

SEQ ID NO: 74651 - RNA, 23 nt, Artificial Sequence
  Oligomer
cugucagccaacauugccuugca

SEQ ID NO: 74652 - RNA, 23 nt, Artificial Sequence
  Oligomer
ccaaaucugucuagaauccugcu

SEQ ID NO: 74653 - RNA, 23 nt, Artificial Sequence
  Oligomer
ucaaacacacuuccagcuggcau

SEQ ID NO: 74654 - RNA, 23 nt, Artificial Sequence
  Oligomer
ccaccucucugucuuuuuccuuc

SEQ ID NO: 74655 - RNA, 23 nt, Artificial Sequence
  Oligomer
caacugcccaagccuacagaaca

SEQ ID NO: 74656 - RNA, 23 nt, Artificial Sequence
  Oligomer
cuccaagagguuuuucagcucuu

SEQ ID NO: 74657 - RNA, 23 nt, Artificial Sequence
  Oligomer
gucugaauacugcagcacucugu

SEQ ID NO: 74658 - RNA, 23 nt, Artificial Sequence
  Oligomer
agacucuguaaccaccucucugu

SEQ ID NO: 74659 - RNA, 23 nt, Artificial Sequence
  Oligomer
ucauucaaucaaccugcacuuca

SEQ ID NO: 74660 - RNA, 23 nt, Artificial Sequence
  Oligomer
gguuuaugagaacugguucuugc

SEQ ID NO: 74661 - RNA, 23 nt, Artificial Sequence
  Oligomer
cuagucacccucuucaagcuuuu

SEQ ID NO: 74662 - RNA, 23 nt, Artificial Sequence
  Oligomer
ucuuugacaacgccaacugccca

SEQ ID NO: 74663 - RNA, 23 nt, Artificial Sequence
  Oligomer
uuucauucauauccuccgcccuu

SEQ ID NO: 74664 - RNA, 23 nt, Artificial Sequence
  Oligomer
gcucaauaaauauuuguuugggu

SEQ ID NO: 74665 - RNA, 23 nt, Artificial Sequence
  Oligomer
auuuuaucaaacacacuuccagc

SEQ ID NO: 74666 - RNA, 23 nt, Artificial Sequence
  Oligomer
cuaccuuuugauaaaauguuccu

SEQ ID NO: 74667 - RNA, 23 nt, Artificial Sequence
  Oligomer
aaguguuuucugagcgggcuugu

SEQ ID NO: 74668 - RNA, 23 nt, Artificial Sequence
  Oligomer
cuuuaccuucauuucauccuguu

SEQ ID NO: 74669 - RNA, 23 nt, Artificial Sequence
  Oligomer
cagucuguucucacauaacagag

SEQ ID NO: 74670 - RNA, 23 nt, Artificial Sequence
  Oligomer
cacuuccagcuggcauauagguu

SEQ ID NO: 74671 - RNA, 23 nt, Artificial Sequence
  Oligomer
cuugguuggaccuauugccagga

SEQ ID NO: 74672 - RNA, 23 nt, Artificial Sequence
  Oligomer
acauaucaugugugagauaacuu

SEQ ID NO: 74673 - RNA, 23 nt, Artificial Sequence
  Oligomer
aaguccugccuuugggucgacau

SEQ ID NO: 74674 - RNA, 23 nt, Artificial Sequence
  Oligomer
augugggaaucucccagacuugu

SEQ ID NO: 74675 - RNA, 23 nt, Artificial Sequence
  Oligomer
agauguaauguaguucuuuguuc

SEQ ID NO: 74676 - RNA, 23 nt, Artificial Sequence
  Oligomer
gagaaggccaggaagaauggugu

SEQ ID NO: 74677 - RNA, 23 nt, Artificial Sequence
  Oligomer
cuaaaaaagaaccgaguggugcu

SEQ ID NO: 74678 - RNA, 23 nt, Artificial Sequence
  Oligomer
auguaauguaguucuuuguuccu

SEQ ID NO: 74679 - RNA, 23 nt, Artificial Sequence
  Oligomer
aucucucucccuuacuauuccca

SEQ ID NO: 74680 - RNA, 23 nt, Artificial Sequence
  Oligomer
uuguuuucaaccuagaaaccuuu

SEQ ID NO: 74681 - RNA, 23 nt, Artificial Sequence
  Oligomer
gugauagagccuuugaucuucag

SEQ ID NO: 74682 - RNA, 23 nt, Artificial Sequence
  Oligomer
uaugcuccuggcacagaauucca

SEQ ID NO: 74683 - RNA, 23 nt, Artificial Sequence
  Oligomer
agaugucugagagaccaucuccu

SEQ ID NO: 74684 - RNA, 23 nt, Artificial Sequence
  Oligomer
uaaaaaagaaccgaguggugcua

SEQ ID NO: 74685 - RNA, 23 nt, Artificial Sequence
  Oligomer
agucucaaagaucuuucguuggu

SEQ ID NO: 74686 - RNA, 23 nt, Artificial Sequence
  Oligomer
uuucauucaaucaaccugcacuu

SEQ ID NO: 74687 - RNA, 23 nt, Artificial Sequence
  Oligomer
acuucugugucugucaccacauc

SEQ ID NO: 74688 - RNA, 23 nt, Artificial Sequence
  Oligomer
agucuguucucacauaacagagu

SEQ ID NO: 74689 - RNA, 23 nt, Artificial Sequence
  Oligomer
aucuuuuggcucugaagaagcaa

SEQ ID NO: 74690 - RNA, 23 nt, Artificial Sequence
  Oligomer
gccaaacagcuguuguugagcga

SEQ ID NO: 74691 - RNA, 23 nt, Artificial Sequence
  Oligomer
uccacucccacugccaggauuuu

SEQ ID NO: 74692 - RNA, 23 nt, Artificial Sequence
  Oligomer
uuuguagauggcacuuuagugau

SEQ ID NO: 74693 - RNA, 23 nt, Artificial Sequence
  Oligomer
aauuguuagaacaucuucuggag

SEQ ID NO: 74694 - RNA, 23 nt, Artificial Sequence
  Oligomer
uggaaguguguuugauaaaauuc

SEQ ID NO: 74695 - RNA, 23 nt, Artificial Sequence
  Oligomer
uugggcaguuggcguugucaaag

SEQ ID NO: 74696 - RNA, 23 nt, Artificial Sequence
  Oligomer
ucuggcugaaacugcccacuuug

SEQ ID NO: 74697 - RNA, 23 nt, Artificial Sequence
  Oligomer
ucugcaguuucucuugcauuucc

SEQ ID NO: 74698 - RNA, 23 nt, Artificial Sequence
  Oligomer
ucuagguugaaaacaauaacaug

SEQ ID NO: 74699 - RNA, 23 nt, Artificial Sequence
  Oligomer
uccugaagaucaaaggcucuauc

SEQ ID NO: 74700 - RNA, 23 nt, Artificial Sequence
  Oligomer
uuugcuucuucagagccaaaaga

SEQ ID NO: 74701 - RNA, 23 nt, Artificial Sequence
  Oligomer
ucuacaggcaaagggcuucacag

SEQ ID NO: 74702 - RNA, 23 nt, Artificial Sequence
  Oligomer
uccugugcagucuggucacauag

SEQ ID NO: 74703 - RNA, 23 nt, Artificial Sequence
  Oligomer
uucuccagaagauguucuaacaa

SEQ ID NO: 74704 - RNA, 23 nt, Artificial Sequence
  Oligomer
uugugcuggaagguggaccaaga

SEQ ID NO: 74705 - RNA, 23 nt, Artificial Sequence
  Oligomer
uuuggcacccgauggcaauacaa

SEQ ID NO: 74706 - RNA, 23 nt, Artificial Sequence
  Oligomer
caaagaucaauaagguacaaaug

SEQ ID NO: 74707 - RNA, 23 nt, Artificial Sequence
  Oligomer
ucuccuugcaccgguggaauucu

SEQ ID NO: 74708 - RNA, 23 nt, Artificial Sequence
  Oligomer
ucacaagcccgcucagaaaacac

SEQ ID NO: 74709 - RNA, 23 nt, Artificial Sequence
  Oligomer
uauuuggcacccgauggcaauac

SEQ ID NO: 74710 - RNA, 23 nt, Artificial Sequence
  Oligomer
augcaugccacacacucccaaua

SEQ ID NO: 74711 - RNA, 23 nt, Artificial Sequence
  Oligomer
uuugaggcaggcauagccgcaua

SEQ ID NO: 74712 - RNA, 23 nt, Artificial Sequence
  Oligomer
gaaguguguuugauaaaauucag

SEQ ID NO: 74713 - RNA, 23 nt, Artificial Sequence
  Oligomer
ugggagaugugaaggaaguuauc

SEQ ID NO: 74714 - RNA, 23 nt, Artificial Sequence
  Oligomer
ugcaguuucucuugcauuuccug

SEQ ID NO: 74715 - RNA, 23 nt, Artificial Sequence
  Oligomer
ucaggcucuucaacugcagcuga

SEQ ID NO: 74716 - RNA, 23 nt, Artificial Sequence
  Oligomer
ugaaacauuccuggcaauagguc

SEQ ID NO: 74717 - RNA, 23 nt, Artificial Sequence
  Oligomer
uccagaagauguucuaacaauuc

SEQ ID NO: 74718 - RNA, 23 nt, Artificial Sequence
  Oligomer
ucagaaaacacuugagcaagagc

SEQ ID NO: 74719 - RNA, 23 nt, Artificial Sequence
  Oligomer
uuuggcuagcaccacucgguucu

SEQ ID NO: 74720 - RNA, 23 nt, Artificial Sequence
  Oligomer
uuccuggcaauagguccaaccaa

SEQ ID NO: 74721 - RNA, 23 nt, Artificial Sequence
  Oligomer
uggcuagcaccacucgguucuuu

SEQ ID NO: 74722 - RNA, 23 nt, Artificial Sequence
  Oligomer
agugcagguugauugaaugaaag

SEQ ID NO: 74723 - RNA, 23 nt, Artificial Sequence
  Oligomer
ucccacacucaaaggcagagaug

SEQ ID NO: 74724 - RNA, 23 nt, Artificial Sequence
  Oligomer
aaagguucucucucucaaauacu

SEQ ID NO: 74725 - RNA, 23 nt, Artificial Sequence
  Oligomer
uaaagguuucuagguugaaaaca

SEQ ID NO: 74726 - RNA, 23 nt, Artificial Sequence
  Oligomer
ugauggugaauaaaacaaacaag

SEQ ID NO: 74727 - RNA, 23 nt, Artificial Sequence
  Oligomer
ugcagguugauugaaugaaagug

SEQ ID NO: 74728 - RNA, 23 nt, Artificial Sequence
  Oligomer
accacccaaacaaauauuuauug

SEQ ID NO: 74729 - RNA, 23 nt, Artificial Sequence
  Oligomer
cuagguugaaaacaauaacaugu

SEQ ID NO: 74730 - RNA, 23 nt, Artificial Sequence
  Oligomer
caaagagcugaaaaaccucuugg

SEQ ID NO: 74731 - RNA, 23 nt, Artificial Sequence
  Oligomer
accuauaugccagcuggaagugu

SEQ ID NO: 74732 - RNA, 23 nt, Artificial Sequence
  Oligomer
acaugauggugaauaaaacaaac

SEQ ID NO: 74733 - RNA, 23 nt, Artificial Sequence
  Oligomer
acagcuguuuggcuagcaccacu

SEQ ID NO: 74734 - RNA, 23 nt, Artificial Sequence
  Oligomer
aguuaucucacacaugauauguc

SEQ ID NO: 74735 - RNA, 23 nt, Artificial Sequence
  Oligomer
aauccguguauauugucaaaagg

SEQ ID NO: 74736 - RNA, 23 nt, Artificial Sequence
  Oligomer
agagaaacaaccaacgaaagauc

SEQ ID NO: 74737 - RNA, 23 nt, Artificial Sequence
  Oligomer
auggacgucauagcccaaaagcu

SEQ ID NO: 74738 - RNA, 23 nt, Artificial Sequence
  Oligomer
acauggacgucauagcccaaaag

SEQ ID NO: 74739 - RNA, 23 nt, Artificial Sequence
  Oligomer
ugugcagucuggucacauagaac

SEQ ID NO: 74740 - RNA, 23 nt, Artificial Sequence
  Oligomer
agaugaugggcacaggaaacaag

SEQ ID NO: 74741 - RNA, 23 nt, Artificial Sequence
  Oligomer
agugggaguggaaagguucucuc

SEQ ID NO: 74742 - RNA, 23 nt, Artificial Sequence
  Oligomer
aagacagagaggugguuacagag

SEQ ID NO: 74743 - RNA, 23 nt, Artificial Sequence
  Oligomer
uccuucuccagaagauguucuaa

SEQ ID NO: 74744 - RNA, 23 nt, Artificial Sequence
  Oligomer
uuggcuagcaccacucgguucuu

SEQ ID NO: 74745 - RNA, 23 nt, Artificial Sequence
  Oligomer
gcuggaacugaacacaaauaugg

SEQ ID NO: 74746 - RNA, 23 nt, Artificial Sequence
  Oligomer
ggaaguguguuugauaaaauuca

SEQ ID NO: 74747 - RNA, 23 nt, Artificial Sequence
  Oligomer
agcuggaacugaacacaaauaug

SEQ ID NO: 74748 - RNA, 23 nt, Artificial Sequence
  Oligomer
ugagcucccucauuuccaaggug

SEQ ID NO: 74749 - RNA, 23 nt, Artificial Sequence
  Oligomer
aucuccuugcaccgguggaauuc

SEQ ID NO: 74750 - RNA, 23 nt, Artificial Sequence
  Oligomer
aaaagacagagaggugguuacag

SEQ ID NO: 74751 - RNA, 23 nt, Artificial Sequence
  Oligomer
uguggugacagacacagaaguag

SEQ ID NO: 74752 - RNA, 23 nt, Artificial Sequence
  Oligomer
aaagcuugaagagggugacuaga

SEQ ID NO: 74753 - RNA, 23 nt, Artificial Sequence
  Oligomer
ugaagaucaaaggcucuaucaca

SEQ ID NO: 74754 - RNA, 23 nt, Artificial Sequence
  Oligomer
agaguuuacauuuuaaaugaggg

SEQ ID NO: 74755 - RNA, 23 nt, Artificial Sequence
  Oligomer
uugagacuuccaugggcaaagau

SEQ ID NO: 74756 - RNA, 23 nt, Artificial Sequence
  Oligomer
cuggaaguguguuugauaaaauu

SEQ ID NO: 74757 - RNA, 23 nt, Artificial Sequence
  Oligomer
aagggagagagauggacguuucu

SEQ ID NO: 74758 - RNA, 23 nt, Artificial Sequence
  Oligomer
acaaccaaauccuggccaggugu

SEQ ID NO: 74759 - RNA, 23 nt, Artificial Sequence
  Oligomer
uugaggcaggcauagccgcauau

SEQ ID NO: 74760 - RNA, 23 nt, Artificial Sequence
  Oligomer
agcaagaaaucaccauuuaauga

SEQ ID NO: 74761 - RNA, 23 nt, Artificial Sequence
  Oligomer
acugcaaccuauaugccagcugg

SEQ ID NO: 74762 - RNA, 23 nt, Artificial Sequence
  Oligomer
auuuggcacccgauggcaauaca

SEQ ID NO: 74763 - RNA, 23 nt, Artificial Sequence
  Oligomer
aggccgagacugcaaccuauaug

SEQ ID NO: 74764 - RNA, 23 nt, Artificial Sequence
  Oligomer
uugagcccaaacgagccaagagu

SEQ ID NO: 74765 - RNA, 23 nt, Artificial Sequence
  Oligomer
ugccaguggauaaaagcaaaaca

SEQ ID NO: 74766 - RNA, 23 nt, Artificial Sequence
  Oligomer
ugcaaggcaauguuggcugacag

SEQ ID NO: 74767 - RNA, 23 nt, Artificial Sequence
  Oligomer
agcaggauucuagacagauuugg

SEQ ID NO: 74768 - RNA, 23 nt, Artificial Sequence
  Oligomer
augccagcuggaaguguguuuga

SEQ ID NO: 74769 - RNA, 23 nt, Artificial Sequence
  Oligomer
gaaggaaaaagacagagaggugg

SEQ ID NO: 74770 - RNA, 23 nt, Artificial Sequence
  Oligomer
uguucuguaggcuugggcaguug

SEQ ID NO: 74771 - RNA, 23 nt, Artificial Sequence
  Oligomer
aagagcugaaaaaccucuuggag

SEQ ID NO: 74772 - RNA, 23 nt, Artificial Sequence
  Oligomer
acagagugcugcaguauucagac

SEQ ID NO: 74773 - RNA, 23 nt, Artificial Sequence
  Oligomer
acagagaggugguuacagagucu

SEQ ID NO: 74774 - RNA, 23 nt, Artificial Sequence
  Oligomer
ugaagugcagguugauugaauga

SEQ ID NO: 74775 - RNA, 23 nt, Artificial Sequence
  Oligomer
gcaagaaccaguucucauaaacc

SEQ ID NO: 74776 - RNA, 23 nt, Artificial Sequence
  Oligomer
aaaagcuugaagagggugacuag

SEQ ID NO: 74777 - RNA, 23 nt, Artificial Sequence
  Oligomer
ugggcaguuggcguugucaaaga

SEQ ID NO: 74778 - RNA, 23 nt, Artificial Sequence
  Oligomer
aagggcggaggauaugaaugaaa

SEQ ID NO: 74779 - RNA, 23 nt, Artificial Sequence
  Oligomer
acccaaacaaauauuuauugagc

SEQ ID NO: 74780 - RNA, 23 nt, Artificial Sequence
  Oligomer
gcuggaaguguguuugauaaaau

SEQ ID NO: 74781 - RNA, 23 nt, Artificial Sequence
  Oligomer
aggaacauuuuaucaaaagguag

SEQ ID NO: 74782 - RNA, 23 nt, Artificial Sequence
  Oligomer
acaagcccgcucagaaaacacuu

SEQ ID NO: 74783 - RNA, 23 nt, Artificial Sequence
  Oligomer
aacaggaugaaaugaagguaaag

SEQ ID NO: 74784 - RNA, 23 nt, Artificial Sequence
  Oligomer
cucuguuaugugagaacagacug

SEQ ID NO: 74785 - RNA, 23 nt, Artificial Sequence
  Oligomer
aaccuauaugccagcuggaagug

SEQ ID NO: 74786 - RNA, 23 nt, Artificial Sequence
  Oligomer
uccuggcaauagguccaaccaag

SEQ ID NO: 74787 - RNA, 23 nt, Artificial Sequence
  Oligomer
aaguuaucucacacaugauaugu

SEQ ID NO: 74788 - RNA, 23 nt, Artificial Sequence
  Oligomer
augucgacccaaaggcaggacuu

SEQ ID NO: 74789 - RNA, 23 nt, Artificial Sequence
  Oligomer
acaagucugggagauucccacau

SEQ ID NO: 74790 - RNA, 23 nt, Artificial Sequence
  Oligomer
gaacaaagaacuacauuacaucu

SEQ ID NO: 74791 - RNA, 23 nt, Artificial Sequence
  Oligomer
acaccauucuuccuggccuucuc

SEQ ID NO: 74792 - RNA, 23 nt, Artificial Sequence
  Oligomer
agcaccacucgguucuuuuuuag

SEQ ID NO: 74793 - RNA, 23 nt, Artificial Sequence
  Oligomer
aggaacaaagaacuacauuacau

SEQ ID NO: 74794 - RNA, 23 nt, Artificial Sequence
  Oligomer
ugggaauaguaagggagagagau

SEQ ID NO: 74795 - RNA, 23 nt, Artificial Sequence
  Oligomer
aaagguuucuagguugaaaacaa

SEQ ID NO: 74796 - RNA, 23 nt, Artificial Sequence
  Oligomer
cugaagaucaaaggcucuaucac

SEQ ID NO: 74797 - RNA, 23 nt, Artificial Sequence
  Oligomer
uggaauucugugccaggagcaua

SEQ ID NO: 74798 - RNA, 23 nt, Artificial Sequence
  Oligomer
aggagauggucucucagacaucu

SEQ ID NO: 74799 - RNA, 23 nt, Artificial Sequence
  Oligomer
uagcaccacucgguucuuuuuua

SEQ ID NO: 74800 - RNA, 23 nt, Artificial Sequence
  Oligomer
accaacgaaagaucuuugagacu

SEQ ID NO: 74801 - RNA, 23 nt, Artificial Sequence
  Oligomer
aagugcagguugauugaaugaaa

SEQ ID NO: 74802 - RNA, 23 nt, Artificial Sequence
  Oligomer
gauguggugacagacacagaagu

SEQ ID NO: 74803 - RNA, 23 nt, Artificial Sequence
  Oligomer
acucuguuaugugagaacagacu

SEQ ID NO: 74804 - RNA, 23 nt, Artificial Sequence
  Oligomer
uugcuucuucagagccaaaagau

SEQ ID NO: 74805 - RNA, 23 nt, Artificial Sequence
  Oligomer
ucgcucaacaacagcuguuuggc

SEQ ID NO: 74806 - RNA, 23 nt, Artificial Sequence
  Oligomer
aaaauccuggcagugggagugga

SEQ ID NO: 74807 - RNA, 23 nt, Artificial Sequence
  Oligomer
aucacuaaagugccaucuacaaa

SEQ ID NO: 74808 - RNA, 23 nt, Artificial Sequence
  Oligomer
cuccagaagauguucuaacaauu

SEQ ID NO: 74809 - RNA, 23 nt, Artificial Sequence
  Oligomer
guauuaaacucuccuuugauauu

SEQ ID NO: 74810 - RNA, 23 nt, Artificial Sequence
  Oligomer
aguauuaaacucuccuuugauau

SEQ ID NO: 74811 - RNA, 23 nt, Artificial Sequence
  Oligomer
caguauuaaacucuccuuugaua

SEQ ID NO: 74812 - RNA, 23 nt, Artificial Sequence
  Oligomer
cauaucucucccuucuuuaccuu

SEQ ID NO: 74813 - RNA, 23 nt, Artificial Sequence
  Oligomer
ucauaucucucccuucuuuaccu

SEQ ID NO: 74814 - RNA, 23 nt, Artificial Sequence
  Oligomer
uucauaucucucccuucuuuacc

SEQ ID NO: 74815 - RNA, 23 nt, Artificial Sequence
  Oligomer
cuucauaucucucccuucuuuac

SEQ ID NO: 74816 - RNA, 23 nt, Artificial Sequence
  Oligomer
gcuucauaucucucccuucuuua

SEQ ID NO: 74817 - RNA, 23 nt, Artificial Sequence
  Oligomer
ggagagugaugccgguaaagaaa

SEQ ID NO: 74818 - RNA, 23 nt, Artificial Sequence
  Oligomer
aggagagugaugccgguaaagaa

SEQ ID NO: 74819 - RNA, 23 nt, Artificial Sequence
  Oligomer
gaggagagugaugccgguaaaga

SEQ ID NO: 74820 - RNA, 23 nt, Artificial Sequence
  Oligomer
cgaggagagugaugccgguaaag

SEQ ID NO: 74821 - RNA, 23 nt, Artificial Sequence
  Oligomer
gcgaggagagugaugccgguaaa

SEQ ID NO: 74822 - RNA, 23 nt, Artificial Sequence
  Oligomer
uuaucucccugcuucauaucucu

SEQ ID NO: 74823 - RNA, 23 nt, Artificial Sequence
  Oligomer
cuuaucucccugcuucauaucuc

SEQ ID NO: 74824 - RNA, 23 nt, Artificial Sequence
  Oligomer
gcuuaucucccugcuucauaucu

SEQ ID NO: 74825 - RNA, 23 nt, Artificial Sequence
  Oligomer
agcuuaucucccugcuucauauc

SEQ ID NO: 74826 - RNA, 23 nt, Artificial Sequence
  Oligomer
uagcuuaucucccugcuucauau

SEQ ID NO: 74827 - RNA, 23 nt, Artificial Sequence
  Oligomer
cucccugcuucauaucucucccu

SEQ ID NO: 74828 - RNA, 23 nt, Artificial Sequence
  Oligomer
ucucccugcuucauaucucuccc

SEQ ID NO: 74829 - RNA, 23 nt, Artificial Sequence
  Oligomer
aucucccugcuucauaucucucc

SEQ ID NO: 74830 - RNA, 23 nt, Artificial Sequence
  Oligomer
uaucucccugcuucauaucucuc

SEQ ID NO: 74831 - RNA, 23 nt, Artificial Sequence
  Oligomer
ugcuucauaucucucccuucuuu

SEQ ID NO: 74832 - RNA, 23 nt, Artificial Sequence
  Oligomer
acugcacaggaaaugcaagagaa

SEQ ID NO: 74833 - RNA, 23 nt, Artificial Sequence
  Oligomer
cugcuucauaucucucccuucuu

SEQ ID NO: 74834 - RNA, 23 nt, Artificial Sequence
  Oligomer
ccugcuucauaucucucccuucu

SEQ ID NO: 74835 - RNA, 23 nt, Artificial Sequence
  Oligomer
cccugcuucauaucucucccuuc

SEQ ID NO: 74836 - RNA, 23 nt, Artificial Sequence
  Oligomer
uaugugaccagacugcacaggaa

SEQ ID NO: 74837 - RNA, 23 nt, Artificial Sequence
  Oligomer
uucaaucaaccugcacuucauau

SEQ ID NO: 74838 - RNA, 23 nt, Artificial Sequence
  Oligomer
auucaaucaaccugcacuucaua

SEQ ID NO: 74839 - RNA, 23 nt, Artificial Sequence
  Oligomer
cauucaaucaaccugcacuucau

SEQ ID NO: 74840 - RNA, 23 nt, Artificial Sequence
  Oligomer
caacuucccuguucuuuaagacu

SEQ ID NO: 74841 - RNA, 23 nt, Artificial Sequence
  Oligomer
ccaacuucccuguucuuuaagac

SEQ ID NO: 74842 - RNA, 23 nt, Artificial Sequence
  Oligomer
cccaacuucccuguucuuuaaga

SEQ ID NO: 74843 - RNA, 23 nt, Artificial Sequence
  Oligomer
ucccaacuucccuguucuuuaag

SEQ ID NO: 74844 - RNA, 23 nt, Artificial Sequence
  Oligomer
uucccaacuucccuguucuuuaa

SEQ ID NO: 74845 - RNA, 23 nt, Artificial Sequence
  Oligomer
cagagaaggccaggaagaauggu

SEQ ID NO: 74846 - RNA, 23 nt, Artificial Sequence
  Oligomer
ucagagaaggccaggaagaaugg

SEQ ID NO: 74847 - RNA, 23 nt, Artificial Sequence
  Oligomer
aucagagaaggccaggaagaaug

SEQ ID NO: 74848 - RNA, 23 nt, Artificial Sequence
  Oligomer
caucagagaaggccaggaagaau

SEQ ID NO: 74849 - RNA, 23 nt, Artificial Sequence
  Oligomer
gcaucagagaaggccaggaagaa

SEQ ID NO: 74850 - RNA, 23 nt, Artificial Sequence
  Oligomer
ugcaaggagaugucugaauacug

SEQ ID NO: 74851 - RNA, 23 nt, Artificial Sequence
  Oligomer
gugcaaggagaugucugaauacu

SEQ ID NO: 74852 - RNA, 23 nt, Artificial Sequence
  Oligomer
ggugcaaggagaugucugaauac

SEQ ID NO: 74853 - RNA, 23 nt, Artificial Sequence
  Oligomer
cggugcaaggagaugucugaaua

SEQ ID NO: 74854 - RNA, 23 nt, Artificial Sequence
  Oligomer
ccggugcaaggagaugucugaau

SEQ ID NO: 74855 - RNA, 23 nt, Artificial Sequence
  Oligomer
accggugcaaggagaugucugaa

SEQ ID NO: 74856 - RNA, 23 nt, Artificial Sequence
  Oligomer
caccggugcaaggagaugucuga

SEQ ID NO: 74857 - RNA, 23 nt, Artificial Sequence
  Oligomer
agggaagaaggcaagccaaccuu

SEQ ID NO: 74858 - RNA, 23 nt, Artificial Sequence
  Oligomer
gagggaagaaggcaagccaaccu

SEQ ID NO: 74859 - RNA, 23 nt, Artificial Sequence
  Oligomer
agagggaagaaggcaagccaacc

SEQ ID NO: 74860 - RNA, 23 nt, Artificial Sequence
  Oligomer
aagagggaagaaggcaagccaac

SEQ ID NO: 74861 - RNA, 23 nt, Artificial Sequence
  Oligomer
aaagagggaagaaggcaagccaa

SEQ ID NO: 74862 - RNA, 23 nt, Artificial Sequence
  Oligomer
caucgaggcucuugcucaagugu

SEQ ID NO: 74863 - RNA, 23 nt, Artificial Sequence
  Oligomer
acaucgaggcucuugcucaagug

SEQ ID NO: 74864 - RNA, 23 nt, Artificial Sequence
  Oligomer
uacaucgaggcucuugcucaagu

SEQ ID NO: 74865 - RNA, 23 nt, Artificial Sequence
  Oligomer
guacaucgaggcucuugcucaag

SEQ ID NO: 74866 - RNA, 23 nt, Artificial Sequence
  Oligomer
gguacaucgaggcucuugcucaa

SEQ ID NO: 74867 - RNA, 23 nt, Artificial Sequence
  Oligomer
gcacuucacuggagagaaagaac

SEQ ID NO: 74868 - RNA, 23 nt, Artificial Sequence
  Oligomer
gaaggacaucaucaccuuggaaa

SEQ ID NO: 74869 - RNA, 23 nt, Artificial Sequence
  Oligomer
ccaccaaaucugucuagaauccu

SEQ ID NO: 74870 - RNA, 23 nt, Artificial Sequence
  Oligomer
cguccaucucucucccuuacuau

SEQ ID NO: 74871 - RNA, 23 nt, Artificial Sequence
  Oligomer
acguccaucucucucccuuacua

SEQ ID NO: 74872 - RNA, 23 nt, Artificial Sequence
  Oligomer
aacguccaucucucucccuuacu

SEQ ID NO: 74873 - RNA, 23 nt, Artificial Sequence
  Oligomer
aaacguccaucucucucccuuac

SEQ ID NO: 74874 - RNA, 23 nt, Artificial Sequence
  Oligomer
gaaacguccaucucucucccuua

SEQ ID NO: 74875 - RNA, 23 nt, Artificial Sequence
  Oligomer
cuucccaacuucccuguucuuua

SEQ ID NO: 74876 - RNA, 23 nt, Artificial Sequence
  Oligomer
ucccugcuucauaucucucccuu

SEQ ID NO: 74877 - RNA, 23 nt, Artificial Sequence
  Oligomer
guguuucccuagacucuguaacc

SEQ ID NO: 74878 - RNA, 23 nt, Artificial Sequence
  Oligomer
uguguuucccuagacucuguaac

SEQ ID NO: 74879 - RNA, 23 nt, Artificial Sequence
  Oligomer
guguguuucccuagacucuguaa

SEQ ID NO: 74880 - RNA, 23 nt, Artificial Sequence
  Oligomer
cucccuucuuuaccuucauuuca

SEQ ID NO: 74881 - RNA, 23 nt, Artificial Sequence
  Oligomer
ucucccuucuuuaccuucauuuc

SEQ ID NO: 74882 - RNA, 23 nt, Artificial Sequence
  Oligomer
cucucccuucuuuaccuucauuu

SEQ ID NO: 74883 - RNA, 23 nt, Artificial Sequence
  Oligomer
ucucucccuucuuuaccuucauu

SEQ ID NO: 74884 - RNA, 23 nt, Artificial Sequence
  Oligomer
aucucucccuucuuuaccuucau

SEQ ID NO: 74885 - RNA, 23 nt, Artificial Sequence
  Oligomer
ccaucucucucccuuacuauucc

SEQ ID NO: 74886 - RNA, 23 nt, Artificial Sequence
  Oligomer
uccaucucucucccuuacuauuc

SEQ ID NO: 74887 - RNA, 23 nt, Artificial Sequence
  Oligomer
guccaucucucucccuuacuauu

SEQ ID NO: 74888 - RNA, 23 nt, Artificial Sequence
  Oligomer
gcccauggaagucucaaagaucu

SEQ ID NO: 74889 - RNA, 23 nt, Artificial Sequence
  Oligomer
gggagagggcauauaaauucccc

SEQ ID NO: 74890 - RNA, 23 nt, Artificial Sequence
  Oligomer
ggggagagggcauauaaauuccc

SEQ ID NO: 74891 - RNA, 23 nt, Artificial Sequence
  Oligomer
uggggagagggcauauaaauucc

SEQ ID NO: 74892 - RNA, 23 nt, Artificial Sequence
  Oligomer
auggggagagggcauauaaauuc

SEQ ID NO: 74893 - RNA, 23 nt, Artificial Sequence
  Oligomer
uauggggagagggcauauaaauu

SEQ ID NO: 74894 - RNA, 23 nt, Artificial Sequence
  Oligomer
cuagagugagaguuuggaaggug

SEQ ID NO: 74895 - RNA, 23 nt, Artificial Sequence
  Oligomer
ccuagagugagaguuuggaaggu

SEQ ID NO: 74896 - RNA, 23 nt, Artificial Sequence
  Oligomer
uccuagagugagaguuuggaagg

SEQ ID NO: 74897 - RNA, 23 nt, Artificial Sequence
  Oligomer
guccuagagugagaguuuggaag

SEQ ID NO: 74898 - RNA, 23 nt, Artificial Sequence
  Oligomer
uguccuagagugagaguuuggaa

SEQ ID NO: 74899 - RNA, 23 nt, Artificial Sequence
  Oligomer
gaguggugcuagccaaacagcug

SEQ ID NO: 74900 - RNA, 23 nt, Artificial Sequence
  Oligomer
cgaguggugcuagccaaacagcu

SEQ ID NO: 74901 - RNA, 23 nt, Artificial Sequence
  Oligomer
ccgaguggugcuagccaaacagc

SEQ ID NO: 74902 - RNA, 23 nt, Artificial Sequence
  Oligomer
accgaguggugcuagccaaacag

SEQ ID NO: 74903 - RNA, 23 nt, Artificial Sequence
  Oligomer
aaccgaguggugcuagccaaaca

SEQ ID NO: 74904 - RNA, 23 nt, Artificial Sequence
  Oligomer
acucuccuuugauauuauguggc

SEQ ID NO: 74905 - RNA, 23 nt, Artificial Sequence
  Oligomer
aacucuccuuugauauuaugugg

SEQ ID NO: 74906 - RNA, 23 nt, Artificial Sequence
  Oligomer
aaacucuccuuugauauuaugug

SEQ ID NO: 74907 - RNA, 23 nt, Artificial Sequence
  Oligomer
uaaacucuccuuugauauuaugu

SEQ ID NO: 74908 - RNA, 23 nt, Artificial Sequence
  Oligomer
uuaaacucuccuuugauauuaug

SEQ ID NO: 74909 - RNA, 23 nt, Artificial Sequence
  Oligomer
cugucuuuuuccuuccugagaaa

SEQ ID NO: 74910 - RNA, 23 nt, Artificial Sequence
  Oligomer
ucugucuuuuuccuuccugagaa

SEQ ID NO: 74911 - RNA, 23 nt, Artificial Sequence
  Oligomer
cucugucuuuuuccuuccugaga

SEQ ID NO: 74912 - RNA, 23 nt, Artificial Sequence
  Oligomer
ucucugucuuuuuccuuccugag

SEQ ID NO: 74913 - RNA, 23 nt, Artificial Sequence
  Oligomer
cucucugucuuuuuccuuccuga

SEQ ID NO: 74914 - RNA, 23 nt, Artificial Sequence
  Oligomer
caggaagaaugguguguuucccu

SEQ ID NO: 74915 - RNA, 23 nt, Artificial Sequence
  Oligomer
ccaggaagaaugguguguuuccc

SEQ ID NO: 74916 - RNA, 23 nt, Artificial Sequence
  Oligomer
gccaggaagaaugguguguuucc

SEQ ID NO: 74917 - RNA, 23 nt, Artificial Sequence
  Oligomer
ggccaggaagaaugguguguuuc

SEQ ID NO: 74918 - RNA, 23 nt, Artificial Sequence
  Oligomer
aggccaggaagaaugguguguuu

SEQ ID NO: 74919 - RNA, 23 nt, Artificial Sequence
  Oligomer
aaaagagggaagaaggcaagcca

SEQ ID NO: 74920 - RNA, 23 nt, Artificial Sequence
  Oligomer
uaaaagagggaagaaggcaagcc

SEQ ID NO: 74921 - RNA, 23 nt, Artificial Sequence
  Oligomer
auaaaagagggaagaaggcaagc

SEQ ID NO: 74922 - RNA, 23 nt, Artificial Sequence
  Oligomer
aauaaaagagggaagaaggcaag

SEQ ID NO: 74923 - RNA, 23 nt, Artificial Sequence
  Oligomer
agcaucagagaaggccaggaaga

SEQ ID NO: 74924 - RNA, 23 nt, Artificial Sequence
  Oligomer
gagcaucagagaaggccaggaag

SEQ ID NO: 74925 - RNA, 23 nt, Artificial Sequence
  Oligomer
ggagcaucagagaaggccaggaa

SEQ ID NO: 74926 - RNA, 23 nt, Artificial Sequence
  Oligomer
gacugcacaggaaaugcaagaga

SEQ ID NO: 74927 - RNA, 23 nt, Artificial Sequence
  Oligomer
agacugcacaggaaaugcaagag

SEQ ID NO: 74928 - RNA, 23 nt, Artificial Sequence
  Oligomer
cagacugcacaggaaaugcaaga

SEQ ID NO: 74929 - RNA, 23 nt, Artificial Sequence
  Oligomer
uaucucucccuucuuuaccuuca

SEQ ID NO: 74930 - RNA, 23 nt, Artificial Sequence
  Oligomer
auaucucucccuucuuuaccuuc

SEQ ID NO: 74931 - RNA, 23 nt, Artificial Sequence
  Oligomer
aagaagcaaacaugacuagagac

SEQ ID NO: 74932 - RNA, 23 nt, Artificial Sequence
  Oligomer
gaagaagcaaacaugacuagaga

SEQ ID NO: 74933 - RNA, 23 nt, Artificial Sequence
  Oligomer
gaguuuggaagguguccaaauuu

SEQ ID NO: 74934 - RNA, 23 nt, Artificial Sequence
  Oligomer
agaguuuggaagguguccaaauu

SEQ ID NO: 74935 - RNA, 23 nt, Artificial Sequence
  Oligomer
gagaguuuggaagguguccaaau

SEQ ID NO: 74936 - RNA, 23 nt, Artificial Sequence
  Oligomer
ugagaguuuggaagguguccaaa

SEQ ID NO: 74937 - RNA, 23 nt, Artificial Sequence
  Oligomer
gugagaguuuggaagguguccaa

SEQ ID NO: 74938 - RNA, 23 nt, Artificial Sequence
  Oligomer
gaaaaguugccgaagaugagacu

SEQ ID NO: 74939 - RNA, 23 nt, Artificial Sequence
  Oligomer
agaaaaguugccgaagaugagac

SEQ ID NO: 74940 - RNA, 23 nt, Artificial Sequence
  Oligomer
aagaaaaguugccgaagaugaga

SEQ ID NO: 74941 - RNA, 23 nt, Artificial Sequence
  Oligomer
aaagaaaaguugccgaagaugag

SEQ ID NO: 74942 - RNA, 23 nt, Artificial Sequence
  Oligomer
uaaagaaaaguugccgaagauga

SEQ ID NO: 74943 - RNA, 23 nt, Artificial Sequence
  Oligomer
cucuagucacccucuucaagcuu

SEQ ID NO: 74944 - RNA, 23 nt, Artificial Sequence
  Oligomer
acucuagucacccucuucaagcu

SEQ ID NO: 74945 - RNA, 23 nt, Artificial Sequence
  Oligomer
uacucuagucacccucuucaagc

SEQ ID NO: 74946 - RNA, 23 nt, Artificial Sequence
  Oligomer
ggcuuuuauuucagugccauaca

SEQ ID NO: 74947 - RNA, 23 nt, Artificial Sequence
  Oligomer
uggcuuuuauuucagugccauac

SEQ ID NO: 74948 - RNA, 23 nt, Artificial Sequence
  Oligomer
guggcuuuuauuucagugccaua

SEQ ID NO: 74949 - RNA, 23 nt, Artificial Sequence
  Oligomer
cuagcuuaucucccugcuucaua

SEQ ID NO: 74950 - RNA, 23 nt, Artificial Sequence
  Oligomer
cuugcugcaguguccagaagcgg

SEQ ID NO: 74951 - RNA, 23 nt, Artificial Sequence
  Oligomer
ccuugcugcaguguccagaagcg

SEQ ID NO: 74952 - RNA, 23 nt, Artificial Sequence
  Oligomer
accuugcugcaguguccagaagc

SEQ ID NO: 74953 - RNA, 23 nt, Artificial Sequence
  Oligomer
caccuugcugcaguguccagaag

SEQ ID NO: 74954 - RNA, 23 nt, Artificial Sequence
  Oligomer
gcaccuugcugcaguguccagaa

SEQ ID NO: 74955 - RNA, 23 nt, Artificial Sequence
  Oligomer
acuuaucaaggaucgggaagguu

SEQ ID NO: 74956 - RNA, 23 nt, Artificial Sequence
  Oligomer
cgccaucuaugguguggauggga

SEQ ID NO: 74957 - RNA, 23 nt, Artificial Sequence
  Oligomer
gcgccaucuaugguguggauggg

SEQ ID NO: 74958 - RNA, 23 nt, Artificial Sequence
  Oligomer
ggcgccaucuaugguguggaugg

SEQ ID NO: 74959 - RNA, 23 nt, Artificial Sequence
  Oligomer
gggcgccaucuaugguguggaug

SEQ ID NO: 74960 - RNA, 23 nt, Artificial Sequence
  Oligomer
agggcgccaucuaugguguggau

SEQ ID NO: 74961 - RNA, 23 nt, Artificial Sequence
  Oligomer
uuuuguagauggcacuuuaguga

SEQ ID NO: 74962 - RNA, 23 nt, Artificial Sequence
  Oligomer
caaugugcacuucacuggagaga

SEQ ID NO: 74963 - RNA, 23 nt, Artificial Sequence
  Oligomer
gcaaugugcacuucacuggagag

SEQ ID NO: 74964 - RNA, 23 nt, Artificial Sequence
  Oligomer
agcaaugugcacuucacuggaga

SEQ ID NO: 74965 - RNA, 23 nt, Artificial Sequence
  Oligomer
gagcaaugugcacuucacuggag

SEQ ID NO: 74966 - RNA, 23 nt, Artificial Sequence
  Oligomer
ugagcaaugugcacuucacugga

SEQ ID NO: 74967 - RNA, 23 nt, Artificial Sequence
  Oligomer
aaacgagguuccugguacaucga

SEQ ID NO: 74968 - RNA, 23 nt, Artificial Sequence
  Oligomer
ccuagcuuaucucccugcuucau

SEQ ID NO: 74969 - RNA, 23 nt, Artificial Sequence
  Oligomer
guaaaugcucaaagauguaaugu

SEQ ID NO: 74970 - RNA, 23 nt, Artificial Sequence
  Oligomer
uguaaaugcucaaagauguaaug

SEQ ID NO: 74971 - RNA, 23 nt, Artificial Sequence
  Oligomer
auguaaaugcucaaagauguaau

SEQ ID NO: 74972 - RNA, 23 nt, Artificial Sequence
  Oligomer
ccuuuuuguccuagagugagagu

SEQ ID NO: 74973 - RNA, 23 nt, Artificial Sequence
  Oligomer
cacacuuccagcuggcauauagg

SEQ ID NO: 74974 - RNA, 23 nt, Artificial Sequence
  Oligomer
acacacuuccagcuggcauauag

SEQ ID NO: 74975 - RNA, 23 nt, Artificial Sequence
  Oligomer
aacacacuuccagcuggcauaua

SEQ ID NO: 74976 - RNA, 23 nt, Artificial Sequence
  Oligomer
aaacacacuuccagcuggcauau

SEQ ID NO: 74977 - RNA, 23 nt, Artificial Sequence
  Oligomer
caaacacacuuccagcuggcaua

SEQ ID NO: 74978 - RNA, 23 nt, Artificial Sequence
  Oligomer
ugcgaggagagugaugccgguaa

SEQ ID NO: 74979 - RNA, 23 nt, Artificial Sequence
  Oligomer
gggguugaccaacaagauggaaa

SEQ ID NO: 74980 - RNA, 23 nt, Artificial Sequence
  Oligomer
ugggguugaccaacaagauggaa

SEQ ID NO: 74981 - RNA, 23 nt, Artificial Sequence
  Oligomer
gugggguugaccaacaagaugga

SEQ ID NO: 74982 - RNA, 23 nt, Artificial Sequence
  Oligomer
uccuagcuuaucucccugcuuca

SEQ ID NO: 74983 - RNA, 23 nt, Artificial Sequence
  Oligomer
cauugccuugcauuuguaccuua

SEQ ID NO: 74984 - RNA, 23 nt, Artificial Sequence
  Oligomer
acuggaauuucgcucuggagggg

SEQ ID NO: 74985 - RNA, 23 nt, Artificial Sequence
  Oligomer
aacuggaauuucgcucuggaggg

SEQ ID NO: 74986 - RNA, 23 nt, Artificial Sequence
  Oligomer
uuacauuaguuaagaugucugag

SEQ ID NO: 74987 - RNA, 23 nt, Artificial Sequence
  Oligomer
aacugcccaagccuacagaacaa

SEQ ID NO: 74988 - RNA, 23 nt, Artificial Sequence
  Oligomer
cuuugaucuucaggaugcacggu

SEQ ID NO: 74989 - RNA, 23 nt, Artificial Sequence
  Oligomer
ccuuugaucuucaggaugcacgg

SEQ ID NO: 74990 - RNA, 23 nt, Artificial Sequence
  Oligomer
cuuuuuccuuccugagaaacguc

SEQ ID NO: 74991 - RNA, 23 nt, Artificial Sequence
  Oligomer
ucuuuuuccuuccugagaaacgu

SEQ ID NO: 74992 - RNA, 23 nt, Artificial Sequence
  Oligomer
gucuuuuuccuuccugagaaacg

SEQ ID NO: 74993 - RNA, 23 nt, Artificial Sequence
  Oligomer
ugucuuuuuccuuccugagaaac

SEQ ID NO: 74994 - RNA, 23 nt, Artificial Sequence
  Oligomer
ggcucugaagaagcaaacaugac

SEQ ID NO: 74995 - RNA, 23 nt, Artificial Sequence
  Oligomer
uggcucugaagaagcaaacauga

SEQ ID NO: 74996 - RNA, 23 nt, Artificial Sequence
  Oligomer
aguuaagaugucugagagaccau

SEQ ID NO: 74997 - RNA, 23 nt, Artificial Sequence
  Oligomer
uaguuaagaugucugagagacca

SEQ ID NO: 74998 - RNA, 23 nt, Artificial Sequence
  Oligomer
uggcaugcauccucaucaucagg

SEQ ID NO: 74999 - RNA, 23 nt, Artificial Sequence
  Oligomer
guggcaugcauccucaucaucag

SEQ ID NO: 75000 - RNA, 23 nt, Artificial Sequence
  Oligomer
ucaacuugcugccuaagaggggu

SEQ ID NO: 75001 - RNA, 23 nt, Artificial Sequence
  Oligomer
cucaacuugcugccuaagagggg

SEQ ID NO: 75002 - RNA, 23 nt, Artificial Sequence
  Oligomer
ccucaacuugcugccuaagaggg

SEQ ID NO: 75003 - RNA, 23 nt, Artificial Sequence
  Oligomer
caccaaaucugucuagaauccug

SEQ ID NO: 75004 - RNA, 23 nt, Artificial Sequence
  Oligomer
augcugguuaaggugaacgcacu

SEQ ID NO: 75005 - RNA, 23 nt, Artificial Sequence
  Oligomer
caugcugguuaaggugaacgcac

SEQ ID NO: 75006 - RNA, 23 nt, Artificial Sequence
  Oligomer
ggacacucuuggcucguuugggc

SEQ ID NO: 75007 - RNA, 23 nt, Artificial Sequence
  Oligomer
cuuuaucccugcuuaucugaaac

SEQ ID NO: 75008 - RNA, 23 nt, Artificial Sequence
  Oligomer
ccuuuaucccugcuuaucugaaa

SEQ ID NO: 75009 - RNA, 23 nt, Artificial Sequence
  Oligomer
uguggcaugcauccucaucauca

SEQ ID NO: 75010 - RNA, 23 nt, Artificial Sequence
  Oligomer
gagguuccugguacaucgaggcu

SEQ ID NO: 75011 - RNA, 23 nt, Artificial Sequence
  Oligomer
cgagguuccugguacaucgaggc

SEQ ID NO: 75012 - RNA, 23 nt, Artificial Sequence
  Oligomer
acgagguuccugguacaucgagg

SEQ ID NO: 75013 - RNA, 23 nt, Artificial Sequence
  Oligomer
aacgagguuccugguacaucgag

SEQ ID NO: 75014 - RNA, 23 nt, Artificial Sequence
  Oligomer
cuuccuccagucuguucucacau

SEQ ID NO: 75015 - RNA, 23 nt, Artificial Sequence
  Oligomer
ucuuccuccagucuguucucaca

SEQ ID NO: 75016 - RNA, 23 nt, Artificial Sequence
  Oligomer
uuguccuagagugagaguuugga

SEQ ID NO: 75017 - RNA, 23 nt, Artificial Sequence
  Oligomer
cuuugagugugggacuccaggcc

SEQ ID NO: 75018 - RNA, 23 nt, Artificial Sequence
  Oligomer
ccuuugagugugggacuccaggc

SEQ ID NO: 75019 - RNA, 23 nt, Artificial Sequence
  Oligomer
gccuuugagugugggacuccagg

SEQ ID NO: 75020 - RNA, 23 nt, Artificial Sequence
  Oligomer
ugccuuugagugugggacuccag

SEQ ID NO: 75021 - RNA, 23 nt, Artificial Sequence
  Oligomer
cugccuuugagugugggacucca

SEQ ID NO: 75022 - RNA, 23 nt, Artificial Sequence
  Oligomer
caggccagcuccuuuucugugaa

SEQ ID NO: 75023 - RNA, 23 nt, Artificial Sequence
  Oligomer
aaaccuuuaucccugcuuaucug

SEQ ID NO: 75024 - RNA, 23 nt, Artificial Sequence
  Oligomer
cuuaucaaggaucgggaagguua

SEQ ID NO: 75025 - RNA, 23 nt, Artificial Sequence
  Oligomer
cuucaggaugcacgguuucuguu

SEQ ID NO: 75026 - RNA, 23 nt, Artificial Sequence
  Oligomer
uugugagccuugcugccaagucc

SEQ ID NO: 75027 - RNA, 23 nt, Artificial Sequence
  Oligomer
uuugugagccuugcugccaaguc

SEQ ID NO: 75028 - RNA, 23 nt, Artificial Sequence
  Oligomer
guuugugagccuugcugccaagu

SEQ ID NO: 75029 - RNA, 23 nt, Artificial Sequence
  Oligomer
gguuugugagccuugcugccaag

SEQ ID NO: 75030 - RNA, 23 nt, Artificial Sequence
  Oligomer
ugguuugugagccuugcugccaa

SEQ ID NO: 75031 - RNA, 23 nt, Artificial Sequence
  Oligomer
gagagagaaccuuuccacuccca

SEQ ID NO: 75032 - RNA, 23 nt, Artificial Sequence
  Oligomer
cagacaugauaugcggcuaugcc

SEQ ID NO: 75033 - RNA, 23 nt, Artificial Sequence
  Oligomer
ucagacaugauaugcggcuaugc

SEQ ID NO: 75034 - RNA, 23 nt, Artificial Sequence
  Oligomer
cucagacaugauaugcggcuaug

SEQ ID NO: 75035 - RNA, 23 nt, Artificial Sequence
  Oligomer
gcucagacaugauaugcggcuau

SEQ ID NO: 75036 - RNA, 23 nt, Artificial Sequence
  Oligomer
cgcucagacaugauaugcggcua

SEQ ID NO: 75037 - RNA, 23 nt, Artificial Sequence
  Oligomer
gguguguuucccuagacucugua

SEQ ID NO: 75038 - RNA, 23 nt, Artificial Sequence
  Oligomer
agugagaguuuggaaggugucca

SEQ ID NO: 75039 - RNA, 23 nt, Artificial Sequence
  Oligomer
gagugagaguuuggaaggugucc

SEQ ID NO: 75040 - RNA, 23 nt, Artificial Sequence
  Oligomer
agagugagaguuuggaagguguc

SEQ ID NO: 75041 - RNA, 23 nt, Artificial Sequence
  Oligomer
uagagugagaguuuggaaggugu

SEQ ID NO: 75042 - RNA, 23 nt, Artificial Sequence
  Oligomer
caacuugcugccuaagagggguc

SEQ ID NO: 75043 - RNA, 23 nt, Artificial Sequence
  Oligomer
agguuuuucagcucuuugacaac

SEQ ID NO: 75044 - RNA, 23 nt, Artificial Sequence
  Oligomer
gagguuuuucagcucuuugacaa

SEQ ID NO: 75045 - RNA, 23 nt, Artificial Sequence
  Oligomer
agagguuuuucagcucuuugaca

SEQ ID NO: 75046 - RNA, 23 nt, Artificial Sequence
  Oligomer
aagagguuuuucagcucuuugac

SEQ ID NO: 75047 - RNA, 23 nt, Artificial Sequence
  Oligomer
caagagguuuuucagcucuuuga

SEQ ID NO: 75048 - RNA, 23 nt, Artificial Sequence
  Oligomer
gaaacugcuccagcuccaagagg

SEQ ID NO: 75049 - RNA, 23 nt, Artificial Sequence
  Oligomer
ggaaacugcuccagcuccaagag

SEQ ID NO: 75050 - RNA, 23 nt, Artificial Sequence
  Oligomer
gggaaacugcuccagcuccaaga

SEQ ID NO: 75051 - RNA, 23 nt, Artificial Sequence
  Oligomer
ugggaaacugcuccagcuccaag

SEQ ID NO: 75052 - RNA, 23 nt, Artificial Sequence
  Oligomer
augggaaacugcuccagcuccaa

SEQ ID NO: 75053 - RNA, 23 nt, Artificial Sequence
  Oligomer
agguuaugcuccuggcacagaau

SEQ ID NO: 75054 - RNA, 23 nt, Artificial Sequence
  Oligomer
aagguuaugcuccuggcacagaa

SEQ ID NO: 75055 - RNA, 23 nt, Artificial Sequence
  Oligomer
gaagguuaugcuccuggcacaga

SEQ ID NO: 75056 - RNA, 23 nt, Artificial Sequence
  Oligomer
ggaagguuaugcuccuggcacag

SEQ ID NO: 75057 - RNA, 23 nt, Artificial Sequence
  Oligomer
gggaagguuaugcuccuggcaca

SEQ ID NO: 75058 - RNA, 23 nt, Artificial Sequence
  Oligomer
ucuuuguuccugcuuucucuuuc

SEQ ID NO: 75059 - RNA, 23 nt, Artificial Sequence
  Oligomer
ugacaauauacacggauuauuau

SEQ ID NO: 75060 - RNA, 23 nt, Artificial Sequence
  Oligomer
uugacaauauacacggauuauua

SEQ ID NO: 75061 - RNA, 23 nt, Artificial Sequence
  Oligomer
uuugacaauauacacggauuauu

SEQ ID NO: 75062 - RNA, 23 nt, Artificial Sequence
  Oligomer
uuuugacaauauacacggauuau

SEQ ID NO: 75063 - RNA, 23 nt, Artificial Sequence
  Oligomer
cuuuugacaauauacacggauua

SEQ ID NO: 75064 - RNA, 23 nt, Artificial Sequence
  Oligomer
ugaacgcacuuaucaaggaucgg

SEQ ID NO: 75065 - RNA, 23 nt, Artificial Sequence
  Oligomer
gugaacgcacuuaucaaggaucg

SEQ ID NO: 75066 - RNA, 23 nt, Artificial Sequence
  Oligomer
ggugaacgcacuuaucaaggauc

SEQ ID NO: 75067 - RNA, 23 nt, Artificial Sequence
  Oligomer
ggaucgggaagguuaugcuccug

SEQ ID NO: 75068 - RNA, 23 nt, Artificial Sequence
  Oligomer
aggaucgggaagguuaugcuccu

SEQ ID NO: 75069 - RNA, 23 nt, Artificial Sequence
  Oligomer
aaggaucgggaagguuaugcucc

SEQ ID NO: 75070 - RNA, 23 nt, Artificial Sequence
  Oligomer
ccacaggaggugugauagagccu

SEQ ID NO: 75071 - RNA, 23 nt, Artificial Sequence
  Oligomer
accacaggaggugugauagagcc

SEQ ID NO: 75072 - RNA, 23 nt, Artificial Sequence
  Oligomer
gaccacaggaggugugauagagc

SEQ ID NO: 75073 - RNA, 23 nt, Artificial Sequence
  Oligomer
ggaccacaggaggugugauagag

SEQ ID NO: 75074 - RNA, 23 nt, Artificial Sequence
  Oligomer
uggaccacaggaggugugauaga

SEQ ID NO: 75075 - RNA, 23 nt, Artificial Sequence
  Oligomer
ggucccuagcaaaaugcuaggcc

SEQ ID NO: 75076 - RNA, 23 nt, Artificial Sequence
  Oligomer
uggucccuagcaaaaugcuaggc

SEQ ID NO: 75077 - RNA, 23 nt, Artificial Sequence
  Oligomer
auggucccuagcaaaaugcuagg

SEQ ID NO: 75078 - RNA, 23 nt, Artificial Sequence
  Oligomer
cauggucccuagcaaaaugcuag

SEQ ID NO: 75079 - RNA, 23 nt, Artificial Sequence
  Oligomer
gaucuuugcccauggaagucuca

SEQ ID NO: 75080 - RNA, 23 nt, Artificial Sequence
  Oligomer
ugaucuuugcccauggaagucuc

SEQ ID NO: 75081 - RNA, 23 nt, Artificial Sequence
  Oligomer
auugaucuuugcccauggaaguc

SEQ ID NO: 75082 - RNA, 23 nt, Artificial Sequence
  Oligomer
uauugaucuuugcccauggaagu

SEQ ID NO: 75083 - RNA, 23 nt, Artificial Sequence
  Oligomer
ccaacaagauggaaagaaccacg

SEQ ID NO: 75084 - RNA, 23 nt, Artificial Sequence
  Oligomer
accaacaagauggaaagaaccac

SEQ ID NO: 75085 - RNA, 23 nt, Artificial Sequence
  Oligomer
gaccaacaagauggaaagaacca

SEQ ID NO: 75086 - RNA, 23 nt, Artificial Sequence
  Oligomer
cuuucuuccuccagucuguucuc

SEQ ID NO: 75087 - RNA, 23 nt, Artificial Sequence
  Oligomer
ucuuucuuccuccagucuguucu

SEQ ID NO: 75088 - RNA, 23 nt, Artificial Sequence
  Oligomer
uucuuucuuccuccagucuguuc

SEQ ID NO: 75089 - RNA, 23 nt, Artificial Sequence
  Oligomer
auucuuucuuccuccagucuguu

SEQ ID NO: 75090 - RNA, 23 nt, Artificial Sequence
  Oligomer
cauucuuucuuccuccagucugu

SEQ ID NO: 75091 - RNA, 23 nt, Artificial Sequence
  Oligomer
ccaacauugccuugcauuuguac

SEQ ID NO: 75092 - RNA, 23 nt, Artificial Sequence
  Oligomer
gccaacauugccuugcauuugua

SEQ ID NO: 75093 - RNA, 23 nt, Artificial Sequence
  Oligomer
agccaacauugccuugcauuugu

SEQ ID NO: 75094 - RNA, 23 nt, Artificial Sequence
  Oligomer
cagccaacauugccuugcauuug

SEQ ID NO: 75095 - RNA, 23 nt, Artificial Sequence
  Oligomer
ucagccaacauugccuugcauuu

SEQ ID NO: 75096 - RNA, 23 nt, Artificial Sequence
  Oligomer
uuuugaugccuucugugaagcac

SEQ ID NO: 75097 - RNA, 23 nt, Artificial Sequence
  Oligomer
cuuuugaugccuucugugaagca

SEQ ID NO: 75098 - RNA, 23 nt, Artificial Sequence
  Oligomer
gcuuuugaugccuucugugaagc

SEQ ID NO: 75099 - RNA, 23 nt, Artificial Sequence
  Oligomer
aaacaugacuagagacgcaccuu

SEQ ID NO: 75100 - RNA, 23 nt, Artificial Sequence
  Oligomer
caaacaugacuagagacgcaccu

SEQ ID NO: 75101 - RNA, 23 nt, Artificial Sequence
  Oligomer
uuuauucaccaucauguaccaag

SEQ ID NO: 75102 - RNA, 23 nt, Artificial Sequence
  Oligomer
uuuuauucaccaucauguaccaa

SEQ ID NO: 75103 - RNA, 23 nt, Artificial Sequence
  Oligomer
guuuuauucaccaucauguacca

SEQ ID NO: 75104 - RNA, 23 nt, Artificial Sequence
  Oligomer
uggaaaugagggagcucauccag

SEQ ID NO: 75105 - RNA, 23 nt, Artificial Sequence
  Oligomer
uuggaaaugagggagcucaucca

SEQ ID NO: 75106 - RNA, 23 nt, Artificial Sequence
  Oligomer
cuuggaaaugagggagcucaucc

SEQ ID NO: 75107 - RNA, 23 nt, Artificial Sequence
  Oligomer
ccuuggaaaugagggagcucauc

SEQ ID NO: 75108 - RNA, 23 nt, Artificial Sequence
  Oligomer
accuuggaaaugagggagcucau

SEQ ID NO: 75109 - RNA, 23 nt, Artificial Sequence
  Oligomer
acauugccuugcauuuguaccuu

SEQ ID NO: 75110 - RNA, 23 nt, Artificial Sequence
  Oligomer
aacauugccuugcauuuguaccu

SEQ ID NO: 75111 - RNA, 23 nt, Artificial Sequence
  Oligomer
caacauugccuugcauuuguacc

SEQ ID NO: 75112 - RNA, 23 nt, Artificial Sequence
  Oligomer
caggauauugggaguguguggca

SEQ ID NO: 75113 - RNA, 23 nt, Artificial Sequence
  Oligomer
gucugagagaccaucuccuaucu

SEQ ID NO: 75114 - RNA, 23 nt, Artificial Sequence
  Oligomer
ugucugagagaccaucuccuauc

SEQ ID NO: 75115 - RNA, 23 nt, Artificial Sequence
  Oligomer
augucugagagaccaucuccuau

SEQ ID NO: 75116 - RNA, 23 nt, Artificial Sequence
  Oligomer
uccugagaaacguccaucucucu

SEQ ID NO: 75117 - RNA, 23 nt, Artificial Sequence
  Oligomer
uuccugagaaacguccaucucuc

SEQ ID NO: 75118 - RNA, 23 nt, Artificial Sequence
  Oligomer
cuuccugagaaacguccaucucu

SEQ ID NO: 75119 - RNA, 23 nt, Artificial Sequence
  Oligomer
ccuuccugagaaacguccaucuc

SEQ ID NO: 75120 - RNA, 23 nt, Artificial Sequence
  Oligomer
uccuuccugagaaacguccaucu

SEQ ID NO: 75121 - RNA, 23 nt, Artificial Sequence
  Oligomer
cuuacuauucccacuuucauuca

SEQ ID NO: 75122 - RNA, 23 nt, Artificial Sequence
  Oligomer
uguggcuuuuauuucagugccau

SEQ ID NO: 75123 - RNA, 23 nt, Artificial Sequence
  Oligomer
gagaaacguccaucucucucccu

SEQ ID NO: 75124 - RNA, 23 nt, Artificial Sequence
  Oligomer
ugagaaacguccaucucucuccc

SEQ ID NO: 75125 - RNA, 23 nt, Artificial Sequence
  Oligomer
cugagaaacguccaucucucucc

SEQ ID NO: 75126 - RNA, 23 nt, Artificial Sequence
  Oligomer
ccugagaaacguccaucucucuc

SEQ ID NO: 75127 - RNA, 23 nt, Artificial Sequence
  Oligomer
agacauaucaugugugagauaac

SEQ ID NO: 75128 - RNA, 23 nt, Artificial Sequence
  Oligomer
aagacauaucaugugugagauaa

SEQ ID NO: 75129 - RNA, 23 nt, Artificial Sequence
  Oligomer
acugguguugagcaaugugcacu

SEQ ID NO: 75130 - RNA, 23 nt, Artificial Sequence
  Oligomer
cacugguguugagcaaugugcac

SEQ ID NO: 75131 - RNA, 23 nt, Artificial Sequence
  Oligomer
gcacugguguugagcaaugugca

SEQ ID NO: 75132 - RNA, 23 nt, Artificial Sequence
  Oligomer
aagaaggcaagccaaccuuagcu

SEQ ID NO: 75133 - RNA, 23 nt, Artificial Sequence
  Oligomer
gaagaaggcaagccaaccuuagc

SEQ ID NO: 75134 - RNA, 23 nt, Artificial Sequence
  Oligomer
ggaagaaggcaagccaaccuuag

SEQ ID NO: 75135 - RNA, 23 nt, Artificial Sequence
  Oligomer
gggaagaaggcaagccaaccuua

SEQ ID NO: 75136 - RNA, 23 nt, Artificial Sequence
  Oligomer
guguggaugggaaacugcuccag

SEQ ID NO: 75137 - RNA, 23 nt, Artificial Sequence
  Oligomer
gguguggaugggaaacugcucca

SEQ ID NO: 75138 - RNA, 23 nt, Artificial Sequence
  Oligomer
caucauguaccaagugcuuggca

SEQ ID NO: 75139 - RNA, 23 nt, Artificial Sequence
  Oligomer
gcuuucucuuucaguauuaaacu

SEQ ID NO: 75140 - RNA, 23 nt, Artificial Sequence
  Oligomer
agauggaaagaaccacgcaggau

SEQ ID NO: 75141 - RNA, 23 nt, Artificial Sequence
  Oligomer
aagauggaaagaaccacgcagga

SEQ ID NO: 75142 - RNA, 23 nt, Artificial Sequence
  Oligomer
caagauggaaagaaccacgcagg

SEQ ID NO: 75143 - RNA, 23 nt, Artificial Sequence
  Oligomer
acaagauggaaagaaccacgcag

SEQ ID NO: 75144 - RNA, 23 nt, Artificial Sequence
  Oligomer
aacaagauggaaagaaccacgca

SEQ ID NO: 75145 - RNA, 23 nt, Artificial Sequence
  Oligomer
uuguuugggugguuugugagccu

SEQ ID NO: 75146 - RNA, 23 nt, Artificial Sequence
  Oligomer
uuuguuugggugguuugugagcc

SEQ ID NO: 75147 - RNA, 23 nt, Artificial Sequence
  Oligomer
auuuguuugggugguuugugagc

SEQ ID NO: 75148 - RNA, 23 nt, Artificial Sequence
  Oligomer
uauuuguuugggugguuugugag

SEQ ID NO: 75149 - RNA, 23 nt, Artificial Sequence
  Oligomer
agaaacugcagaauuuugcacag

SEQ ID NO: 75150 - RNA, 23 nt, Artificial Sequence
  Oligomer
gagaaacugcagaauuuugcaca

SEQ ID NO: 75151 - RNA, 23 nt, Artificial Sequence
  Oligomer
uguguggcaugcauccucaucau

SEQ ID NO: 75152 - RNA, 23 nt, Artificial Sequence
  Oligomer
guguguggcaugcauccucauca

SEQ ID NO: 75153 - RNA, 23 nt, Artificial Sequence
  Oligomer
aguguguggcaugcauccucauc

SEQ ID NO: 75154 - RNA, 23 nt, Artificial Sequence
  Oligomer
gaguguguggcaugcauccucau

SEQ ID NO: 75155 - RNA, 23 nt, Artificial Sequence
  Oligomer
ggaguguguggcaugcauccuca

SEQ ID NO: 75156 - RNA, 23 nt, Artificial Sequence
  Oligomer
cauuuuuagcuccuugaagacau

SEQ ID NO: 75157 - RNA, 23 nt, Artificial Sequence
  Oligomer
uggagaugagacugaucgugggg

SEQ ID NO: 75158 - RNA, 23 nt, Artificial Sequence
  Oligomer
guggagaugagacugaucguggg

SEQ ID NO: 75159 - RNA, 23 nt, Artificial Sequence
  Oligomer
cguggagaugagacugaucgugg

SEQ ID NO: 75160 - RNA, 23 nt, Artificial Sequence
  Oligomer
uuaugcuccuggcacagaauucc

SEQ ID NO: 75161 - RNA, 23 nt, Artificial Sequence
  Oligomer
guuaugcuccuggcacagaauuc

SEQ ID NO: 75162 - RNA, 23 nt, Artificial Sequence
  Oligomer
gguuaugcuccuggcacagaauu

SEQ ID NO: 75163 - RNA, 23 nt, Artificial Sequence
  Oligomer
ugguuggaccuauugccaggaau

SEQ ID NO: 75164 - RNA, 23 nt, Artificial Sequence
  Oligomer
caucucucucccuuacuauuccc

SEQ ID NO: 75165 - RNA, 23 nt, Artificial Sequence
  Oligomer
auguggcuuuuauuucagugcca

SEQ ID NO: 75166 - RNA, 23 nt, Artificial Sequence
  Oligomer
ccaggccagcuccuuuucuguga

SEQ ID NO: 75167 - RNA, 23 nt, Artificial Sequence
  Oligomer
acaucuucuggagaaggacauca

SEQ ID NO: 75168 - RNA, 23 nt, Artificial Sequence
  Oligomer
aacaucuucuggagaaggacauc

SEQ ID NO: 75169 - RNA, 23 nt, Artificial Sequence
  Oligomer
gaacaucuucuggagaaggacau

SEQ ID NO: 75170 - RNA, 23 nt, Artificial Sequence
  Oligomer
agaacaucuucuggagaaggaca

SEQ ID NO: 75171 - RNA, 23 nt, Artificial Sequence
  Oligomer
acauaguauggaaguauuugaga

SEQ ID NO: 75172 - RNA, 23 nt, Artificial Sequence
  Oligomer
ucagugccauacauguuauuguu

SEQ ID NO: 75173 - RNA, 23 nt, Artificial Sequence
  Oligomer
uucagugccauacauguuauugu

SEQ ID NO: 75174 - RNA, 23 nt, Artificial Sequence
  Oligomer
uuucagugccauacauguuauug

SEQ ID NO: 75175 - RNA, 23 nt, Artificial Sequence
  Oligomer
auuucagugccauacauguuauu

SEQ ID NO: 75176 - RNA, 23 nt, Artificial Sequence
  Oligomer
guaaaugagggcagaaaccuugu

SEQ ID NO: 75177 - RNA, 23 nt, Artificial Sequence
  Oligomer
uguaaaugagggcagaaaccuug

SEQ ID NO: 75178 - RNA, 23 nt, Artificial Sequence
  Oligomer
acuuguuuccugugcccaucauc

SEQ ID NO: 75179 - RNA, 23 nt, Artificial Sequence
  Oligomer
gacuuguuuccugugcccaucau

SEQ ID NO: 75180 - RNA, 23 nt, Artificial Sequence
  Oligomer
agacuuguuuccugugcccauca

SEQ ID NO: 75181 - RNA, 23 nt, Artificial Sequence
  Oligomer
cagacuuguuuccugugcccauc

SEQ ID NO: 75182 - RNA, 23 nt, Artificial Sequence
  Oligomer
ccagacuuguuuccugugcccau

SEQ ID NO: 75183 - RNA, 23 nt, Artificial Sequence
  Oligomer
cuuccuucacaucucccaugguc

SEQ ID NO: 75184 - RNA, 23 nt, Artificial Sequence
  Oligomer
acuuccuucacaucucccauggu

SEQ ID NO: 75185 - RNA, 23 nt, Artificial Sequence
  Oligomer
aacuuccuucacaucucccaugg

SEQ ID NO: 75186 - RNA, 23 nt, Artificial Sequence
  Oligomer
uaacuuccuucacaucucccaug

SEQ ID NO: 75187 - RNA, 23 nt, Artificial Sequence
  Oligomer
auaacuuccuucacaucucccau

SEQ ID NO: 75188 - RNA, 23 nt, Artificial Sequence
  Oligomer
aagccaaccuuagcuacaauccu

SEQ ID NO: 75189 - RNA, 23 nt, Artificial Sequence
  Oligomer
gauuucuugcuaagcuccagccc

SEQ ID NO: 75190 - RNA, 23 nt, Artificial Sequence
  Oligomer
ugauuucuugcuaagcuccagcc

SEQ ID NO: 75191 - RNA, 23 nt, Artificial Sequence
  Oligomer
cacggauuauuauuuguacuuug

SEQ ID NO: 75192 - RNA, 23 nt, Artificial Sequence
  Oligomer
acacggauuauuauuuguacuuu

SEQ ID NO: 75193 - RNA, 23 nt, Artificial Sequence
  Oligomer
uacacggauuauuauuuguacuu

SEQ ID NO: 75194 - RNA, 23 nt, Artificial Sequence
  Oligomer
auacacggauuauuauuuguacu

SEQ ID NO: 75195 - RNA, 23 nt, Artificial Sequence
  Oligomer
uauacacggauuauuauuuguac

SEQ ID NO: 75196 - RNA, 23 nt, Artificial Sequence
  Oligomer
gcuccaagagguuuuucagcucu

SEQ ID NO: 75197 - RNA, 23 nt, Artificial Sequence
  Oligomer
agcuccaagagguuuuucagcuc

SEQ ID NO: 75198 - RNA, 23 nt, Artificial Sequence
  Oligomer
cagcuccaagagguuuuucagcu

SEQ ID NO: 75199 - RNA, 23 nt, Artificial Sequence
  Oligomer
gaugugggaaucucccagacuug

SEQ ID NO: 75200 - RNA, 23 nt, Artificial Sequence
  Oligomer
ggaugugggaaucucccagacuu

SEQ ID NO: 75201 - RNA, 23 nt, Artificial Sequence
  Oligomer
gggaugugggaaucucccagacu

SEQ ID NO: 75202 - RNA, 23 nt, Artificial Sequence
  Oligomer
agggaugugggaaucucccagac

SEQ ID NO: 75203 - RNA, 23 nt, Artificial Sequence
  Oligomer
cagggaugugggaaucucccaga

SEQ ID NO: 75204 - RNA, 23 nt, Artificial Sequence
  Oligomer
uggcacagaauuccaccggugca

SEQ ID NO: 75205 - RNA, 23 nt, Artificial Sequence
  Oligomer
uucugagcgggcuugugauaugc

SEQ ID NO: 75206 - RNA, 23 nt, Artificial Sequence
  Oligomer
uuucugagcgggcuugugauaug

SEQ ID NO: 75207 - RNA, 23 nt, Artificial Sequence
  Oligomer
uuuucugagcgggcuugugauau

SEQ ID NO: 75208 - RNA, 23 nt, Artificial Sequence
  Oligomer
guuuucugagcgggcuugugaua

SEQ ID NO: 75209 - RNA, 23 nt, Artificial Sequence
  Oligomer
uguuuucugagcgggcuugugau

SEQ ID NO: 75210 - RNA, 23 nt, Artificial Sequence
  Oligomer
guguggcaugcauccucaucauc

SEQ ID NO: 75211 - RNA, 23 nt, Artificial Sequence
  Oligomer
ucauccacgccaaguggaagcca

SEQ ID NO: 75212 - RNA, 23 nt, Artificial Sequence
  Oligomer
aucauccacgccaaguggaagcc

SEQ ID NO: 75213 - RNA, 23 nt, Artificial Sequence
  Oligomer
caucauccacgccaaguggaagc

SEQ ID NO: 75214 - RNA, 23 nt, Artificial Sequence
  Oligomer
ccaucauccacgccaaguggaag

SEQ ID NO: 75215 - RNA, 23 nt, Artificial Sequence
  Oligomer
cccaucauccacgccaaguggaa

SEQ ID NO: 75216 - RNA, 23 nt, Artificial Sequence
  Oligomer
caaagaucuuucguugguuguuu

SEQ ID NO: 75217 - RNA, 23 nt, Artificial Sequence
  Oligomer
ucaaagaucuuucguugguuguu

SEQ ID NO: 75218 - RNA, 23 nt, Artificial Sequence
  Oligomer
cucaaagaucuuucguugguugu

SEQ ID NO: 75219 - RNA, 23 nt, Artificial Sequence
  Oligomer
ucucaaagaucuuucguugguug

SEQ ID NO: 75220 - RNA, 23 nt, Artificial Sequence
  Oligomer
gucucaaagaucuuucguugguu

SEQ ID NO: 75221 - RNA, 23 nt, Artificial Sequence
  Oligomer
agaugagacugaucgugggguug

SEQ ID NO: 75222 - RNA, 23 nt, Artificial Sequence
  Oligomer
gagaugagacugaucgugggguu

SEQ ID NO: 75223 - RNA, 23 nt, Artificial Sequence
  Oligomer
ggagaugagacugaucguggggu

SEQ ID NO: 75224 - RNA, 23 nt, Artificial Sequence
  Oligomer
agagaaggccaggaagaauggug

SEQ ID NO: 75225 - RNA, 23 nt, Artificial Sequence
  Oligomer
gaugucugagagaccaucuccua

SEQ ID NO: 75226 - RNA, 23 nt, Artificial Sequence
  Oligomer
acgcgcucagacaugauaugcgg

SEQ ID NO: 75227 - RNA, 23 nt, Artificial Sequence
  Oligomer
cacgcgcucagacaugauaugcg

SEQ ID NO: 75228 - RNA, 23 nt, Artificial Sequence
  Oligomer
ccacgcgcucagacaugauaugc

SEQ ID NO: 75229 - RNA, 23 nt, Artificial Sequence
  Oligomer
cccacgcgcucagacaugauaug

SEQ ID NO: 75230 - RNA, 23 nt, Artificial Sequence
  Oligomer
gcccacgcgcucagacaugauau

SEQ ID NO: 75231 - RNA, 23 nt, Artificial Sequence
  Oligomer
caguuucagccagaauguggaac

SEQ ID NO: 75232 - RNA, 23 nt, Artificial Sequence
  Oligomer
ggauauugggaguguguggcaug

SEQ ID NO: 75233 - RNA, 23 nt, Artificial Sequence
  Oligomer
aggauauugggaguguguggcau

SEQ ID NO: 75234 - RNA, 23 nt, Artificial Sequence
  Oligomer
uuccuuccugagaaacguccauc

SEQ ID NO: 75235 - RNA, 23 nt, Artificial Sequence
  Oligomer
uuuccuuccugagaaacguccau

SEQ ID NO: 75236 - RNA, 23 nt, Artificial Sequence
  Oligomer
ucugagcgggcuugugauaugca

SEQ ID NO: 75237 - RNA, 23 nt, Artificial Sequence
  Oligomer
auuaucuuuuggcucugaagaag

SEQ ID NO: 75238 - RNA, 23 nt, Artificial Sequence
  Oligomer
cuuuguuacugaaaugagccucg

SEQ ID NO: 75239 - RNA, 23 nt, Artificial Sequence
  Oligomer
ucccuucuuuaccuucauuucau

SEQ ID NO: 75240 - RNA, 23 nt, Artificial Sequence
  Oligomer
aaccuuuaucccugcuuaucuga

SEQ ID NO: 75241 - RNA, 23 nt, Artificial Sequence
  Oligomer
gaaacuucccaacuucccuguuc

SEQ ID NO: 75242 - RNA, 23 nt, Artificial Sequence
  Oligomer
ugaaacuucccaacuucccuguu

SEQ ID NO: 75243 - RNA, 23 nt, Artificial Sequence
  Oligomer
cugaaacuucccaacuucccugu

SEQ ID NO: 75244 - RNA, 23 nt, Artificial Sequence
  Oligomer
ucugaaacuucccaacuucccug

SEQ ID NO: 75245 - RNA, 23 nt, Artificial Sequence
  Oligomer
cauguaccaagugcuuggcacau

SEQ ID NO: 75246 - RNA, 23 nt, Artificial Sequence
  Oligomer
ucauguaccaagugcuuggcaca

SEQ ID NO: 75247 - RNA, 23 nt, Artificial Sequence
  Oligomer
cuauucccacuuucauucaauca

SEQ ID NO: 75248 - RNA, 23 nt, Artificial Sequence
  Oligomer
acuauucccacuuucauucaauc

SEQ ID NO: 75249 - RNA, 23 nt, Artificial Sequence
  Oligomer
uacuauucccacuuucauucaau

SEQ ID NO: 75250 - RNA, 23 nt, Artificial Sequence
  Oligomer
uuacuauucccacuuucauucaa

SEQ ID NO: 75251 - RNA, 23 nt, Artificial Sequence
  Oligomer
ggaaagaaccacgcaggaucccc

SEQ ID NO: 75252 - RNA, 23 nt, Artificial Sequence
  Oligomer
uggaaagaaccacgcaggauccc

SEQ ID NO: 75253 - RNA, 23 nt, Artificial Sequence
  Oligomer
auggaaagaaccacgcaggaucc

SEQ ID NO: 75254 - RNA, 23 nt, Artificial Sequence
  Oligomer
gauggaaagaaccacgcaggauc

SEQ ID NO: 75255 - RNA, 23 nt, Artificial Sequence
  Oligomer
cgggaagguuaugcuccuggcac

SEQ ID NO: 75256 - RNA, 23 nt, Artificial Sequence
  Oligomer
ucgggaagguuaugcuccuggca

SEQ ID NO: 75257 - RNA, 23 nt, Artificial Sequence
  Oligomer
guguucaguuccagcuuuuguag

SEQ ID NO: 75258 - RNA, 23 nt, Artificial Sequence
  Oligomer
uguguucaguuccagcuuuugua

SEQ ID NO: 75259 - RNA, 23 nt, Artificial Sequence
  Oligomer
uuguguucaguuccagcuuuugu

SEQ ID NO: 75260 - RNA, 23 nt, Artificial Sequence
  Oligomer
uuuguguucaguuccagcuuuug

SEQ ID NO: 75261 - RNA, 23 nt, Artificial Sequence
  Oligomer
auuuguguucaguuccagcuuuu

SEQ ID NO: 75262 - RNA, 23 nt, Artificial Sequence
  Oligomer
uuauugaucuuugcccauggaag

SEQ ID NO: 75263 - RNA, 23 nt, Artificial Sequence
  Oligomer
auuugagagagagaaccuuucca

SEQ ID NO: 75264 - RNA, 23 nt, Artificial Sequence
  Oligomer
gacaauauacacggauuauuauu

SEQ ID NO: 75265 - RNA, 23 nt, Artificial Sequence
  Oligomer
ccaugcggaacaccaaacgaggu

SEQ ID NO: 75266 - RNA, 23 nt, Artificial Sequence
  Oligomer
gccaugcggaacaccaaacgagg

SEQ ID NO: 75267 - RNA, 23 nt, Artificial Sequence
  Oligomer
cgccaugcggaacaccaaacgag

SEQ ID NO: 75268 - RNA, 23 nt, Artificial Sequence
  Oligomer
ccgccaugcggaacaccaaacga

SEQ ID NO: 75269 - RNA, 23 nt, Artificial Sequence
  Oligomer
uguuucagcugcaguugaagagc

SEQ ID NO: 75270 - RNA, 23 nt, Artificial Sequence
  Oligomer
auguuucagcugcaguugaagag

SEQ ID NO: 75271 - RNA, 23 nt, Artificial Sequence
  Oligomer
aauguuucagcugcaguugaaga

SEQ ID NO: 75272 - RNA, 23 nt, Artificial Sequence
  Oligomer
ggaaucucccagacuuguuuccu

SEQ ID NO: 75273 - RNA, 23 nt, Artificial Sequence
  Oligomer
gggaaucucccagacuuguuucc

SEQ ID NO: 75274 - RNA, 23 nt, Artificial Sequence
  Oligomer
ugggaaucucccagacuuguuuc

SEQ ID NO: 75275 - RNA, 23 nt, Artificial Sequence
  Oligomer
gugggaaucucccagacuuguuu

SEQ ID NO: 75276 - RNA, 23 nt, Artificial Sequence
  Oligomer
ugugggaaucucccagacuuguu

SEQ ID NO: 75277 - RNA, 23 nt, Artificial Sequence
  Oligomer
aaaaguugccgaagaugagacug

SEQ ID NO: 75278 - RNA, 23 nt, Artificial Sequence
  Oligomer
ugcccacgcgcucagacaugaua

SEQ ID NO: 75279 - RNA, 23 nt, Artificial Sequence
  Oligomer
uuauccacuggcauuuuuagcuc

SEQ ID NO: 75280 - RNA, 23 nt, Artificial Sequence
  Oligomer
uuuauccacuggcauuuuuagcu

SEQ ID NO: 75281 - RNA, 23 nt, Artificial Sequence
  Oligomer
uuuuauccacuggcauuuuuagc

SEQ ID NO: 75282 - RNA, 23 nt, Artificial Sequence
  Oligomer
uauuucagugccauacauguuau

SEQ ID NO: 75283 - RNA, 23 nt, Artificial Sequence
  Oligomer
cuucuuuaccuucauuucauccu

SEQ ID NO: 75284 - RNA, 23 nt, Artificial Sequence
  Oligomer
ccuucuuuaccuucauuucaucc

SEQ ID NO: 75285 - RNA, 23 nt, Artificial Sequence
  Oligomer
cccuucuuuaccuucauuucauc

SEQ ID NO: 75286 - RNA, 23 nt, Artificial Sequence
  Oligomer
aaaugagggagcucauccaggcc

SEQ ID NO: 75287 - RNA, 23 nt, Artificial Sequence
  Oligomer
gaaaugagggagcucauccaggc

SEQ ID NO: 75288 - RNA, 23 nt, Artificial Sequence
  Oligomer
ggaaaugagggagcucauccagg

SEQ ID NO: 75289 - RNA, 23 nt, Artificial Sequence
  Oligomer
cuggaccacaggaggugugauag

SEQ ID NO: 75290 - RNA, 23 nt, Artificial Sequence
  Oligomer
acuggaccacaggaggugugaua

SEQ ID NO: 75291 - RNA, 23 nt, Artificial Sequence
  Oligomer
accuuuaucccugcuuaucugaa

SEQ ID NO: 75292 - RNA, 23 nt, Artificial Sequence
  Oligomer
cugugcccaucaucucugccuuu

SEQ ID NO: 75293 - RNA, 23 nt, Artificial Sequence
  Oligomer
agacaugauaugcggcuaugccu

SEQ ID NO: 75294 - RNA, 23 nt, Artificial Sequence
  Oligomer
uuuuuguccuagagugagaguuu

SEQ ID NO: 75295 - RNA, 23 nt, Artificial Sequence
  Oligomer
cuuuuuguccuagagugagaguu

SEQ ID NO: 75296 - RNA, 23 nt, Artificial Sequence
  Oligomer
uuuuccuuccugagaaacgucca

SEQ ID NO: 75297 - RNA, 23 nt, Artificial Sequence
  Oligomer
gccugugcguucccuucaguacu

SEQ ID NO: 75298 - RNA, 23 nt, Artificial Sequence
  Oligomer
ggccugugcguucccuucaguac

SEQ ID NO: 75299 - RNA, 23 nt, Artificial Sequence
  Oligomer
cggccugugcguucccuucagua

SEQ ID NO: 75300 - RNA, 23 nt, Artificial Sequence
  Oligomer
uguucaguuccagcuuuuguaga

SEQ ID NO: 75301 - RNA, 23 nt, Artificial Sequence
  Oligomer
ccuucacaucucccauggucccu

SEQ ID NO: 75302 - RNA, 23 nt, Artificial Sequence
  Oligomer
uccuucacaucucccaugguccc

SEQ ID NO: 75303 - RNA, 23 nt, Artificial Sequence
  Oligomer
uuccuucacaucucccauggucc

SEQ ID NO: 75304 - RNA, 23 nt, Artificial Sequence
  Oligomer
aauaucaaaggagaguuuaauac

SEQ ID NO: 75305 - RNA, 23 nt, Artificial Sequence
  Oligomer
auaucaaaggagaguuuaauacu

SEQ ID NO: 75306 - RNA, 23 nt, Artificial Sequence
  Oligomer
uaucaaaggagaguuuaauacug

SEQ ID NO: 75307 - RNA, 23 nt, Artificial Sequence
  Oligomer
aagguaaagaagggagagauaug

SEQ ID NO: 75308 - RNA, 23 nt, Artificial Sequence
  Oligomer
agguaaagaagggagagauauga

SEQ ID NO: 75309 - RNA, 23 nt, Artificial Sequence
  Oligomer
gguaaagaagggagagauaugaa

SEQ ID NO: 75310 - RNA, 23 nt, Artificial Sequence
  Oligomer
guaaagaagggagagauaugaag

SEQ ID NO: 75311 - RNA, 23 nt, Artificial Sequence
  Oligomer
uaaagaagggagagauaugaagc

SEQ ID NO: 75312 - RNA, 23 nt, Artificial Sequence
  Oligomer
uuucuuuaccggcaucacucucc

SEQ ID NO: 75313 - RNA, 23 nt, Artificial Sequence
  Oligomer
uucuuuaccggcaucacucuccu

SEQ ID NO: 75314 - RNA, 23 nt, Artificial Sequence
  Oligomer
ucuuuaccggcaucacucuccuc

SEQ ID NO: 75315 - RNA, 23 nt, Artificial Sequence
  Oligomer
cuuuaccggcaucacucuccucg

SEQ ID NO: 75316 - RNA, 23 nt, Artificial Sequence
  Oligomer
uuuaccggcaucacucuccucgc

SEQ ID NO: 75317 - RNA, 23 nt, Artificial Sequence
  Oligomer
agagauaugaagcagggagauaa

SEQ ID NO: 75318 - RNA, 23 nt, Artificial Sequence
  Oligomer
gagauaugaagcagggagauaag

SEQ ID NO: 75319 - RNA, 23 nt, Artificial Sequence
  Oligomer
agauaugaagcagggagauaagc

SEQ ID NO: 75320 - RNA, 23 nt, Artificial Sequence
  Oligomer
gauaugaagcagggagauaagcu

SEQ ID NO: 75321 - RNA, 23 nt, Artificial Sequence
  Oligomer
auaugaagcagggagauaagcua

SEQ ID NO: 75322 - RNA, 23 nt, Artificial Sequence
  Oligomer
agggagagauaugaagcagggag

SEQ ID NO: 75323 - RNA, 23 nt, Artificial Sequence
  Oligomer
gggagagauaugaagcagggaga

SEQ ID NO: 75324 - RNA, 23 nt, Artificial Sequence
  Oligomer
ggagagauaugaagcagggagau

SEQ ID NO: 75325 - RNA, 23 nt, Artificial Sequence
  Oligomer
gagagauaugaagcagggagaua

SEQ ID NO: 75326 - RNA, 23 nt, Artificial Sequence
  Oligomer
aaagaagggagagauaugaagca

SEQ ID NO: 75327 - RNA, 23 nt, Artificial Sequence
  Oligomer
uucucuugcauuuccugugcagu

SEQ ID NO: 75328 - RNA, 23 nt, Artificial Sequence
  Oligomer
aagaagggagagauaugaagcag

SEQ ID NO: 75329 - RNA, 23 nt, Artificial Sequence
  Oligomer
agaagggagagauaugaagcagg

SEQ ID NO: 75330 - RNA, 23 nt, Artificial Sequence
  Oligomer
gaagggagagauaugaagcaggg

SEQ ID NO: 75331 - RNA, 23 nt, Artificial Sequence
  Oligomer
uuccugugcagucuggucacaua

SEQ ID NO: 75332 - RNA, 23 nt, Artificial Sequence
  Oligomer
auaugaagugcagguugauugaa

SEQ ID NO: 75333 - RNA, 23 nt, Artificial Sequence
  Oligomer
uaugaagugcagguugauugaau

SEQ ID NO: 75334 - RNA, 23 nt, Artificial Sequence
  Oligomer
augaagugcagguugauugaaug

SEQ ID NO: 75335 - RNA, 23 nt, Artificial Sequence
  Oligomer
agucuuaaagaacagggaaguug

SEQ ID NO: 75336 - RNA, 23 nt, Artificial Sequence
  Oligomer
gucuuaaagaacagggaaguugg

SEQ ID NO: 75337 - RNA, 23 nt, Artificial Sequence
  Oligomer
ucuuaaagaacagggaaguuggg

SEQ ID NO: 75338 - RNA, 23 nt, Artificial Sequence
  Oligomer
cuuaaagaacagggaaguuggga

SEQ ID NO: 75339 - RNA, 23 nt, Artificial Sequence
  Oligomer
uuaaagaacagggaaguugggaa

SEQ ID NO: 75340 - RNA, 23 nt, Artificial Sequence
  Oligomer
accauucuuccuggccuucucug

SEQ ID NO: 75341 - RNA, 23 nt, Artificial Sequence
  Oligomer
ccauucuuccuggccuucucuga

SEQ ID NO: 75342 - RNA, 23 nt, Artificial Sequence
  Oligomer
cauucuuccuggccuucucugau

SEQ ID NO: 75343 - RNA, 23 nt, Artificial Sequence
  Oligomer
auucuuccuggccuucucugaug

SEQ ID NO: 75344 - RNA, 23 nt, Artificial Sequence
  Oligomer
uucuuccuggccuucucugaugc

SEQ ID NO: 75345 - RNA, 23 nt, Artificial Sequence
  Oligomer
caguauucagacaucuccuugca

SEQ ID NO: 75346 - RNA, 23 nt, Artificial Sequence
  Oligomer
aguauucagacaucuccuugcac

SEQ ID NO: 75347 - RNA, 23 nt, Artificial Sequence
  Oligomer
guauucagacaucuccuugcacc

SEQ ID NO: 75348 - RNA, 23 nt, Artificial Sequence
  Oligomer
uauucagacaucuccuugcaccg

SEQ ID NO: 75349 - RNA, 23 nt, Artificial Sequence
  Oligomer
auucagacaucuccuugcaccgg

SEQ ID NO: 75350 - RNA, 23 nt, Artificial Sequence
  Oligomer
uucagacaucuccuugcaccggu

SEQ ID NO: 75351 - RNA, 23 nt, Artificial Sequence
  Oligomer
ucagacaucuccuugcaccggug

SEQ ID NO: 75352 - RNA, 23 nt, Artificial Sequence
  Oligomer
aagguuggcuugccuucuucccu

SEQ ID NO: 75353 - RNA, 23 nt, Artificial Sequence
  Oligomer
agguuggcuugccuucuucccuc

SEQ ID NO: 75354 - RNA, 23 nt, Artificial Sequence
  Oligomer
gguuggcuugccuucuucccucu

SEQ ID NO: 75355 - RNA, 23 nt, Artificial Sequence
  Oligomer
guuggcuugccuucuucccucuu

SEQ ID NO: 75356 - RNA, 23 nt, Artificial Sequence
  Oligomer
uuggcuugccuucuucccucuuu

SEQ ID NO: 75357 - RNA, 23 nt, Artificial Sequence
  Oligomer
acacuugagcaagagccucgaug

SEQ ID NO: 75358 - RNA, 23 nt, Artificial Sequence
  Oligomer
cacuugagcaagagccucgaugu

SEQ ID NO: 75359 - RNA, 23 nt, Artificial Sequence
  Oligomer
acuugagcaagagccucgaugua

SEQ ID NO: 75360 - RNA, 23 nt, Artificial Sequence
  Oligomer
cuugagcaagagccucgauguac

SEQ ID NO: 75361 - RNA, 23 nt, Artificial Sequence
  Oligomer
uugagcaagagccucgauguacc

SEQ ID NO: 75362 - RNA, 23 nt, Artificial Sequence
  Oligomer
guucuuucucuccagugaagugc

SEQ ID NO: 75363 - RNA, 23 nt, Artificial Sequence
  Oligomer
uuuccaaggugaugauguccuuc

SEQ ID NO: 75364 - RNA, 23 nt, Artificial Sequence
  Oligomer
aggauucuagacagauuuggugg

SEQ ID NO: 75365 - RNA, 23 nt, Artificial Sequence
  Oligomer
auaguaagggagagagauggacg

SEQ ID NO: 75366 - RNA, 23 nt, Artificial Sequence
  Oligomer
uaguaagggagagagauggacgu

SEQ ID NO: 75367 - RNA, 23 nt, Artificial Sequence
  Oligomer
aguaagggagagagauggacguu

SEQ ID NO: 75368 - RNA, 23 nt, Artificial Sequence
  Oligomer
guaagggagagagauggacguuu

SEQ ID NO: 75369 - RNA, 23 nt, Artificial Sequence
  Oligomer
uaagggagagagauggacguuuc

SEQ ID NO: 75370 - RNA, 23 nt, Artificial Sequence
  Oligomer
uaaagaacagggaaguugggaag

SEQ ID NO: 75371 - RNA, 23 nt, Artificial Sequence
  Oligomer
aagggagagauaugaagcaggga

SEQ ID NO: 75372 - RNA, 23 nt, Artificial Sequence
  Oligomer
gguuacagagucuagggaaacac

SEQ ID NO: 75373 - RNA, 23 nt, Artificial Sequence
  Oligomer
guuacagagucuagggaaacaca

SEQ ID NO: 75374 - RNA, 23 nt, Artificial Sequence
  Oligomer
uuacagagucuagggaaacacac

SEQ ID NO: 75375 - RNA, 23 nt, Artificial Sequence
  Oligomer
ugaaaugaagguaaagaagggag

SEQ ID NO: 75376 - RNA, 23 nt, Artificial Sequence
  Oligomer
gaaaugaagguaaagaagggaga

SEQ ID NO: 75377 - RNA, 23 nt, Artificial Sequence
  Oligomer
aaaugaagguaaagaagggagag

SEQ ID NO: 75378 - RNA, 23 nt, Artificial Sequence
  Oligomer
aaugaagguaaagaagggagaga

SEQ ID NO: 75379 - RNA, 23 nt, Artificial Sequence
  Oligomer
augaagguaaagaagggagagau

SEQ ID NO: 75380 - RNA, 23 nt, Artificial Sequence
  Oligomer
ggaauaguaagggagagagaugg

SEQ ID NO: 75381 - RNA, 23 nt, Artificial Sequence
  Oligomer
gaauaguaagggagagagaugga

SEQ ID NO: 75382 - RNA, 23 nt, Artificial Sequence
  Oligomer
aauaguaagggagagagauggac

SEQ ID NO: 75383 - RNA, 23 nt, Artificial Sequence
  Oligomer
agaucuuugagacuuccaugggc

SEQ ID NO: 75384 - RNA, 23 nt, Artificial Sequence
  Oligomer
ggggaauuuauaugcccucuccc

SEQ ID NO: 75385 - RNA, 23 nt, Artificial Sequence
  Oligomer
gggaauuuauaugcccucucccc

SEQ ID NO: 75386 - RNA, 23 nt, Artificial Sequence
  Oligomer
ggaauuuauaugcccucucccca

SEQ ID NO: 75387 - RNA, 23 nt, Artificial Sequence
  Oligomer
gaauuuauaugcccucuccccau

SEQ ID NO: 75388 - RNA, 23 nt, Artificial Sequence
  Oligomer
aauuuauaugcccucuccccaua

SEQ ID NO: 75389 - RNA, 23 nt, Artificial Sequence
  Oligomer
caccuuccaaacucucacucuag

SEQ ID NO: 75390 - RNA, 23 nt, Artificial Sequence
  Oligomer
accuuccaaacucucacucuagg

SEQ ID NO: 75391 - RNA, 23 nt, Artificial Sequence
  Oligomer
ccuuccaaacucucacucuagga

SEQ ID NO: 75392 - RNA, 23 nt, Artificial Sequence
  Oligomer
cuuccaaacucucacucuaggac

SEQ ID NO: 75393 - RNA, 23 nt, Artificial Sequence
  Oligomer
uuccaaacucucacucuaggaca

SEQ ID NO: 75394 - RNA, 23 nt, Artificial Sequence
  Oligomer
cagcuguuuggcuagcaccacuc

SEQ ID NO: 75395 - RNA, 23 nt, Artificial Sequence
  Oligomer
agcuguuuggcuagcaccacucg

SEQ ID NO: 75396 - RNA, 23 nt, Artificial Sequence
  Oligomer
gcuguuuggcuagcaccacucgg

SEQ ID NO: 75397 - RNA, 23 nt, Artificial Sequence
  Oligomer
cuguuuggcuagcaccacucggu

SEQ ID NO: 75398 - RNA, 23 nt, Artificial Sequence
  Oligomer
uguuuggcuagcaccacucgguu

SEQ ID NO: 75399 - RNA, 23 nt, Artificial Sequence
  Oligomer
gccacauaauaucaaaggagagu

SEQ ID NO: 75400 - RNA, 23 nt, Artificial Sequence
  Oligomer
ccacauaauaucaaaggagaguu

SEQ ID NO: 75401 - RNA, 23 nt, Artificial Sequence
  Oligomer
cacauaauaucaaaggagaguuu

SEQ ID NO: 75402 - RNA, 23 nt, Artificial Sequence
  Oligomer
acauaauaucaaaggagaguuua

SEQ ID NO: 75403 - RNA, 23 nt, Artificial Sequence
  Oligomer
cauaauaucaaaggagaguuuaa

SEQ ID NO: 75404 - RNA, 23 nt, Artificial Sequence
  Oligomer
uuucucaggaaggaaaaagacag

SEQ ID NO: 75405 - RNA, 23 nt, Artificial Sequence
  Oligomer
uucucaggaaggaaaaagacaga

SEQ ID NO: 75406 - RNA, 23 nt, Artificial Sequence
  Oligomer
ucucaggaaggaaaaagacagag

SEQ ID NO: 75407 - RNA, 23 nt, Artificial Sequence
  Oligomer
cucaggaaggaaaaagacagaga

SEQ ID NO: 75408 - RNA, 23 nt, Artificial Sequence
  Oligomer
ucaggaaggaaaaagacagagag

SEQ ID NO: 75409 - RNA, 23 nt, Artificial Sequence
  Oligomer
agggaaacacaccauucuuccug

SEQ ID NO: 75410 - RNA, 23 nt, Artificial Sequence
  Oligomer
gggaaacacaccauucuuccugg

SEQ ID NO: 75411 - RNA, 23 nt, Artificial Sequence
  Oligomer
ggaaacacaccauucuuccuggc

SEQ ID NO: 75412 - RNA, 23 nt, Artificial Sequence
  Oligomer
gaaacacaccauucuuccuggcc

SEQ ID NO: 75413 - RNA, 23 nt, Artificial Sequence
  Oligomer
aaacacaccauucuuccuggccu

SEQ ID NO: 75414 - RNA, 23 nt, Artificial Sequence
  Oligomer
uggcuugccuucuucccucuuuu

SEQ ID NO: 75415 - RNA, 23 nt, Artificial Sequence
  Oligomer
ggcuugccuucuucccucuuuua

SEQ ID NO: 75416 - RNA, 23 nt, Artificial Sequence
  Oligomer
gcuugccuucuucccucuuuuau

SEQ ID NO: 75417 - RNA, 23 nt, Artificial Sequence
  Oligomer
cuugccuucuucccucuuuuauu

SEQ ID NO: 75418 - RNA, 23 nt, Artificial Sequence
  Oligomer
ucuuccuggccuucucugaugcu

SEQ ID NO: 75419 - RNA, 23 nt, Artificial Sequence
  Oligomer
cuuccuggccuucucugaugcuc

SEQ ID NO: 75420 - RNA, 23 nt, Artificial Sequence
  Oligomer
uuccuggccuucucugaugcucc

SEQ ID NO: 75421 - RNA, 23 nt, Artificial Sequence
  Oligomer
ucucuugcauuuccugugcaguc

SEQ ID NO: 75422 - RNA, 23 nt, Artificial Sequence
  Oligomer
cucuugcauuuccugugcagucu

SEQ ID NO: 75423 - RNA, 23 nt, Artificial Sequence
  Oligomer
ucuugcauuuccugugcagucug

SEQ ID NO: 75424 - RNA, 23 nt, Artificial Sequence
  Oligomer
ugaagguaaagaagggagagaua

SEQ ID NO: 75425 - RNA, 23 nt, Artificial Sequence
  Oligomer
gaagguaaagaagggagagauau

SEQ ID NO: 75426 - RNA, 23 nt, Artificial Sequence
  Oligomer
gucucuagucauguuugcuucuu

SEQ ID NO: 75427 - RNA, 23 nt, Artificial Sequence
  Oligomer
ucucuagucauguuugcuucuuc

SEQ ID NO: 75428 - RNA, 23 nt, Artificial Sequence
  Oligomer
aaauuuggacaccuuccaaacuc

SEQ ID NO: 75429 - RNA, 23 nt, Artificial Sequence
  Oligomer
aauuuggacaccuuccaaacucu

SEQ ID NO: 75430 - RNA, 23 nt, Artificial Sequence
  Oligomer
auuuggacaccuuccaaacucuc

SEQ ID NO: 75431 - RNA, 23 nt, Artificial Sequence
  Oligomer
uuuggacaccuuccaaacucuca

SEQ ID NO: 75432 - RNA, 23 nt, Artificial Sequence
  Oligomer
uuggacaccuuccaaacucucac

SEQ ID NO: 75433 - RNA, 23 nt, Artificial Sequence
  Oligomer
agucucaucuucggcaacuuuuc

SEQ ID NO: 75434 - RNA, 23 nt, Artificial Sequence
  Oligomer
gucucaucuucggcaacuuuucu

SEQ ID NO: 75435 - RNA, 23 nt, Artificial Sequence
  Oligomer
ucucaucuucggcaacuuuucuu

SEQ ID NO: 75436 - RNA, 23 nt, Artificial Sequence
  Oligomer
cucaucuucggcaacuuuucuuu

SEQ ID NO: 75437 - RNA, 23 nt, Artificial Sequence
  Oligomer
ucaucuucggcaacuuuucuuua

SEQ ID NO: 75438 - RNA, 23 nt, Artificial Sequence
  Oligomer
aagcuugaagagggugacuagag

SEQ ID NO: 75439 - RNA, 23 nt, Artificial Sequence
  Oligomer
agcuugaagagggugacuagagu

SEQ ID NO: 75440 - RNA, 23 nt, Artificial Sequence
  Oligomer
gcuugaagagggugacuagagua

SEQ ID NO: 75441 - RNA, 23 nt, Artificial Sequence
  Oligomer
uguauggcacugaaauaaaagcc

SEQ ID NO: 75442 - RNA, 23 nt, Artificial Sequence
  Oligomer
guauggcacugaaauaaaagcca

SEQ ID NO: 75443 - RNA, 23 nt, Artificial Sequence
  Oligomer
uauggcacugaaauaaaagccac

SEQ ID NO: 75444 - RNA, 23 nt, Artificial Sequence
  Oligomer
uaugaagcagggagauaagcuag

SEQ ID NO: 75445 - RNA, 23 nt, Artificial Sequence
  Oligomer
ccgcuucuggacacugcagcaag

SEQ ID NO: 75446 - RNA, 23 nt, Artificial Sequence
  Oligomer
cgcuucuggacacugcagcaagg

SEQ ID NO: 75447 - RNA, 23 nt, Artificial Sequence
  Oligomer
gcuucuggacacugcagcaaggu

SEQ ID NO: 75448 - RNA, 23 nt, Artificial Sequence
  Oligomer
cuucuggacacugcagcaaggug

SEQ ID NO: 75449 - RNA, 23 nt, Artificial Sequence
  Oligomer
uucuggacacugcagcaaggugc

SEQ ID NO: 75450 - RNA, 23 nt, Artificial Sequence
  Oligomer
aaccuucccgauccuugauaagu

SEQ ID NO: 75451 - RNA, 23 nt, Artificial Sequence
  Oligomer
ucccauccacaccauagauggcg

SEQ ID NO: 75452 - RNA, 23 nt, Artificial Sequence
  Oligomer
cccauccacaccauagauggcgc

SEQ ID NO: 75453 - RNA, 23 nt, Artificial Sequence
  Oligomer
ccauccacaccauagauggcgcc

SEQ ID NO: 75454 - RNA, 23 nt, Artificial Sequence
  Oligomer
cauccacaccauagauggcgccc

SEQ ID NO: 75455 - RNA, 23 nt, Artificial Sequence
  Oligomer
auccacaccauagauggcgcccu

SEQ ID NO: 75456 - RNA, 23 nt, Artificial Sequence
  Oligomer
ucacuaaagugccaucuacaaaa

SEQ ID NO: 75457 - RNA, 23 nt, Artificial Sequence
  Oligomer
ucucuccagugaagugcacauug

SEQ ID NO: 75458 - RNA, 23 nt, Artificial Sequence
  Oligomer
cucuccagugaagugcacauugc

SEQ ID NO: 75459 - RNA, 23 nt, Artificial Sequence
  Oligomer
ucuccagugaagugcacauugcu

SEQ ID NO: 75460 - RNA, 23 nt, Artificial Sequence
  Oligomer
cuccagugaagugcacauugcuc

SEQ ID NO: 75461 - RNA, 23 nt, Artificial Sequence
  Oligomer
uccagugaagugcacauugcuca

SEQ ID NO: 75462 - RNA, 23 nt, Artificial Sequence
  Oligomer
ucgauguaccaggaaccucguuu

SEQ ID NO: 75463 - RNA, 23 nt, Artificial Sequence
  Oligomer
augaagcagggagauaagcuagg

SEQ ID NO: 75464 - RNA, 23 nt, Artificial Sequence
  Oligomer
acauuacaucuuugagcauuuac

SEQ ID NO: 75465 - RNA, 23 nt, Artificial Sequence
  Oligomer
cauuacaucuuugagcauuuaca

SEQ ID NO: 75466 - RNA, 23 nt, Artificial Sequence
  Oligomer
auuacaucuuugagcauuuacau

SEQ ID NO: 75467 - RNA, 23 nt, Artificial Sequence
  Oligomer
acucucacucuaggacaaaaagg

SEQ ID NO: 75468 - RNA, 23 nt, Artificial Sequence
  Oligomer
ccuauaugccagcuggaagugug

SEQ ID NO: 75469 - RNA, 23 nt, Artificial Sequence
  Oligomer
cuauaugccagcuggaagugugu

SEQ ID NO: 75470 - RNA, 23 nt, Artificial Sequence
  Oligomer
uauaugccagcuggaaguguguu

SEQ ID NO: 75471 - RNA, 23 nt, Artificial Sequence
  Oligomer
auaugccagcuggaaguguguuu

SEQ ID NO: 75472 - RNA, 23 nt, Artificial Sequence
  Oligomer
uaugccagcuggaaguguguuug

SEQ ID NO: 75473 - RNA, 23 nt, Artificial Sequence
  Oligomer
uuaccggcaucacucuccucgca

SEQ ID NO: 75474 - RNA, 23 nt, Artificial Sequence
  Oligomer
uuuccaucuuguuggucaacccc

SEQ ID NO: 75475 - RNA, 23 nt, Artificial Sequence
  Oligomer
uuccaucuuguuggucaacccca

SEQ ID NO: 75476 - RNA, 23 nt, Artificial Sequence
  Oligomer
uccaucuuguuggucaaccccac

SEQ ID NO: 75477 - RNA, 23 nt, Artificial Sequence
  Oligomer
ugaagcagggagauaagcuagga

SEQ ID NO: 75478 - RNA, 23 nt, Artificial Sequence
  Oligomer
uaagguacaaaugcaaggcaaug

SEQ ID NO: 75479 - RNA, 23 nt, Artificial Sequence
  Oligomer
ccccuccagagcgaaauuccagu

SEQ ID NO: 75480 - RNA, 23 nt, Artificial Sequence
  Oligomer
cccuccagagcgaaauuccaguu

SEQ ID NO: 75481 - RNA, 23 nt, Artificial Sequence
  Oligomer
cucagacaucuuaacuaauguaa

SEQ ID NO: 75482 - RNA, 23 nt, Artificial Sequence
  Oligomer
uuguucuguaggcuugggcaguu

SEQ ID NO: 75483 - RNA, 23 nt, Artificial Sequence
  Oligomer
accgugcauccugaagaucaaag

SEQ ID NO: 75484 - RNA, 23 nt, Artificial Sequence
  Oligomer
ccgugcauccugaagaucaaagg

SEQ ID NO: 75485 - RNA, 23 nt, Artificial Sequence
  Oligomer
gacguuucucaggaaggaaaaag

SEQ ID NO: 75486 - RNA, 23 nt, Artificial Sequence
  Oligomer
acguuucucaggaaggaaaaaga

SEQ ID NO: 75487 - RNA, 23 nt, Artificial Sequence
  Oligomer
cguuucucaggaaggaaaaagac

SEQ ID NO: 75488 - RNA, 23 nt, Artificial Sequence
  Oligomer
guuucucaggaaggaaaaagaca

SEQ ID NO: 75489 - RNA, 23 nt, Artificial Sequence
  Oligomer
gucauguuugcuucuucagagcc

SEQ ID NO: 75490 - RNA, 23 nt, Artificial Sequence
  Oligomer
ucauguuugcuucuucagagcca

SEQ ID NO: 75491 - RNA, 23 nt, Artificial Sequence
  Oligomer
auggucucucagacaucuuaacu

SEQ ID NO: 75492 - RNA, 23 nt, Artificial Sequence
  Oligomer
uggucucucagacaucuuaacua

SEQ ID NO: 75493 - RNA, 23 nt, Artificial Sequence
  Oligomer
ccugaugaugaggaugcaugcca

SEQ ID NO: 75494 - RNA, 23 nt, Artificial Sequence
  Oligomer
cugaugaugaggaugcaugccac

SEQ ID NO: 75495 - RNA, 23 nt, Artificial Sequence
  Oligomer
accccucuuaggcagcaaguuga

SEQ ID NO: 75496 - RNA, 23 nt, Artificial Sequence
  Oligomer
ccccucuuaggcagcaaguugag

SEQ ID NO: 75497 - RNA, 23 nt, Artificial Sequence
  Oligomer
cccucuuaggcagcaaguugagg

SEQ ID NO: 75498 - RNA, 23 nt, Artificial Sequence
  Oligomer
caggauucuagacagauuuggug

SEQ ID NO: 75499 - RNA, 23 nt, Artificial Sequence
  Oligomer
agugcguucaccuuaaccagcau

SEQ ID NO: 75500 - RNA, 23 nt, Artificial Sequence
  Oligomer
gugcguucaccuuaaccagcaug

SEQ ID NO: 75501 - RNA, 23 nt, Artificial Sequence
  Oligomer
gcccaaacgagccaagagugucc

SEQ ID NO: 75502 - RNA, 23 nt, Artificial Sequence
  Oligomer
guuucagauaagcagggauaaag

SEQ ID NO: 75503 - RNA, 23 nt, Artificial Sequence
  Oligomer
uuucagauaagcagggauaaagg

SEQ ID NO: 75504 - RNA, 23 nt, Artificial Sequence
  Oligomer
ugaugaugaggaugcaugccaca

SEQ ID NO: 75505 - RNA, 23 nt, Artificial Sequence
  Oligomer
agccucgauguaccaggaaccuc

SEQ ID NO: 75506 - RNA, 23 nt, Artificial Sequence
  Oligomer
gccucgauguaccaggaaccucg

SEQ ID NO: 75507 - RNA, 23 nt, Artificial Sequence
  Oligomer
ccucgauguaccaggaaccucgu

SEQ ID NO: 75508 - RNA, 23 nt, Artificial Sequence
  Oligomer
cucgauguaccaggaaccucguu

SEQ ID NO: 75509 - RNA, 23 nt, Artificial Sequence
  Oligomer
augugagaacagacuggaggaag

SEQ ID NO: 75510 - RNA, 23 nt, Artificial Sequence
  Oligomer
ugugagaacagacuggaggaaga

SEQ ID NO: 75511 - RNA, 23 nt, Artificial Sequence
  Oligomer
uccaaacucucacucuaggacaa

SEQ ID NO: 75512 - RNA, 23 nt, Artificial Sequence
  Oligomer
ggccuggagucccacacucaaag

SEQ ID NO: 75513 - RNA, 23 nt, Artificial Sequence
  Oligomer
gccuggagucccacacucaaagg

SEQ ID NO: 75514 - RNA, 23 nt, Artificial Sequence
  Oligomer
ccuggagucccacacucaaaggc

SEQ ID NO: 75515 - RNA, 23 nt, Artificial Sequence
  Oligomer
cuggagucccacacucaaaggca

SEQ ID NO: 75516 - RNA, 23 nt, Artificial Sequence
  Oligomer
uggagucccacacucaaaggcag

SEQ ID NO: 75517 - RNA, 23 nt, Artificial Sequence
  Oligomer
uucacagaaaaggagcuggccug

SEQ ID NO: 75518 - RNA, 23 nt, Artificial Sequence
  Oligomer
cagauaagcagggauaaagguuu

SEQ ID NO: 75519 - RNA, 23 nt, Artificial Sequence
  Oligomer
uaaccuucccgauccuugauaag

SEQ ID NO: 75520 - RNA, 23 nt, Artificial Sequence
  Oligomer
aacagaaaccgugcauccugaag

SEQ ID NO: 75521 - RNA, 23 nt, Artificial Sequence
  Oligomer
ggacuuggcagcaaggcucacaa

SEQ ID NO: 75522 - RNA, 23 nt, Artificial Sequence
  Oligomer
gacuuggcagcaaggcucacaaa

SEQ ID NO: 75523 - RNA, 23 nt, Artificial Sequence
  Oligomer
acuuggcagcaaggcucacaaac

SEQ ID NO: 75524 - RNA, 23 nt, Artificial Sequence
  Oligomer
cuuggcagcaaggcucacaaacc

SEQ ID NO: 75525 - RNA, 23 nt, Artificial Sequence
  Oligomer
uuggcagcaaggcucacaaacca

SEQ ID NO: 75526 - RNA, 23 nt, Artificial Sequence
  Oligomer
ugggaguggaaagguucucucuc

SEQ ID NO: 75527 - RNA, 23 nt, Artificial Sequence
  Oligomer
ggcauagccgcauaucaugucug

SEQ ID NO: 75528 - RNA, 23 nt, Artificial Sequence
  Oligomer
gcauagccgcauaucaugucuga

SEQ ID NO: 75529 - RNA, 23 nt, Artificial Sequence
  Oligomer
cauagccgcauaucaugucugag

SEQ ID NO: 75530 - RNA, 23 nt, Artificial Sequence
  Oligomer
auagccgcauaucaugucugagc

SEQ ID NO: 75531 - RNA, 23 nt, Artificial Sequence
  Oligomer
uagccgcauaucaugucugagcg

SEQ ID NO: 75532 - RNA, 23 nt, Artificial Sequence
  Oligomer
uacagagucuagggaaacacacc

SEQ ID NO: 75533 - RNA, 23 nt, Artificial Sequence
  Oligomer
uggacaccuuccaaacucucacu

SEQ ID NO: 75534 - RNA, 23 nt, Artificial Sequence
  Oligomer
ggacaccuuccaaacucucacuc

SEQ ID NO: 75535 - RNA, 23 nt, Artificial Sequence
  Oligomer
gacaccuuccaaacucucacucu

SEQ ID NO: 75536 - RNA, 23 nt, Artificial Sequence
  Oligomer
acaccuuccaaacucucacucua

SEQ ID NO: 75537 - RNA, 23 nt, Artificial Sequence
  Oligomer
gaccccucuuaggcagcaaguug

SEQ ID NO: 75538 - RNA, 23 nt, Artificial Sequence
  Oligomer
guugucaaagagcugaaaaaccu

SEQ ID NO: 75539 - RNA, 23 nt, Artificial Sequence
  Oligomer
uugucaaagagcugaaaaaccuc

SEQ ID NO: 75540 - RNA, 23 nt, Artificial Sequence
  Oligomer
ugucaaagagcugaaaaaccucu

SEQ ID NO: 75541 - RNA, 23 nt, Artificial Sequence
  Oligomer
gucaaagagcugaaaaaccucuu

SEQ ID NO: 75542 - RNA, 23 nt, Artificial Sequence
  Oligomer
ucaaagagcugaaaaaccucuug

SEQ ID NO: 75543 - RNA, 23 nt, Artificial Sequence
  Oligomer
ccucuuggagcuggagcaguuuc

SEQ ID NO: 75544 - RNA, 23 nt, Artificial Sequence
  Oligomer
cucuuggagcuggagcaguuucc

SEQ ID NO: 75545 - RNA, 23 nt, Artificial Sequence
  Oligomer
ucuuggagcuggagcaguuuccc

SEQ ID NO: 75546 - RNA, 23 nt, Artificial Sequence
  Oligomer
cuuggagcuggagcaguuuccca

SEQ ID NO: 75547 - RNA, 23 nt, Artificial Sequence
  Oligomer
uuggagcuggagcaguuucccau

SEQ ID NO: 75548 - RNA, 23 nt, Artificial Sequence
  Oligomer
auucugugccaggagcauaaccu

SEQ ID NO: 75549 - RNA, 23 nt, Artificial Sequence
  Oligomer
uucugugccaggagcauaaccuu

SEQ ID NO: 75550 - RNA, 23 nt, Artificial Sequence
  Oligomer
ucugugccaggagcauaaccuuc

SEQ ID NO: 75551 - RNA, 23 nt, Artificial Sequence
  Oligomer
cugugccaggagcauaaccuucc

SEQ ID NO: 75552 - RNA, 23 nt, Artificial Sequence
  Oligomer
ugugccaggagcauaaccuuccc

SEQ ID NO: 75553 - RNA, 23 nt, Artificial Sequence
  Oligomer
gaaagagaaagcaggaacaaaga

SEQ ID NO: 75554 - RNA, 23 nt, Artificial Sequence
  Oligomer
auaauaauccguguauauuguca

SEQ ID NO: 75555 - RNA, 23 nt, Artificial Sequence
  Oligomer
uaauaauccguguauauugucaa

SEQ ID NO: 75556 - RNA, 23 nt, Artificial Sequence
  Oligomer
aauaauccguguauauugucaaa

SEQ ID NO: 75557 - RNA, 23 nt, Artificial Sequence
  Oligomer
auaauccguguauauugucaaaa

SEQ ID NO: 75558 - RNA, 23 nt, Artificial Sequence
  Oligomer
uaauccguguauauugucaaaag

SEQ ID NO: 75559 - RNA, 23 nt, Artificial Sequence
  Oligomer
ccgauccuugauaagugcguuca

SEQ ID NO: 75560 - RNA, 23 nt, Artificial Sequence
  Oligomer
cgauccuugauaagugcguucac

SEQ ID NO: 75561 - RNA, 23 nt, Artificial Sequence
  Oligomer
gauccuugauaagugcguucacc

SEQ ID NO: 75562 - RNA, 23 nt, Artificial Sequence
  Oligomer
caggagcauaaccuucccgaucc

SEQ ID NO: 75563 - RNA, 23 nt, Artificial Sequence
  Oligomer
aggagcauaaccuucccgauccu

SEQ ID NO: 75564 - RNA, 23 nt, Artificial Sequence
  Oligomer
ggagcauaaccuucccgauccuu

SEQ ID NO: 75565 - RNA, 23 nt, Artificial Sequence
  Oligomer
aggcucuaucacaccuccugugg

SEQ ID NO: 75566 - RNA, 23 nt, Artificial Sequence
  Oligomer
ggcucuaucacaccuccuguggu

SEQ ID NO: 75567 - RNA, 23 nt, Artificial Sequence
  Oligomer
gcucuaucacaccuccugugguc

SEQ ID NO: 75568 - RNA, 23 nt, Artificial Sequence
  Oligomer
cucuaucacaccuccuguggucc

SEQ ID NO: 75569 - RNA, 23 nt, Artificial Sequence
  Oligomer
ucuaucacaccuccuguggucca

SEQ ID NO: 75570 - RNA, 23 nt, Artificial Sequence
  Oligomer
ggccuagcauuuugcuagggacc

SEQ ID NO: 75571 - RNA, 23 nt, Artificial Sequence
  Oligomer
gccuagcauuuugcuagggacca

SEQ ID NO: 75572 - RNA, 23 nt, Artificial Sequence
  Oligomer
ccuagcauuuugcuagggaccau

SEQ ID NO: 75573 - RNA, 23 nt, Artificial Sequence
  Oligomer
cuagcauuuugcuagggaccaug

SEQ ID NO: 75574 - RNA, 23 nt, Artificial Sequence
  Oligomer
ugagacuuccaugggcaaagauc

SEQ ID NO: 75575 - RNA, 23 nt, Artificial Sequence
  Oligomer
gagacuuccaugggcaaagauca

SEQ ID NO: 75576 - RNA, 23 nt, Artificial Sequence
  Oligomer
gacuuccaugggcaaagaucaau

SEQ ID NO: 75577 - RNA, 23 nt, Artificial Sequence
  Oligomer
acuuccaugggcaaagaucaaua

SEQ ID NO: 75578 - RNA, 23 nt, Artificial Sequence
  Oligomer
cgugguucuuuccaucuuguugg

SEQ ID NO: 75579 - RNA, 23 nt, Artificial Sequence
  Oligomer
gugguucuuuccaucuuguuggu

SEQ ID NO: 75580 - RNA, 23 nt, Artificial Sequence
  Oligomer
ugguucuuuccaucuuguugguc

SEQ ID NO: 75581 - RNA, 23 nt, Artificial Sequence
  Oligomer
gagaacagacuggaggaagaaag

SEQ ID NO: 75582 - RNA, 23 nt, Artificial Sequence
  Oligomer
agaacagacuggaggaagaaaga

SEQ ID NO: 75583 - RNA, 23 nt, Artificial Sequence
  Oligomer
gaacagacuggaggaagaaagaa

SEQ ID NO: 75584 - RNA, 23 nt, Artificial Sequence
  Oligomer
aacagacuggaggaagaaagaau

SEQ ID NO: 75585 - RNA, 23 nt, Artificial Sequence
  Oligomer
acagacuggaggaagaaagaaug

SEQ ID NO: 75586 - RNA, 23 nt, Artificial Sequence
  Oligomer
guacaaaugcaaggcaauguugg

SEQ ID NO: 75587 - RNA, 23 nt, Artificial Sequence
  Oligomer
uacaaaugcaaggcaauguuggc

SEQ ID NO: 75588 - RNA, 23 nt, Artificial Sequence
  Oligomer
acaaaugcaaggcaauguuggcu

SEQ ID NO: 75589 - RNA, 23 nt, Artificial Sequence
  Oligomer
caaaugcaaggcaauguuggcug

SEQ ID NO: 75590 - RNA, 23 nt, Artificial Sequence
  Oligomer
aaaugcaaggcaauguuggcuga

SEQ ID NO: 75591 - RNA, 23 nt, Artificial Sequence
  Oligomer
gugcuucacagaaggcaucaaaa

SEQ ID NO: 75592 - RNA, 23 nt, Artificial Sequence
  Oligomer
ugcuucacagaaggcaucaaaag

SEQ ID NO: 75593 - RNA, 23 nt, Artificial Sequence
  Oligomer
gcuucacagaaggcaucaaaagc

SEQ ID NO: 75594 - RNA, 23 nt, Artificial Sequence
  Oligomer
aaggugcgucucuagucauguuu

SEQ ID NO: 75595 - RNA, 23 nt, Artificial Sequence
  Oligomer
aggugcgucucuagucauguuug

SEQ ID NO: 75596 - RNA, 23 nt, Artificial Sequence
  Oligomer
cuugguacaugauggugaauaaa

SEQ ID NO: 75597 - RNA, 23 nt, Artificial Sequence
  Oligomer
uugguacaugauggugaauaaaa

SEQ ID NO: 75598 - RNA, 23 nt, Artificial Sequence
  Oligomer
ugguacaugauggugaauaaaac

SEQ ID NO: 75599 - RNA, 23 nt, Artificial Sequence
  Oligomer
cuggaugagcucccucauuucca

SEQ ID NO: 75600 - RNA, 23 nt, Artificial Sequence
  Oligomer
uggaugagcucccucauuuccaa

SEQ ID NO: 75601 - RNA, 23 nt, Artificial Sequence
  Oligomer
ggaugagcucccucauuuccaag

SEQ ID NO: 75602 - RNA, 23 nt, Artificial Sequence
  Oligomer
gaugagcucccucauuuccaagg

SEQ ID NO: 75603 - RNA, 23 nt, Artificial Sequence
  Oligomer
augagcucccucauuuccaaggu

SEQ ID NO: 75604 - RNA, 23 nt, Artificial Sequence
  Oligomer
aagguacaaaugcaaggcaaugu

SEQ ID NO: 75605 - RNA, 23 nt, Artificial Sequence
  Oligomer
agguacaaaugcaaggcaauguu

SEQ ID NO: 75606 - RNA, 23 nt, Artificial Sequence
  Oligomer
gguacaaaugcaaggcaauguug

SEQ ID NO: 75607 - RNA, 23 nt, Artificial Sequence
  Oligomer
ugccacacacucccaauauccug

SEQ ID NO: 75608 - RNA, 23 nt, Artificial Sequence
  Oligomer
agauaggagauggucucucagac

SEQ ID NO: 75609 - RNA, 23 nt, Artificial Sequence
  Oligomer
gauaggagauggucucucagaca

SEQ ID NO: 75610 - RNA, 23 nt, Artificial Sequence
  Oligomer
auaggagauggucucucagacau

SEQ ID NO: 75611 - RNA, 23 nt, Artificial Sequence
  Oligomer
agagagauggacguuucucagga

SEQ ID NO: 75612 - RNA, 23 nt, Artificial Sequence
  Oligomer
gagagauggacguuucucaggaa

SEQ ID NO: 75613 - RNA, 23 nt, Artificial Sequence
  Oligomer
agagauggacguuucucaggaag

SEQ ID NO: 75614 - RNA, 23 nt, Artificial Sequence
  Oligomer
gagauggacguuucucaggaagg

SEQ ID NO: 75615 - RNA, 23 nt, Artificial Sequence
  Oligomer
agauggacguuucucaggaagga

SEQ ID NO: 75616 - RNA, 23 nt, Artificial Sequence
  Oligomer
ugaaugaaagugggaauaguaag

SEQ ID NO: 75617 - RNA, 23 nt, Artificial Sequence
  Oligomer
auggcacugaaauaaaagccaca

SEQ ID NO: 75618 - RNA, 23 nt, Artificial Sequence
  Oligomer
agggagagagauggacguuucuc

SEQ ID NO: 75619 - RNA, 23 nt, Artificial Sequence
  Oligomer
gggagagagauggacguuucuca

SEQ ID NO: 75620 - RNA, 23 nt, Artificial Sequence
  Oligomer
ggagagagauggacguuucucag

SEQ ID NO: 75621 - RNA, 23 nt, Artificial Sequence
  Oligomer
gagagagauggacguuucucagg

SEQ ID NO: 75622 - RNA, 23 nt, Artificial Sequence
  Oligomer
guuaucucacacaugauaugucu

SEQ ID NO: 75623 - RNA, 23 nt, Artificial Sequence
  Oligomer
uuaucucacacaugauaugucuu

SEQ ID NO: 75624 - RNA, 23 nt, Artificial Sequence
  Oligomer
agugcacauugcucaacaccagu

SEQ ID NO: 75625 - RNA, 23 nt, Artificial Sequence
  Oligomer
gugcacauugcucaacaccagug

SEQ ID NO: 75626 - RNA, 23 nt, Artificial Sequence
  Oligomer
ugcacauugcucaacaccagugc

SEQ ID NO: 75627 - RNA, 23 nt, Artificial Sequence
  Oligomer
agcuaagguuggcuugccuucuu

SEQ ID NO: 75628 - RNA, 23 nt, Artificial Sequence
  Oligomer
gcuaagguuggcuugccuucuuc

SEQ ID NO: 75629 - RNA, 23 nt, Artificial Sequence
  Oligomer
cuaagguuggcuugccuucuucc

SEQ ID NO: 75630 - RNA, 23 nt, Artificial Sequence
  Oligomer
uaagguuggcuugccuucuuccc

SEQ ID NO: 75631 - RNA, 23 nt, Artificial Sequence
  Oligomer
cuggagcaguuucccauccacac

SEQ ID NO: 75632 - RNA, 23 nt, Artificial Sequence
  Oligomer
uggagcaguuucccauccacacc

SEQ ID NO: 75633 - RNA, 23 nt, Artificial Sequence
  Oligomer
ugccaagcacuugguacaugaug

SEQ ID NO: 75634 - RNA, 23 nt, Artificial Sequence
  Oligomer
aguuuaauacugaaagagaaagc

SEQ ID NO: 75635 - RNA, 23 nt, Artificial Sequence
  Oligomer
auccugcgugguucuuuccaucu

SEQ ID NO: 75636 - RNA, 23 nt, Artificial Sequence
  Oligomer
uccugcgugguucuuuccaucuu

SEQ ID NO: 75637 - RNA, 23 nt, Artificial Sequence
  Oligomer
ccugcgugguucuuuccaucuug

SEQ ID NO: 75638 - RNA, 23 nt, Artificial Sequence
  Oligomer
cugcgugguucuuuccaucuugu

SEQ ID NO: 75639 - RNA, 23 nt, Artificial Sequence
  Oligomer
ugcgugguucuuuccaucuuguu

SEQ ID NO: 75640 - RNA, 23 nt, Artificial Sequence
  Oligomer
aggcucacaaaccacccaaacaa

SEQ ID NO: 75641 - RNA, 23 nt, Artificial Sequence
  Oligomer
ggcucacaaaccacccaaacaaa

SEQ ID NO: 75642 - RNA, 23 nt, Artificial Sequence
  Oligomer
gcucacaaaccacccaaacaaau

SEQ ID NO: 75643 - RNA, 23 nt, Artificial Sequence
  Oligomer
cucacaaaccacccaaacaaaua

SEQ ID NO: 75644 - RNA, 23 nt, Artificial Sequence
  Oligomer
cugugcaaaauucugcaguuucu

SEQ ID NO: 75645 - RNA, 23 nt, Artificial Sequence
  Oligomer
ugugcaaaauucugcaguuucuc

SEQ ID NO: 75646 - RNA, 23 nt, Artificial Sequence
  Oligomer
augaugaggaugcaugccacaca

SEQ ID NO: 75647 - RNA, 23 nt, Artificial Sequence
  Oligomer
ugaugaggaugcaugccacacac

SEQ ID NO: 75648 - RNA, 23 nt, Artificial Sequence
  Oligomer
gaugaggaugcaugccacacacu

SEQ ID NO: 75649 - RNA, 23 nt, Artificial Sequence
  Oligomer
augaggaugcaugccacacacuc

SEQ ID NO: 75650 - RNA, 23 nt, Artificial Sequence
  Oligomer
ugaggaugcaugccacacacucc

SEQ ID NO: 75651 - RNA, 23 nt, Artificial Sequence
  Oligomer
augucuucaaggagcuaaaaaug

SEQ ID NO: 75652 - RNA, 23 nt, Artificial Sequence
  Oligomer
ccccacgaucagucucaucucca

SEQ ID NO: 75653 - RNA, 23 nt, Artificial Sequence
  Oligomer
cccacgaucagucucaucuccac

SEQ ID NO: 75654 - RNA, 23 nt, Artificial Sequence
  Oligomer
ccacgaucagucucaucuccacg

SEQ ID NO: 75655 - RNA, 23 nt, Artificial Sequence
  Oligomer
ggaauucugugccaggagcauaa

SEQ ID NO: 75656 - RNA, 23 nt, Artificial Sequence
  Oligomer
gaauucugugccaggagcauaac

SEQ ID NO: 75657 - RNA, 23 nt, Artificial Sequence
  Oligomer
aauucugugccaggagcauaacc

SEQ ID NO: 75658 - RNA, 23 nt, Artificial Sequence
  Oligomer
auuccuggcaauagguccaacca

SEQ ID NO: 75659 - RNA, 23 nt, Artificial Sequence
  Oligomer
gggaauaguaagggagagagaug

SEQ ID NO: 75660 - RNA, 23 nt, Artificial Sequence
  Oligomer
uggcacugaaauaaaagccacau

SEQ ID NO: 75661 - RNA, 23 nt, Artificial Sequence
  Oligomer
ucacagaaaaggagcuggccugg

SEQ ID NO: 75662 - RNA, 23 nt, Artificial Sequence
  Oligomer
ugauguccuucuccagaagaugu

SEQ ID NO: 75663 - RNA, 23 nt, Artificial Sequence
  Oligomer
gauguccuucuccagaagauguu

SEQ ID NO: 75664 - RNA, 23 nt, Artificial Sequence
  Oligomer
auguccuucuccagaagauguuc

SEQ ID NO: 75665 - RNA, 23 nt, Artificial Sequence
  Oligomer
uguccuucuccagaagauguucu

SEQ ID NO: 75666 - RNA, 23 nt, Artificial Sequence
  Oligomer
ucucaaauacuuccauacuaugu

SEQ ID NO: 75667 - RNA, 23 nt, Artificial Sequence
  Oligomer
aacaauaacauguauggcacuga

SEQ ID NO: 75668 - RNA, 23 nt, Artificial Sequence
  Oligomer
acaauaacauguauggcacugaa

SEQ ID NO: 75669 - RNA, 23 nt, Artificial Sequence
  Oligomer
caauaacauguauggcacugaaa

SEQ ID NO: 75670 - RNA, 23 nt, Artificial Sequence
  Oligomer
aauaacauguauggcacugaaau

SEQ ID NO: 75671 - RNA, 23 nt, Artificial Sequence
  Oligomer
acaagguuucugcccucauuuac

SEQ ID NO: 75672 - RNA, 23 nt, Artificial Sequence
  Oligomer
caagguuucugcccucauuuaca

SEQ ID NO: 75673 - RNA, 23 nt, Artificial Sequence
  Oligomer
gaugaugggcacaggaaacaagu

SEQ ID NO: 75674 - RNA, 23 nt, Artificial Sequence
  Oligomer
augaugggcacaggaaacaaguc

SEQ ID NO: 75675 - RNA, 23 nt, Artificial Sequence
  Oligomer
ugaugggcacaggaaacaagucu

SEQ ID NO: 75676 - RNA, 23 nt, Artificial Sequence
  Oligomer
gaugggcacaggaaacaagucug

SEQ ID NO: 75677 - RNA, 23 nt, Artificial Sequence
  Oligomer
augggcacaggaaacaagucugg

SEQ ID NO: 75678 - RNA, 23 nt, Artificial Sequence
  Oligomer
gaccaugggagaugugaaggaag

SEQ ID NO: 75679 - RNA, 23 nt, Artificial Sequence
  Oligomer
accaugggagaugugaaggaagu

SEQ ID NO: 75680 - RNA, 23 nt, Artificial Sequence
  Oligomer
ccaugggagaugugaaggaaguu

SEQ ID NO: 75681 - RNA, 23 nt, Artificial Sequence
  Oligomer
caugggagaugugaaggaaguua

SEQ ID NO: 75682 - RNA, 23 nt, Artificial Sequence
  Oligomer
augggagaugugaaggaaguuau

SEQ ID NO: 75683 - RNA, 23 nt, Artificial Sequence
  Oligomer
aggauuguagcuaagguuggcuu

SEQ ID NO: 75684 - RNA, 23 nt, Artificial Sequence
  Oligomer
gggcuggagcuuagcaagaaauc

SEQ ID NO: 75685 - RNA, 23 nt, Artificial Sequence
  Oligomer
ggcuggagcuuagcaagaaauca

SEQ ID NO: 75686 - RNA, 23 nt, Artificial Sequence
  Oligomer
caaaguacaaauaauaauccgug

SEQ ID NO: 75687 - RNA, 23 nt, Artificial Sequence
  Oligomer
aaaguacaaauaauaauccgugu

SEQ ID NO: 75688 - RNA, 23 nt, Artificial Sequence
  Oligomer
aaguacaaauaauaauccgugua

SEQ ID NO: 75689 - RNA, 23 nt, Artificial Sequence
  Oligomer
aguacaaauaauaauccguguau

SEQ ID NO: 75690 - RNA, 23 nt, Artificial Sequence
  Oligomer
guacaaauaauaauccguguaua

SEQ ID NO: 75691 - RNA, 23 nt, Artificial Sequence
  Oligomer
agagcugaaaaaccucuuggagc

SEQ ID NO: 75692 - RNA, 23 nt, Artificial Sequence
  Oligomer
gagcugaaaaaccucuuggagcu

SEQ ID NO: 75693 - RNA, 23 nt, Artificial Sequence
  Oligomer
agcugaaaaaccucuuggagcug

SEQ ID NO: 75694 - RNA, 23 nt, Artificial Sequence
  Oligomer
caagucugggagauucccacauc

SEQ ID NO: 75695 - RNA, 23 nt, Artificial Sequence
  Oligomer
aagucugggagauucccacaucc

SEQ ID NO: 75696 - RNA, 23 nt, Artificial Sequence
  Oligomer
agucugggagauucccacauccc

SEQ ID NO: 75697 - RNA, 23 nt, Artificial Sequence
  Oligomer
gucugggagauucccacaucccu

SEQ ID NO: 75698 - RNA, 23 nt, Artificial Sequence
  Oligomer
ucugggagauucccacaucccug

SEQ ID NO: 75699 - RNA, 23 nt, Artificial Sequence
  Oligomer
ugcaccgguggaauucugugcca

SEQ ID NO: 75700 - RNA, 23 nt, Artificial Sequence
  Oligomer
gcauaucacaagcccgcucagaa

SEQ ID NO: 75701 - RNA, 23 nt, Artificial Sequence
  Oligomer
cauaucacaagcccgcucagaaa

SEQ ID NO: 75702 - RNA, 23 nt, Artificial Sequence
  Oligomer
auaucacaagcccgcucagaaaa

SEQ ID NO: 75703 - RNA, 23 nt, Artificial Sequence
  Oligomer
uaucacaagcccgcucagaaaac

SEQ ID NO: 75704 - RNA, 23 nt, Artificial Sequence
  Oligomer
aucacaagcccgcucagaaaaca

SEQ ID NO: 75705 - RNA, 23 nt, Artificial Sequence
  Oligomer
gaugaugaggaugcaugccacac

SEQ ID NO: 75706 - RNA, 23 nt, Artificial Sequence
  Oligomer
uggcuuccacuuggcguggauga

SEQ ID NO: 75707 - RNA, 23 nt, Artificial Sequence
  Oligomer
ggcuuccacuuggcguggaugau

SEQ ID NO: 75708 - RNA, 23 nt, Artificial Sequence
  Oligomer
gcuuccacuuggcguggaugaug

SEQ ID NO: 75709 - RNA, 23 nt, Artificial Sequence
  Oligomer
cuuccacuuggcguggaugaugg

SEQ ID NO: 75710 - RNA, 23 nt, Artificial Sequence
  Oligomer
uuccacuuggcguggaugauggg

SEQ ID NO: 75711 - RNA, 23 nt, Artificial Sequence
  Oligomer
aaacaaccaacgaaagaucuuug

SEQ ID NO: 75712 - RNA, 23 nt, Artificial Sequence
  Oligomer
aacaaccaacgaaagaucuuuga

SEQ ID NO: 75713 - RNA, 23 nt, Artificial Sequence
  Oligomer
acaaccaacgaaagaucuuugag

SEQ ID NO: 75714 - RNA, 23 nt, Artificial Sequence
  Oligomer
caaccaacgaaagaucuuugaga

SEQ ID NO: 75715 - RNA, 23 nt, Artificial Sequence
  Oligomer
aaccaacgaaagaucuuugagac

SEQ ID NO: 75716 - RNA, 23 nt, Artificial Sequence
  Oligomer
caaccccacgaucagucucaucu

SEQ ID NO: 75717 - RNA, 23 nt, Artificial Sequence
  Oligomer
aaccccacgaucagucucaucuc

SEQ ID NO: 75718 - RNA, 23 nt, Artificial Sequence
  Oligomer
accccacgaucagucucaucucc

SEQ ID NO: 75719 - RNA, 23 nt, Artificial Sequence
  Oligomer
caccauucuuccuggccuucucu

SEQ ID NO: 75720 - RNA, 23 nt, Artificial Sequence
  Oligomer
uaggagauggucucucagacauc

SEQ ID NO: 75721 - RNA, 23 nt, Artificial Sequence
  Oligomer
ccgcauaucaugucugagcgcgu

SEQ ID NO: 75722 - RNA, 23 nt, Artificial Sequence
  Oligomer
cgcauaucaugucugagcgcgug

SEQ ID NO: 75723 - RNA, 23 nt, Artificial Sequence
  Oligomer
gcauaucaugucugagcgcgugg

SEQ ID NO: 75724 - RNA, 23 nt, Artificial Sequence
  Oligomer
cauaucaugucugagcgcguggg

SEQ ID NO: 75725 - RNA, 23 nt, Artificial Sequence
  Oligomer
auaucaugucugagcgcgugggc

SEQ ID NO: 75726 - RNA, 23 nt, Artificial Sequence
  Oligomer
guuccacauucuggcugaaacug

SEQ ID NO: 75727 - RNA, 23 nt, Artificial Sequence
  Oligomer
caugccacacacucccaauaucc

SEQ ID NO: 75728 - RNA, 23 nt, Artificial Sequence
  Oligomer
augccacacacucccaauauccu

SEQ ID NO: 75729 - RNA, 23 nt, Artificial Sequence
  Oligomer
gauggacguuucucaggaaggaa

SEQ ID NO: 75730 - RNA, 23 nt, Artificial Sequence
  Oligomer
auggacguuucucaggaaggaaa

SEQ ID NO: 75731 - RNA, 23 nt, Artificial Sequence
  Oligomer
ugcauaucacaagcccgcucaga

SEQ ID NO: 75732 - RNA, 23 nt, Artificial Sequence
  Oligomer
cuucuucagagccaaaagauaau

SEQ ID NO: 75733 - RNA, 23 nt, Artificial Sequence
  Oligomer
cgaggcucauuucaguaacaaag

SEQ ID NO: 75734 - RNA, 23 nt, Artificial Sequence
  Oligomer
augaaaugaagguaaagaaggga

SEQ ID NO: 75735 - RNA, 23 nt, Artificial Sequence
  Oligomer
ucagauaagcagggauaaagguu

SEQ ID NO: 75736 - RNA, 23 nt, Artificial Sequence
  Oligomer
gaacagggaaguugggaaguuuc

SEQ ID NO: 75737 - RNA, 23 nt, Artificial Sequence
  Oligomer
aacagggaaguugggaaguuuca

SEQ ID NO: 75738 - RNA, 23 nt, Artificial Sequence
  Oligomer
acagggaaguugggaaguuucag

SEQ ID NO: 75739 - RNA, 23 nt, Artificial Sequence
  Oligomer
cagggaaguugggaaguuucaga

SEQ ID NO: 75740 - RNA, 23 nt, Artificial Sequence
  Oligomer
augugccaagcacuugguacaug

SEQ ID NO: 75741 - RNA, 23 nt, Artificial Sequence
  Oligomer
ugugccaagcacuugguacauga

SEQ ID NO: 75742 - RNA, 23 nt, Artificial Sequence
  Oligomer
ugauugaaugaaagugggaauag

SEQ ID NO: 75743 - RNA, 23 nt, Artificial Sequence
  Oligomer
gauugaaugaaagugggaauagu

SEQ ID NO: 75744 - RNA, 23 nt, Artificial Sequence
  Oligomer
auugaaugaaagugggaauagua

SEQ ID NO: 75745 - RNA, 23 nt, Artificial Sequence
  Oligomer
uugaaugaaagugggaauaguaa

SEQ ID NO: 75746 - RNA, 23 nt, Artificial Sequence
  Oligomer
ggggauccugcgugguucuuucc

SEQ ID NO: 75747 - RNA, 23 nt, Artificial Sequence
  Oligomer
gggauccugcgugguucuuucca

SEQ ID NO: 75748 - RNA, 23 nt, Artificial Sequence
  Oligomer
ggauccugcgugguucuuuccau

SEQ ID NO: 75749 - RNA, 23 nt, Artificial Sequence
  Oligomer
gauccugcgugguucuuuccauc

SEQ ID NO: 75750 - RNA, 23 nt, Artificial Sequence
  Oligomer
gugccaggagcauaaccuucccg

SEQ ID NO: 75751 - RNA, 23 nt, Artificial Sequence
  Oligomer
ugccaggagcauaaccuucccga

SEQ ID NO: 75752 - RNA, 23 nt, Artificial Sequence
  Oligomer
cuacaaaagcuggaacugaacac

SEQ ID NO: 75753 - RNA, 23 nt, Artificial Sequence
  Oligomer
uacaaaagcuggaacugaacaca

SEQ ID NO: 75754 - RNA, 23 nt, Artificial Sequence
  Oligomer
acaaaagcuggaacugaacacaa

SEQ ID NO: 75755 - RNA, 23 nt, Artificial Sequence
  Oligomer
caaaagcuggaacugaacacaaa

SEQ ID NO: 75756 - RNA, 23 nt, Artificial Sequence
  Oligomer
aaaagcuggaacugaacacaaau

SEQ ID NO: 75757 - RNA, 23 nt, Artificial Sequence
  Oligomer
cuuccaugggcaaagaucaauaa

SEQ ID NO: 75758 - RNA, 23 nt, Artificial Sequence
  Oligomer
uggaaagguucucucucucaaau

SEQ ID NO: 75759 - RNA, 23 nt, Artificial Sequence
  Oligomer
aauaauaauccguguauauuguc

SEQ ID NO: 75760 - RNA, 23 nt, Artificial Sequence
  Oligomer
accucguuugguguuccgcaugg

SEQ ID NO: 75761 - RNA, 23 nt, Artificial Sequence
  Oligomer
ccucguuugguguuccgcauggc

SEQ ID NO: 75762 - RNA, 23 nt, Artificial Sequence
  Oligomer
cucguuugguguuccgcauggcg

SEQ ID NO: 75763 - RNA, 23 nt, Artificial Sequence
  Oligomer
ucguuugguguuccgcauggcgg

SEQ ID NO: 75764 - RNA, 23 nt, Artificial Sequence
  Oligomer
gcucuucaacugcagcugaaaca

SEQ ID NO: 75765 - RNA, 23 nt, Artificial Sequence
  Oligomer
cucuucaacugcagcugaaacau

SEQ ID NO: 75766 - RNA, 23 nt, Artificial Sequence
  Oligomer
ucuucaacugcagcugaaacauu

SEQ ID NO: 75767 - RNA, 23 nt, Artificial Sequence
  Oligomer
aggaaacaagucugggagauucc

SEQ ID NO: 75768 - RNA, 23 nt, Artificial Sequence
  Oligomer
ggaaacaagucugggagauuccc

SEQ ID NO: 75769 - RNA, 23 nt, Artificial Sequence
  Oligomer
gaaacaagucugggagauuccca

SEQ ID NO: 75770 - RNA, 23 nt, Artificial Sequence
  Oligomer
aaacaagucugggagauucccac

SEQ ID NO: 75771 - RNA, 23 nt, Artificial Sequence
  Oligomer
aacaagucugggagauucccaca

SEQ ID NO: 75772 - RNA, 23 nt, Artificial Sequence
  Oligomer
cagucucaucuucggcaacuuuu

SEQ ID NO: 75773 - RNA, 23 nt, Artificial Sequence
  Oligomer
uaucaugucugagcgcgugggca

SEQ ID NO: 75774 - RNA, 23 nt, Artificial Sequence
  Oligomer
gagcuaaaaaugccaguggauaa

SEQ ID NO: 75775 - RNA, 23 nt, Artificial Sequence
  Oligomer
agcuaaaaaugccaguggauaaa

SEQ ID NO: 75776 - RNA, 23 nt, Artificial Sequence
  Oligomer
gcuaaaaaugccaguggauaaaa

SEQ ID NO: 75777 - RNA, 23 nt, Artificial Sequence
  Oligomer
auaacauguauggcacugaaaua

SEQ ID NO: 75778 - RNA, 23 nt, Artificial Sequence
  Oligomer
aggaugaaaugaagguaaagaag

SEQ ID NO: 75779 - RNA, 23 nt, Artificial Sequence
  Oligomer
ggaugaaaugaagguaaagaagg

SEQ ID NO: 75780 - RNA, 23 nt, Artificial Sequence
  Oligomer
gaugaaaugaagguaaagaaggg

SEQ ID NO: 75781 - RNA, 23 nt, Artificial Sequence
  Oligomer
ggccuggaugagcucccucauuu

SEQ ID NO: 75782 - RNA, 23 nt, Artificial Sequence
  Oligomer
gccuggaugagcucccucauuuc

SEQ ID NO: 75783 - RNA, 23 nt, Artificial Sequence
  Oligomer
ccuggaugagcucccucauuucc

SEQ ID NO: 75784 - RNA, 23 nt, Artificial Sequence
  Oligomer
cuaucacaccuccugugguccag

SEQ ID NO: 75785 - RNA, 23 nt, Artificial Sequence
  Oligomer
uaucacaccuccugugguccagu

SEQ ID NO: 75786 - RNA, 23 nt, Artificial Sequence
  Oligomer
uucagauaagcagggauaaaggu

SEQ ID NO: 75787 - RNA, 23 nt, Artificial Sequence
  Oligomer
aaaggcagagaugaugggcacag

SEQ ID NO: 75788 - RNA, 23 nt, Artificial Sequence
  Oligomer
aggcauagccgcauaucaugucu

SEQ ID NO: 75789 - RNA, 23 nt, Artificial Sequence
  Oligomer
aaacucucacucuaggacaaaaa

SEQ ID NO: 75790 - RNA, 23 nt, Artificial Sequence
  Oligomer
aacucucacucuaggacaaaaag

SEQ ID NO: 75791 - RNA, 23 nt, Artificial Sequence
  Oligomer
uggacguuucucaggaaggaaaa

SEQ ID NO: 75792 - RNA, 23 nt, Artificial Sequence
  Oligomer
aguacugaagggaacgcacaggc

SEQ ID NO: 75793 - RNA, 23 nt, Artificial Sequence
  Oligomer
guacugaagggaacgcacaggcc

SEQ ID NO: 75794 - RNA, 23 nt, Artificial Sequence
  Oligomer
uacugaagggaacgcacaggccg

SEQ ID NO: 75795 - RNA, 23 nt, Artificial Sequence
  Oligomer
ucuacaaaagcuggaacugaaca

SEQ ID NO: 75796 - RNA, 23 nt, Artificial Sequence
  Oligomer
agggaccaugggagaugugaagg

SEQ ID NO: 75797 - RNA, 23 nt, Artificial Sequence
  Oligomer
gggaccaugggagaugugaagga

SEQ ID NO: 75798 - RNA, 23 nt, Artificial Sequence
  Oligomer
ggaccaugggagaugugaaggaa

SEQ ID NO: 75799 - RNA, 19 nt, Artificial Sequence
  Oligomer
cguggaggaggcaauuaga

SEQ ID NO: 75800 - RNA, 19 nt, Artificial Sequence
  Oligomer
gaaaaucaggcucuucaca

SEQ ID NO: 75801 - RNA, 19 nt, Artificial Sequence
  Oligomer
aaaaucaggcucuucacau

SEQ ID NO: 75802 - RNA, 19 nt, Artificial Sequence
  Oligomer
cguucuacugguaugaaga

SEQ ID NO: 75803 - RNA, 19 nt, Artificial Sequence
  Oligomer
gguucuggcgauuucaaca

SEQ ID NO: 75804 - RNA, 19 nt, Artificial Sequence
  Oligomer
cuuuacacugggacgaaaa

SEQ ID NO: 75805 - RNA, 19 nt, Artificial Sequence
  Oligomer
cacugaauugcuaaggaca

SEQ ID NO: 75806 - RNA, 19 nt, Artificial Sequence
  Oligomer
aaaagaugugccacuugua

SEQ ID NO: 75807 - RNA, 19 nt, Artificial Sequence
  Oligomer
aggugagggagaagaaauu

SEQ ID NO: 75808 - RNA, 19 nt, Artificial Sequence
  Oligomer
ccuuacuaacgacccaaca

SEQ ID NO: 75809 - RNA, 19 nt, Artificial Sequence
  Oligomer
gauuugccgggaugcaaga

SEQ ID NO: 75810 - RNA, 19 nt, Artificial Sequence
  Oligomer
aguuauuuuggguucaaca

SEQ ID NO: 75811 - RNA, 19 nt, Artificial Sequence
  Oligomer
ucucgaggacacuucaaaa

SEQ ID NO: 75812 - RNA, 19 nt, Artificial Sequence
  Oligomer
uguucgaggccaaacccaa

SEQ ID NO: 75813 - RNA, 19 nt, Artificial Sequence
  Oligomer
gagucuuuccauuacacac

SEQ ID NO: 75814 - RNA, 19 nt, Artificial Sequence
  Oligomer
aaaaagcguggcuuuaaaa

SEQ ID NO: 75815 - RNA, 19 nt, Artificial Sequence
  Oligomer
uagagaccgcuaugcagaa

SEQ ID NO: 75816 - RNA, 19 nt, Artificial Sequence
  Oligomer
aguuguucugguacacaca

SEQ ID NO: 75817 - RNA, 19 nt, Artificial Sequence
  Oligomer
uguucuucuguggaccuaa

SEQ ID NO: 75818 - RNA, 19 nt, Artificial Sequence
  Oligomer
cuuuggaacugcccugaca

SEQ ID NO: 75819 - RNA, 19 nt, Artificial Sequence
  Oligomer
aaauuuccugacagccgaa

SEQ ID NO: 75820 - RNA, 19 nt, Artificial Sequence
  Oligomer
acuggucgccuaugggaua

SEQ ID NO: 75821 - RNA, 19 nt, Artificial Sequence
  Oligomer
uggaggaggcaauuagaca

SEQ ID NO: 75822 - RNA, 19 nt, Artificial Sequence
  Oligomer
cugugacggccuguugaua

SEQ ID NO: 75823 - RNA, 19 nt, Artificial Sequence
  Oligomer
uagguucuggcgauuucaa

SEQ ID NO: 75824 - RNA, 19 nt, Artificial Sequence
  Oligomer
uugugaacaguacacuaua

SEQ ID NO: 75825 - RNA, 19 nt, Artificial Sequence
  Oligomer
aacugcaugcuaauucuaa

SEQ ID NO: 75826 - RNA, 19 nt, Artificial Sequence
  Oligomer
uauugugaacaguacacua

SEQ ID NO: 75827 - RNA, 19 nt, Artificial Sequence
  Oligomer
ccaaagaacuccaccagga

SEQ ID NO: 75828 - RNA, 19 nt, Artificial Sequence
  Oligomer
uucuauuacaacaaggaga

SEQ ID NO: 75829 - RNA, 19 nt, Artificial Sequence
  Oligomer
cuguagagaccgcuaugca

SEQ ID NO: 75830 - RNA, 19 nt, Artificial Sequence
  Oligomer
cauggcugggaauaaauuu

SEQ ID NO: 75831 - RNA, 19 nt, Artificial Sequence
  Oligomer
ccuaaagcucucucgagga

SEQ ID NO: 75832 - RNA, 19 nt, Artificial Sequence
  Oligomer
aacaaugaguucaagcaga

SEQ ID NO: 75833 - RNA, 19 nt, Artificial Sequence
  Oligomer
ucuauaugguacaaaugca

SEQ ID NO: 75834 - RNA, 19 nt, Artificial Sequence
  Oligomer
ucgucaacugaguucauca

SEQ ID NO: 75835 - RNA, 19 nt, Artificial Sequence
  Oligomer
caauuuucuggcaaggaac

SEQ ID NO: 75836 - RNA, 19 nt, Artificial Sequence
  Oligomer
ucaugaccucgucaacuga

SEQ ID NO: 75837 - RNA, 19 nt, Artificial Sequence
  Oligomer
aguugggaacuggugaaua

SEQ ID NO: 75838 - RNA, 19 nt, Artificial Sequence
  Oligomer
cauuucuauuacaacaagg

SEQ ID NO: 75839 - RNA, 19 nt, Artificial Sequence
  Oligomer
gucucuccaccauauuagu

SEQ ID NO: 75840 - RNA, 19 nt, Artificial Sequence
  Oligomer
cuuaccggcugggaugaaa

SEQ ID NO: 75841 - RNA, 19 nt, Artificial Sequence
  Oligomer
cucucucugcacaacauca

SEQ ID NO: 75842 - RNA, 19 nt, Artificial Sequence
  Oligomer
cuggcuuuagucuugauca

SEQ ID NO: 75843 - RNA, 19 nt, Artificial Sequence
  Oligomer
aguucaagcagauugccua

SEQ ID NO: 75844 - RNA, 19 nt, Artificial Sequence
  Oligomer
auuacaggcuuaaagcaga

SEQ ID NO: 75845 - RNA, 19 nt, Artificial Sequence
  Oligomer
cagugcccagccauaucuu

SEQ ID NO: 75846 - RNA, 19 nt, Artificial Sequence
  Oligomer
agaaguugucauuaccaag

SEQ ID NO: 75847 - RNA, 19 nt, Artificial Sequence
  Oligomer
acugaauugcuaaggacaa

SEQ ID NO: 75848 - RNA, 19 nt, Artificial Sequence
  Oligomer
cagucgaaaccuuauuuca

SEQ ID NO: 75849 - RNA, 19 nt, Artificial Sequence
  Oligomer
acacuauaccauacuuccu

SEQ ID NO: 75850 - RNA, 19 nt, Artificial Sequence
  Oligomer
gugccacuuguauucauca

SEQ ID NO: 75851 - RNA, 19 nt, Artificial Sequence
  Oligomer
cauauauuucuuaccggcu

SEQ ID NO: 75852 - RNA, 19 nt, Artificial Sequence
  Oligomer
gaugcaagagcuuuugagu

SEQ ID NO: 75853 - RNA, 19 nt, Artificial Sequence
  Oligomer
caaggagagcuucuagacu

SEQ ID NO: 75854 - RNA, 19 nt, Artificial Sequence
  Oligomer
acugggacgaaaauacuga

SEQ ID NO: 75855 - RNA, 19 nt, Artificial Sequence
  Oligomer
cuuuugagugguuugcuga

SEQ ID NO: 75856 - RNA, 19 nt, Artificial Sequence
  Oligomer
uggauuugccgggaugcaa

SEQ ID NO: 75857 - RNA, 19 nt, Artificial Sequence
  Oligomer
gcuggauuuugaaugaggg

SEQ ID NO: 75858 - RNA, 19 nt, Artificial Sequence
  Oligomer
guuaaugcaaccauccaca

SEQ ID NO: 75859 - RNA, 19 nt, Artificial Sequence
  Oligomer
cuuacuaacgacccaacau

SEQ ID NO: 75860 - RNA, 19 nt, Artificial Sequence
  Oligomer
ucgaggacacuucaaaaga

SEQ ID NO: 75861 - RNA, 19 nt, Artificial Sequence
  Oligomer
ggcugggaugaaaaucagg

SEQ ID NO: 75862 - RNA, 19 nt, Artificial Sequence
  Oligomer
acuagggaagcccuuacua

SEQ ID NO: 75863 - RNA, 19 nt, Artificial Sequence
  Oligomer
cuguuaaugcaaccaucca

SEQ ID NO: 75864 - RNA, 19 nt, Artificial Sequence
  Oligomer
cauucauaagaggaacaag

SEQ ID NO: 75865 - RNA, 19 nt, Artificial Sequence
  Oligomer
ugaaaaucaggcucuucac

SEQ ID NO: 75866 - RNA, 19 nt, Artificial Sequence
  Oligomer
uuaccggcugggaugaaaa

SEQ ID NO: 75867 - RNA, 19 nt, Artificial Sequence
  Oligomer
cagccauaucuucgcugga

SEQ ID NO: 75868 - RNA, 19 nt, Artificial Sequence
  Oligomer
aaguauuugcugcagagga

SEQ ID NO: 75869 - RNA, 19 nt, Artificial Sequence
  Oligomer
acugguaugaagaggagga

SEQ ID NO: 75870 - RNA, 19 nt, Artificial Sequence
  Oligomer
acacugggacgaaaauacu

SEQ ID NO: 75871 - RNA, 19 nt, Artificial Sequence
  Oligomer
cuuuccauuacacacgagu

SEQ ID NO: 75872 - RNA, 19 nt, Artificial Sequence
  Oligomer
guaugaagaggaggagucu

SEQ ID NO: 75873 - RNA, 19 nt, Artificial Sequence
  Oligomer
aacaaggagagcuucuaga

SEQ ID NO: 75874 - RNA, 19 nt, Artificial Sequence
  Oligomer
cucucucgaggacacuuca

SEQ ID NO: 75875 - RNA, 19 nt, Artificial Sequence
  Oligomer
uggcguguucuucugugga

SEQ ID NO: 75876 - RNA, 19 nt, Artificial Sequence
  Oligomer
aagguguauuucuacugga

SEQ ID NO: 75877 - RNA, 19 nt, Artificial Sequence
  Oligomer
uaugaguuguucugguaca

SEQ ID NO: 75878 - RNA, 19 nt, Artificial Sequence
  Oligomer
ggucaaguccaggcauugu

SEQ ID NO: 75879 - RNA, 19 nt, Artificial Sequence
  Oligomer
gcuucuagacuuuggaggu

SEQ ID NO: 75880 - RNA, 19 nt, Artificial Sequence
  Oligomer
cugacagauguauuucacu

SEQ ID NO: 75881 - RNA, 19 nt, Artificial Sequence
  Oligomer
cuuggaaauggauuuuagg

SEQ ID NO: 75882 - RNA, 19 nt, Artificial Sequence
  Oligomer
aaacuggucgccuauggga

SEQ ID NO: 75883 - RNA, 19 nt, Artificial Sequence
  Oligomer
uucauaagaggaacaagua

SEQ ID NO: 75884 - RNA, 19 nt, Artificial Sequence
  Oligomer
uugggaacuggugaauaau

SEQ ID NO: 75885 - RNA, 19 nt, Artificial Sequence
  Oligomer
augaaaaucaggcucuuca

SEQ ID NO: 75886 - RNA, 19 nt, Artificial Sequence
  Oligomer
aucucuuacucucccugga

SEQ ID NO: 75887 - RNA, 19 nt, Artificial Sequence
  Oligomer
guagagaccgcuaugcaga

SEQ ID NO: 75888 - RNA, 19 nt, Artificial Sequence
  Oligomer
agucucucucugcacaaca

SEQ ID NO: 75889 - RNA, 19 nt, Artificial Sequence
  Oligomer
aggccaaacccaagacagu

SEQ ID NO: 75890 - RNA, 19 nt, Artificial Sequence
  Oligomer
aacuggucgccuaugggau

SEQ ID NO: 75891 - RNA, 19 nt, Artificial Sequence
  Oligomer
uuuacacugggacgaaaau

SEQ ID NO: 75892 - RNA, 19 nt, Artificial Sequence
  Oligomer
caugaaaaagcguggcuuu

SEQ ID NO: 75893 - RNA, 19 nt, Artificial Sequence
  Oligomer
uuagguucuggcgauuuca

SEQ ID NO: 75894 - RNA, 19 nt, Artificial Sequence
  Oligomer
agucgaaaccuuauuucau

SEQ ID NO: 75895 - RNA, 19 nt, Artificial Sequence
  Oligomer
guugauaugagcucccagu

SEQ ID NO: 75896 - RNA, 19 nt, Artificial Sequence
  Oligomer
uguugauaugagcucccag

SEQ ID NO: 75897 - RNA, 19 nt, Artificial Sequence
  Oligomer
ccaccaggaauuccuguga

SEQ ID NO: 75898 - RNA, 19 nt, Artificial Sequence
  Oligomer
aaauacugacgugauuaca

SEQ ID NO: 75899 - RNA, 19 nt, Artificial Sequence
  Oligomer
cugggacgaaaauacugac

SEQ ID NO: 75900 - RNA, 19 nt, Artificial Sequence
  Oligomer
uguaugcaugugaaagaau

SEQ ID NO: 75901 - RNA, 19 nt, Artificial Sequence
  Oligomer
ugaacaguacacuauacca

SEQ ID NO: 75902 - RNA, 19 nt, Artificial Sequence
  Oligomer
ucaaguccaggcauugugu

SEQ ID NO: 75903 - RNA, 19 nt, Artificial Sequence
  Oligomer
ucuauuacaacaaggagag

SEQ ID NO: 75904 - RNA, 19 nt, Artificial Sequence
  Oligomer
agcagauugccuacaauca

SEQ ID NO: 75905 - RNA, 19 nt, Artificial Sequence
  Oligomer
agugguuugcugaucucuu

SEQ ID NO: 75906 - RNA, 19 nt, Artificial Sequence
  Oligomer
guacaaaugcagugaggca

SEQ ID NO: 75907 - RNA, 19 nt, Artificial Sequence
  Oligomer
cuggauuuugaaugagggu

SEQ ID NO: 75908 - RNA, 19 nt, Artificial Sequence
  Oligomer
gauguauuucacuacccag

SEQ ID NO: 75909 - RNA, 19 nt, Artificial Sequence
  Oligomer
ccaggaagacuuuuucagc

SEQ ID NO: 75910 - RNA, 19 nt, Artificial Sequence
  Oligomer
guccuggaacuucacauga

SEQ ID NO: 75911 - RNA, 19 nt, Artificial Sequence
  Oligomer
agguucuggcgauuucaac

SEQ ID NO: 75912 - RNA, 19 nt, Artificial Sequence
  Oligomer
cucggcuuggaaauggauu

SEQ ID NO: 75913 - RNA, 19 nt, Artificial Sequence
  Oligomer
auuagacaaaaaccucaga

SEQ ID NO: 75914 - RNA, 19 nt, Artificial Sequence
  Oligomer
aguauuugcugcagaggac

SEQ ID NO: 75915 - RNA, 19 nt, Artificial Sequence
  Oligomer
uuuccauuacacacgaguu

SEQ ID NO: 75916 - RNA, 19 nt, Artificial Sequence
  Oligomer
ugugacggccuguugauau

SEQ ID NO: 75917 - RNA, 19 nt, Artificial Sequence
  Oligomer
cacugggacgaaaauacug

SEQ ID NO: 75918 - RNA, 19 nt, Artificial Sequence
  Oligomer
uuuugagugguuugcugau

SEQ ID NO: 75919 - RNA, 19 nt, Artificial Sequence
  Oligomer
acuuuuucagcgugcacau

SEQ ID NO: 75920 - RNA, 19 nt, Artificial Sequence
  Oligomer
ugaucaugaccucgucaac

SEQ ID NO: 75921 - RNA, 19 nt, Artificial Sequence
  Oligomer
uaaggacaauagcaggcgu

SEQ ID NO: 75922 - RNA, 19 nt, Artificial Sequence
  Oligomer
ucuacugguaugaagagga

SEQ ID NO: 75923 - RNA, 19 nt, Artificial Sequence
  Oligomer
aaucaggcucuucacauag

SEQ ID NO: 75924 - RNA, 19 nt, Artificial Sequence
  Oligomer
ucuuaccggcugggaugaa

SEQ ID NO: 75925 - RNA, 19 nt, Artificial Sequence
  Oligomer
acaaaugcagugaggcaca

SEQ ID NO: 75926 - RNA, 19 nt, Artificial Sequence
  Oligomer
aaaaccucagauuucacaa

SEQ ID NO: 75927 - RNA, 19 nt, Artificial Sequence
  Oligomer
uaacgacccaacauccaga

SEQ ID NO: 75928 - RNA, 19 nt, Artificial Sequence
  Oligomer
cuuuggaggucaaguccag

SEQ ID NO: 75929 - RNA, 19 nt, Artificial Sequence
  Oligomer
aaagcagaagaccuucuau

SEQ ID NO: 75930 - RNA, 19 nt, Artificial Sequence
  Oligomer
auuucuuaccggcugggau

SEQ ID NO: 75931 - RNA, 19 nt, Artificial Sequence
  Oligomer
ucauauauuucuuaccggc

SEQ ID NO: 75932 - RNA, 19 nt, Artificial Sequence
  Oligomer
aacugcccugacagaugua

SEQ ID NO: 75933 - RNA, 19 nt, Artificial Sequence
  Oligomer
auuuccugacagccgaaga

SEQ ID NO: 75934 - RNA, 19 nt, Artificial Sequence
  Oligomer
acaacaucaccuucuguag

SEQ ID NO: 75935 - RNA, 19 nt, Artificial Sequence
  Oligomer
ucgccuaugggauagcugu

SEQ ID NO: 75936 - RNA, 19 nt, Artificial Sequence
  Oligomer
ugucauauacaacagaaca

SEQ ID NO: 75937 - RNA, 19 nt, Artificial Sequence
  Oligomer
uuucuauuacaacaaggag

SEQ ID NO: 75938 - RNA, 19 nt, Artificial Sequence
  Oligomer
gagugguuugcugaucucu

SEQ ID NO: 75939 - RNA, 19 nt, Artificial Sequence
  Oligomer
cugagcaagguguauuucu

SEQ ID NO: 75940 - RNA, 19 nt, Artificial Sequence
  Oligomer
aaaugcagugaggcacaga

SEQ ID NO: 75941 - RNA, 19 nt, Artificial Sequence
  Oligomer
aguacaucuuggugcagug

SEQ ID NO: 75942 - RNA, 19 nt, Artificial Sequence
  Oligomer
uguggucuuguaugcaugu

SEQ ID NO: 75943 - RNA, 19 nt, Artificial Sequence
  Oligomer
uguucugguacacacacca

SEQ ID NO: 75944 - RNA, 19 nt, Artificial Sequence
  Oligomer
caaaaaccucagauuucac

SEQ ID NO: 75945 - RNA, 19 nt, Artificial Sequence
  Oligomer
guggaggaggcaauuagac

SEQ ID NO: 75946 - RNA, 19 nt, Artificial Sequence
  Oligomer
ucuaauaccugucagucga

SEQ ID NO: 75947 - RNA, 19 nt, Artificial Sequence
  Oligomer
aacuauugugaacaguaca

SEQ ID NO: 75948 - RNA, 19 nt, Artificial Sequence
  Oligomer
ugacggccuguugauauga

SEQ ID NO: 75949 - RNA, 19 nt, Artificial Sequence
  Oligomer
aagaugugccacuuguauu

SEQ ID NO: 75950 - RNA, 19 nt, Artificial Sequence
  Oligomer
cuucaaaagaugugccacu

SEQ ID NO: 75951 - RNA, 19 nt, Artificial Sequence
  Oligomer
cguguucuucuguggaccu

SEQ ID NO: 75952 - RNA, 19 nt, Artificial Sequence
  Oligomer
ugauuacaggcuuaaagca

SEQ ID NO: 75953 - RNA, 19 nt, Artificial Sequence
  Oligomer
uaugcagaauggcagacag

SEQ ID NO: 75954 - RNA, 19 nt, Artificial Sequence
  Oligomer
ucugguacacacaccaugu

SEQ ID NO: 75955 - RNA, 19 nt, Artificial Sequence
  Oligomer
acuaacgacccaacaucca

SEQ ID NO: 75956 - RNA, 19 nt, Artificial Sequence
  Oligomer
ugguaugaagaggaggagu

SEQ ID NO: 75957 - RNA, 19 nt, Artificial Sequence
  Oligomer
augagcucccaguugggaa

SEQ ID NO: 75958 - RNA, 19 nt, Artificial Sequence
  Oligomer
aguauuggcguguucuucu

SEQ ID NO: 75959 - RNA, 19 nt, Artificial Sequence
  Oligomer
uaccggcugggaugaaaau

SEQ ID NO: 75960 - RNA, 19 nt, Artificial Sequence
  Oligomer
aagacuuuuucagcgugca

SEQ ID NO: 75961 - RNA, 19 nt, Artificial Sequence
  Oligomer
uggcgauuucaacaagaag

SEQ ID NO: 75962 - RNA, 19 nt, Artificial Sequence
  Oligomer
aagacagucucucucugca

SEQ ID NO: 75963 - RNA, 19 nt, Artificial Sequence
  Oligomer
gagggagaagaaauuuccu

SEQ ID NO: 75964 - RNA, 19 nt, Artificial Sequence
  Oligomer
aggacaauagcaggcguca

SEQ ID NO: 75965 - RNA, 19 nt, Artificial Sequence
  Oligomer
uucuggccgcacuuuccaa

SEQ ID NO: 75966 - RNA, 19 nt, Artificial Sequence
  Oligomer
gagcuucuagacuuuggag

SEQ ID NO: 75967 - RNA, 19 nt, Artificial Sequence
  Oligomer
acuuguauucaucagcuga

SEQ ID NO: 75968 - RNA, 19 nt, Artificial Sequence
  Oligomer
ucucucgaggacacuucaa

SEQ ID NO: 75969 - RNA, 19 nt, Artificial Sequence
  Oligomer
augagggucucuccaccau

SEQ ID NO: 75970 - RNA, 19 nt, Artificial Sequence
  Oligomer
ucucuuacucucccuggaa

SEQ ID NO: 75971 - RNA, 19 nt, Artificial Sequence
  Oligomer
aauaauuagguucuggcga

SEQ ID NO: 75972 - RNA, 19 nt, Artificial Sequence
  Oligomer
cucaauuuucuggcaagga

SEQ ID NO: 75973 - RNA, 19 nt, Artificial Sequence
  Oligomer
uguagagaccgcuaugcag

SEQ ID NO: 75974 - RNA, 19 nt, Artificial Sequence
  Oligomer
uguuuucaucgucuucuuu

SEQ ID NO: 75975 - RNA, 19 nt, Artificial Sequence
  Oligomer
gacaggccuccuaugaguu

SEQ ID NO: 75976 - RNA, 19 nt, Artificial Sequence
  Oligomer
ucucuggcuuuagucuuga

SEQ ID NO: 75977 - RNA, 19 nt, Artificial Sequence
  Oligomer
auucauaagaggaacaagu

SEQ ID NO: 75978 - RNA, 19 nt, Artificial Sequence
  Oligomer
cuguuuauugacacguucu

SEQ ID NO: 75979 - RNA, 19 nt, Artificial Sequence
  Oligomer
aaagaacuccaccaggaau

SEQ ID NO: 75980 - RNA, 19 nt, Artificial Sequence
  Oligomer
uuacacugggacgaaaaua

SEQ ID NO: 75981 - RNA, 19 nt, Artificial Sequence
  Oligomer
aaugagggucucuccacca

SEQ ID NO: 75982 - RNA, 19 nt, Artificial Sequence
  Oligomer
agagcuuuugagugguuug

SEQ ID NO: 75983 - RNA, 19 nt, Artificial Sequence
  Oligomer
gaauaauuagguucuggcg

SEQ ID NO: 75984 - RNA, 19 nt, Artificial Sequence
  Oligomer
cuuuccaagcugggcaaca

SEQ ID NO: 75985 - RNA, 19 nt, Artificial Sequence
  Oligomer
cuaacgacccaacauccag

SEQ ID NO: 75986 - RNA, 19 nt, Artificial Sequence
  Oligomer
gaugugccacuuguauuca

SEQ ID NO: 75987 - RNA, 19 nt, Artificial Sequence
  Oligomer
ucuccaccauauuaguacu

SEQ ID NO: 75988 - RNA, 19 nt, Artificial Sequence
  Oligomer
aaacacggaugagugagca

SEQ ID NO: 75989 - RNA, 19 nt, Artificial Sequence
  Oligomer
ugguacaaaugcagugagg

SEQ ID NO: 75990 - RNA, 19 nt, Artificial Sequence
  Oligomer
uuggaacugcccugacaga

SEQ ID NO: 75991 - RNA, 19 nt, Artificial Sequence
  Oligomer
aguugucauuaccaaggug

SEQ ID NO: 75992 - RNA, 19 nt, Artificial Sequence
  Oligomer
aaguugucauuaccaaggu

SEQ ID NO: 75993 - RNA, 19 nt, Artificial Sequence
  Oligomer
gauuuuaggcccugugguc

SEQ ID NO: 75994 - RNA, 19 nt, Artificial Sequence
  Oligomer
accgcuaugcagaauggca

SEQ ID NO: 75995 - RNA, 19 nt, Artificial Sequence
  Oligomer
uacucucauggcugggaau

SEQ ID NO: 75996 - RNA, 19 nt, Artificial Sequence
  Oligomer
cugaagcugagcaaggugu

SEQ ID NO: 75997 - RNA, 19 nt, Artificial Sequence
  Oligomer
uaucuucgcuggaguggca

SEQ ID NO: 75998 - RNA, 19 nt, Artificial Sequence
  Oligomer
aaaagcguggcuuuaaaau

SEQ ID NO: 75999 - RNA, 19 nt, Artificial Sequence
  Oligomer
uuaccaaggugguaagcca

SEQ ID NO: 76000 - RNA, 19 nt, Artificial Sequence
  Oligomer
ugucauuaccaagguggua

SEQ ID NO: 76001 - RNA, 19 nt, Artificial Sequence
  Oligomer
cuaugaguuguucugguac

SEQ ID NO: 76002 - RNA, 19 nt, Artificial Sequence
  Oligomer
uaacgagagcuaccucaac

SEQ ID NO: 76003 - RNA, 19 nt, Artificial Sequence
  Oligomer
cacaucguggcgcauuucu

SEQ ID NO: 76004 - RNA, 19 nt, Artificial Sequence
  Oligomer
ugaagaggaggagucuuuc

SEQ ID NO: 76005 - RNA, 19 nt, Artificial Sequence
  Oligomer
uacacuauaccauacuucc

SEQ ID NO: 76006 - RNA, 19 nt, Artificial Sequence
  Oligomer
auuacaacaaggagagcuu

SEQ ID NO: 76007 - RNA, 19 nt, Artificial Sequence
  Oligomer
cagauugccuacaaucacc

SEQ ID NO: 76008 - RNA, 19 nt, Artificial Sequence
  Oligomer
gaacaaugaguucaagcag

SEQ ID NO: 76009 - RNA, 19 nt, Artificial Sequence
  Oligomer
caggccuccuaugaguugu

SEQ ID NO: 76010 - RNA, 19 nt, Artificial Sequence
  Oligomer
gaguucaucagacaggccu

SEQ ID NO: 76011 - RNA, 19 nt, Artificial Sequence
  Oligomer
guucuacugguaugaagag

SEQ ID NO: 76012 - RNA, 19 nt, Artificial Sequence
  Oligomer
aaguccaggcauuguguuu

SEQ ID NO: 76013 - RNA, 19 nt, Artificial Sequence
  Oligomer
acaaggagagcuucuagac

SEQ ID NO: 76014 - RNA, 19 nt, Artificial Sequence
  Oligomer
uagggaagcccuuacuaac

SEQ ID NO: 76015 - RNA, 19 nt, Artificial Sequence
  Oligomer
agcaguauuggcguguucu

SEQ ID NO: 76016 - RNA, 19 nt, Artificial Sequence
  Oligomer
ucuacuggauuugccggga

SEQ ID NO: 76017 - RNA, 19 nt, Artificial Sequence
  Oligomer
uucgcugcucuucugaaau

SEQ ID NO: 76018 - RNA, 19 nt, Artificial Sequence
  Oligomer
ugcuggauuuugaaugagg

SEQ ID NO: 76019 - RNA, 19 nt, Artificial Sequence
  Oligomer
uggaacugcccugacagau

SEQ ID NO: 76020 - RNA, 19 nt, Artificial Sequence
  Oligomer
uuaaaauggcgccagggca

SEQ ID NO: 76021 - RNA, 19 nt, Artificial Sequence
  Oligomer
acagccgaagagcaacaag

SEQ ID NO: 76022 - RNA, 19 nt, Artificial Sequence
  Oligomer
aauggauuuuaggcccugu

SEQ ID NO: 76023 - RNA, 19 nt, Artificial Sequence
  Oligomer
uuuacuagggaagcccuua

SEQ ID NO: 76024 - RNA, 19 nt, Artificial Sequence
  Oligomer
guucugguacacacaccau

SEQ ID NO: 76025 - RNA, 19 nt, Artificial Sequence
  Oligomer
gaucaugaccucgucaacu

SEQ ID NO: 76026 - RNA, 19 nt, Artificial Sequence
  Oligomer
cuugaucaugaccucguca

SEQ ID NO: 76027 - RNA, 19 nt, Artificial Sequence
  Oligomer
cuuuagucuugaucaugac

SEQ ID NO: 76028 - RNA, 19 nt, Artificial Sequence
  Oligomer
aaccuggaacgcuaccacu

SEQ ID NO: 76029 - RNA, 19 nt, Artificial Sequence
  Oligomer
aacaaguauuugcugcaga

SEQ ID NO: 76030 - RNA, 19 nt, Artificial Sequence
  Oligomer
agucuuuccauuacacacg

SEQ ID NO: 76031 - RNA, 19 nt, Artificial Sequence
  Oligomer
acggccuguugauaugagc

SEQ ID NO: 76032 - RNA, 19 nt, Artificial Sequence
  Oligomer
caguauuggcguguucuuc

SEQ ID NO: 76033 - RNA, 19 nt, Artificial Sequence
  Oligomer
gauuacaggcuuaaagcag

SEQ ID NO: 76034 - RNA, 19 nt, Artificial Sequence
  Oligomer
aauacugacgugauuacag

SEQ ID NO: 76035 - RNA, 19 nt, Artificial Sequence
  Oligomer
uaugguacaaaugcaguga

SEQ ID NO: 76036 - RNA, 19 nt, Artificial Sequence
  Oligomer
gucaacugaguucaucaga

SEQ ID NO: 76037 - RNA, 19 nt, Artificial Sequence
  Oligomer
ucuggugaucucucuggcu

SEQ ID NO: 76038 - RNA, 19 nt, Artificial Sequence
  Oligomer
aucguggcgcauuucuuca

SEQ ID NO: 76039 - RNA, 19 nt, Artificial Sequence
  Oligomer
uuggguucaacacuggcuu

SEQ ID NO: 76040 - RNA, 19 nt, Artificial Sequence
  Oligomer
guuauuuuggguucaacac

SEQ ID NO: 76041 - RNA, 19 nt, Artificial Sequence
  Oligomer
caccaggaauuccugugac

SEQ ID NO: 76042 - RNA, 19 nt, Artificial Sequence
  Oligomer
cacauagcuuuacacuggg

SEQ ID NO: 76043 - RNA, 19 nt, Artificial Sequence
  Oligomer
cuucacauagcuuuacacu

SEQ ID NO: 76044 - RNA, 19 nt, Artificial Sequence
  Oligomer
augaaaaagcguggcuuua

SEQ ID NO: 76045 - RNA, 19 nt, Artificial Sequence
  Oligomer
uuguucgaggccaaaccca

SEQ ID NO: 76046 - RNA, 19 nt, Artificial Sequence
  Oligomer
auugcuaaggacaauagca

SEQ ID NO: 76047 - RNA, 19 nt, Artificial Sequence
  Oligomer
acauccagacacaggugag

SEQ ID NO: 76048 - RNA, 19 nt, Artificial Sequence
  Oligomer
caacauccagacacaggug

SEQ ID NO: 76049 - RNA, 19 nt, Artificial Sequence
  Oligomer
acgacccaacauccagaca

SEQ ID NO: 76050 - RNA, 19 nt, Artificial Sequence
  Oligomer
uaugaagaggaggagucuu

SEQ ID NO: 76051 - RNA, 19 nt, Artificial Sequence
  Oligomer
guuuauugacacguucuac

SEQ ID NO: 76052 - RNA, 19 nt, Artificial Sequence
  Oligomer
guuauugauuccaaagaac

SEQ ID NO: 76053 - RNA, 19 nt, Artificial Sequence
  Oligomer
acuuuggaggucaagucca

SEQ ID NO: 76054 - RNA, 19 nt, Artificial Sequence
  Oligomer
aggacacuucaaaagaugu

SEQ ID NO: 76055 - RNA, 19 nt, Artificial Sequence
  Oligomer
aaagcucucucgaggacac

SEQ ID NO: 76056 - RNA, 19 nt, Artificial Sequence
  Oligomer
ggaaacacggaugagugag

SEQ ID NO: 76057 - RNA, 19 nt, Artificial Sequence
  Oligomer
uggaguccuggaacuucac

SEQ ID NO: 76058 - RNA, 19 nt, Artificial Sequence
  Oligomer
agaccgcuaugcagaaugg

SEQ ID NO: 76059 - RNA, 19 nt, Artificial Sequence
  Oligomer
aauuagacaaaaaccucag

SEQ ID NO: 76060 - RNA, 19 nt, Artificial Sequence
  Oligomer
aagaggaggagucuuucca

SEQ ID NO: 76061 - RNA, 19 nt, Artificial Sequence
  Oligomer
aguacucucauggcuggga

SEQ ID NO: 76062 - RNA, 19 nt, Artificial Sequence
  Oligomer
gaugaaaaucaggcucuuc

SEQ ID NO: 76063 - RNA, 19 nt, Artificial Sequence
  Oligomer
aucauauauuucuuaccgg

SEQ ID NO: 76064 - RNA, 19 nt, Artificial Sequence
  Oligomer
uugagugguuugcugaucu

SEQ ID NO: 76065 - RNA, 19 nt, Artificial Sequence
  Oligomer
uauaugguacaaaugcagu

SEQ ID NO: 76066 - RNA, 19 nt, Artificial Sequence
  Oligomer
cucucugcacaacaucacc

SEQ ID NO: 76067 - RNA, 19 nt, Artificial Sequence
  Oligomer
gugccugaauuuuaacugc

SEQ ID NO: 76068 - RNA, 19 nt, Artificial Sequence
  Oligomer
cuagacuuuggaggucaag

SEQ ID NO: 76069 - RNA, 19 nt, Artificial Sequence
  Oligomer
uauuaguacucucauggcu

SEQ ID NO: 76070 - RNA, 19 nt, Artificial Sequence
  Oligomer
agcucucucgaggacacuu

SEQ ID NO: 76071 - RNA, 19 nt, Artificial Sequence
  Oligomer
uaaagcucucucgaggaca

SEQ ID NO: 76072 - RNA, 19 nt, Artificial Sequence
  Oligomer
agcagaagaccuucuaugg

SEQ ID NO: 76073 - RNA, 19 nt, Artificial Sequence
  Oligomer
gcugggaugaaaaucaggc

SEQ ID NO: 76074 - RNA, 19 nt, Artificial Sequence
  Oligomer
ucugaaaucuauaugguac

SEQ ID NO: 76075 - RNA, 19 nt, Artificial Sequence
  Oligomer
auuucacuacccagugugu

SEQ ID NO: 76076 - RNA, 19 nt, Artificial Sequence
  Oligomer
accucgucaacugaguuca

SEQ ID NO: 76077 - RNA, 19 nt, Artificial Sequence
  Oligomer
uuaacugcaugcuaauucu

SEQ ID NO: 76078 - RNA, 19 nt, Artificial Sequence
  Oligomer
acugugccugaauuuuaac

SEQ ID NO: 76079 - RNA, 19 nt, Artificial Sequence
  Oligomer
ugauaugagcucccaguug

SEQ ID NO: 76080 - RNA, 19 nt, Artificial Sequence
  Oligomer
uugauaugagcucccaguu

SEQ ID NO: 76081 - RNA, 19 nt, Artificial Sequence
  Oligomer
uugauuccaaagaacucca

SEQ ID NO: 76082 - RNA, 19 nt, Artificial Sequence
  Oligomer
cuguggaccuaaagcucuc

SEQ ID NO: 76083 - RNA, 19 nt, Artificial Sequence
  Oligomer
uacacugggacgaaaauac

SEQ ID NO: 76084 - RNA, 19 nt, Artificial Sequence
  Oligomer
ucuucacauagcuuuacac

SEQ ID NO: 76085 - RNA, 19 nt, Artificial Sequence
  Oligomer
gaaaacucacuuucugagu

SEQ ID NO: 76086 - RNA, 19 nt, Artificial Sequence
  Oligomer
cuggaaacacggaugagug

SEQ ID NO: 76087 - RNA, 19 nt, Artificial Sequence
  Oligomer
agcuuuugagugguuugcu

SEQ ID NO: 76088 - RNA, 19 nt, Artificial Sequence
  Oligomer
agacuuuuucagcgugcac

SEQ ID NO: 76089 - RNA, 19 nt, Artificial Sequence
  Oligomer
agggcaguacaucuuggug

SEQ ID NO: 76090 - RNA, 19 nt, Artificial Sequence
  Oligomer
acuucacaugaaaaagcgu

SEQ ID NO: 76091 - RNA, 19 nt, Artificial Sequence
  Oligomer
agacagucucucucugcac

SEQ ID NO: 76092 - RNA, 19 nt, Artificial Sequence
  Oligomer
ugaguuguucugguacaca

SEQ ID NO: 76093 - RNA, 19 nt, Artificial Sequence
  Oligomer
uauuuuggguucaacacug

SEQ ID NO: 76094 - RNA, 19 nt, Artificial Sequence
  Oligomer
auugacacguucuacuggu

SEQ ID NO: 76095 - RNA, 19 nt, Artificial Sequence
  Oligomer
auugugaacaguacacuau

SEQ ID NO: 76096 - RNA, 19 nt, Artificial Sequence
  Oligomer
gaccuaaagcucucucgag

SEQ ID NO: 76097 - RNA, 19 nt, Artificial Sequence
  Oligomer
gaaacacggaugagugagc

SEQ ID NO: 76098 - RNA, 19 nt, Artificial Sequence
  Oligomer
cuuacucucccuggaaaca

SEQ ID NO: 76099 - RNA, 19 nt, Artificial Sequence
  Oligomer
gcugaucucuuacucuccc

SEQ ID NO: 76100 - RNA, 19 nt, Artificial Sequence
  Oligomer
guuugcugaucucuuacuc

SEQ ID NO: 76101 - RNA, 19 nt, Artificial Sequence
  Oligomer
acugaagcugagcaaggug

SEQ ID NO: 76102 - RNA, 19 nt, Artificial Sequence
  Oligomer
auguauuucacuacccagu

SEQ ID NO: 76103 - RNA, 19 nt, Artificial Sequence
  Oligomer
gaaguugucauuaccaagg

SEQ ID NO: 76104 - RNA, 19 nt, Artificial Sequence
  Oligomer
ucuuguaugcaugugaaag

SEQ ID NO: 76105 - RNA, 19 nt, Artificial Sequence
  Oligomer
ucuuucucagccuggccau

SEQ ID NO: 76106 - RNA, 19 nt, Artificial Sequence
  Oligomer
caucgucuucuuucucagc

SEQ ID NO: 76107 - RNA, 19 nt, Artificial Sequence
  Oligomer
uuuucaucgucuucuuucu

SEQ ID NO: 76108 - RNA, 19 nt, Artificial Sequence
  Oligomer
aacugaguucaucagacag

SEQ ID NO: 76109 - RNA, 19 nt, Artificial Sequence
  Oligomer
acccaacauccagacacag

SEQ ID NO: 76110 - RNA, 19 nt, Artificial Sequence
  Oligomer
uuauuuuggguucaacacu

SEQ ID NO: 76111 - RNA, 19 nt, Artificial Sequence
  Oligomer
ugugccacuuguauucauc

SEQ ID NO: 76112 - RNA, 19 nt, Artificial Sequence
  Oligomer
aaaauacugacgugauuac

SEQ ID NO: 76113 - RNA, 19 nt, Artificial Sequence
  Oligomer
uugaaugagggucucucca

SEQ ID NO: 76114 - RNA, 19 nt, Artificial Sequence
  Oligomer
uucuggcgauuucaacaag

SEQ ID NO: 76115 - RNA, 19 nt, Artificial Sequence
  Oligomer
uucuguagagaccgcuaug

SEQ ID NO: 76116 - RNA, 19 nt, Artificial Sequence
  Oligomer
cauguuuucaucgucuucu

SEQ ID NO: 76117 - RNA, 19 nt, Artificial Sequence
  Oligomer
acacaaccacugaauugcu

SEQ ID NO: 76118 - RNA, 19 nt, Artificial Sequence
  Oligomer
cuucaaccuggaacgcuac

SEQ ID NO: 76119 - RNA, 19 nt, Artificial Sequence
  Oligomer
aaaaaccucagauuucaca

SEQ ID NO: 76120 - RNA, 19 nt, Artificial Sequence
  Oligomer
aauucuaauaccugucagu

SEQ ID NO: 76121 - RNA, 19 nt, Artificial Sequence
  Oligomer
uggguucaacacuggcuug

SEQ ID NO: 76122 - RNA, 19 nt, Artificial Sequence
  Oligomer
ucuuuccauuacacacgag

SEQ ID NO: 76123 - RNA, 19 nt, Artificial Sequence
  Oligomer
uagacuuuggaggucaagu

SEQ ID NO: 76124 - RNA, 19 nt, Artificial Sequence
  Oligomer
uacuagggaagcccuuacu

SEQ ID NO: 76125 - RNA, 19 nt, Artificial Sequence
  Oligomer
uugucauuaccaagguggu

SEQ ID NO: 76126 - RNA, 19 nt, Artificial Sequence
  Oligomer
caaacccaagacagucucu

SEQ ID NO: 76127 - RNA, 19 nt, Artificial Sequence
  Oligomer
ucuugaucaugaccucguc

SEQ ID NO: 76128 - RNA, 19 nt, Artificial Sequence
  Oligomer
ucucucuggcuuuagucuu

SEQ ID NO: 76129 - RNA, 19 nt, Artificial Sequence
  Oligomer
gaucucucuggcuuuaguc

SEQ ID NO: 76130 - RNA, 19 nt, Artificial Sequence
  Oligomer
cauuucuucaaccuggaac

SEQ ID NO: 76131 - RNA, 19 nt, Artificial Sequence
  Oligomer
augcaaccauccacaucgu

SEQ ID NO: 76132 - RNA, 19 nt, Artificial Sequence
  Oligomer
caaguauuugcugcagagg

SEQ ID NO: 76133 - RNA, 19 nt, Artificial Sequence
  Oligomer
uucauucauaagaggaaca

SEQ ID NO: 76134 - RNA, 19 nt, Artificial Sequence
  Oligomer
uucaacacuggcuugggca

SEQ ID NO: 76135 - RNA, 19 nt, Artificial Sequence
  Oligomer
guucaagcagauugccuac

SEQ ID NO: 76136 - RNA, 19 nt, Artificial Sequence
  Oligomer
gaguucaagcagauugccu

SEQ ID NO: 76137 - RNA, 19 nt, Artificial Sequence
  Oligomer
uucuuaccggcugggauga

SEQ ID NO: 76138 - RNA, 19 nt, Artificial Sequence
  Oligomer
ucucccuggaaacacggau

SEQ ID NO: 76139 - RNA, 19 nt, Artificial Sequence
  Oligomer
uacuggauuugccgggaug

SEQ ID NO: 76140 - RNA, 19 nt, Artificial Sequence
  Oligomer
agugcccagccauaucuuc

SEQ ID NO: 76141 - RNA, 19 nt, Artificial Sequence
  Oligomer
cguggcuuuaaaauggcgc

SEQ ID NO: 76142 - RNA, 19 nt, Artificial Sequence
  Oligomer
gauuucaacaagaaguugu

SEQ ID NO: 76143 - RNA, 19 nt, Artificial Sequence
  Oligomer
augcagaauggcagacagu

SEQ ID NO: 76144 - RNA, 19 nt, Artificial Sequence
  Oligomer
aacccaagacagucucucu

SEQ ID NO: 76145 - RNA, 19 nt, Artificial Sequence
  Oligomer
gauuguucgaggccaaacc

SEQ ID NO: 76146 - RNA, 19 nt, Artificial Sequence
  Oligomer
guacacacaccauguuuuc

SEQ ID NO: 76147 - RNA, 19 nt, Artificial Sequence
  Oligomer
guuguucugguacacacac

SEQ ID NO: 76148 - RNA, 19 nt, Artificial Sequence
  Oligomer
augaccucgucaacugagu

SEQ ID NO: 76149 - RNA, 19 nt, Artificial Sequence
  Oligomer
ugcuaaggacaauagcagg

SEQ ID NO: 76150 - RNA, 19 nt, Artificial Sequence
  Oligomer
gaggaacaaguauuugcug

SEQ ID NO: 76151 - RNA, 19 nt, Artificial Sequence
  Oligomer
auuccaaagaacuccacca

SEQ ID NO: 76152 - RNA, 19 nt, Artificial Sequence
  Oligomer
uauuggcguguucuucugu

SEQ ID NO: 76153 - RNA, 19 nt, Artificial Sequence
  Oligomer
cauagcuuuacacugggac

SEQ ID NO: 76154 - RNA, 19 nt, Artificial Sequence
  Oligomer
ugaaugagggucucuccac

SEQ ID NO: 76155 - RNA, 19 nt, Artificial Sequence
  Oligomer
aagcugagcaagguguauu

SEQ ID NO: 76156 - RNA, 19 nt, Artificial Sequence
  Oligomer
cuuuaaaauggcgccaggg

SEQ ID NO: 76157 - RNA, 19 nt, Artificial Sequence
  Oligomer
aagagcaacaaguaucaug

SEQ ID NO: 76158 - RNA, 19 nt, Artificial Sequence
  Oligomer
auuagguucuggcgauuuc

SEQ ID NO: 76159 - RNA, 19 nt, Artificial Sequence
  Oligomer
agaauaauuagguucuggc

SEQ ID NO: 76160 - RNA, 19 nt, Artificial Sequence
  Oligomer
uuuauugacacguucuacu

SEQ ID NO: 76161 - RNA, 19 nt, Artificial Sequence
  Oligomer
accaggaauuccugugacg

SEQ ID NO: 76162 - RNA, 19 nt, Artificial Sequence
  Oligomer
uucuaugggaggcccaacu

SEQ ID NO: 76163 - RNA, 19 nt, Artificial Sequence
  Oligomer
uauuucuuaccggcuggga

SEQ ID NO: 76164 - RNA, 19 nt, Artificial Sequence
  Oligomer
uuugcugaucucuuacucu

SEQ ID NO: 76165 - RNA, 19 nt, Artificial Sequence
  Oligomer
ugguuugcugaucucuuac

SEQ ID NO: 76166 - RNA, 19 nt, Artificial Sequence
  Oligomer
cacuacccagugugugugu

SEQ ID NO: 76167 - RNA, 19 nt, Artificial Sequence
  Oligomer
caggaagacuuuuucagcg

SEQ ID NO: 76168 - RNA, 19 nt, Artificial Sequence
  Oligomer
agcguggcuuuaaaauggc

SEQ ID NO: 76169 - RNA, 19 nt, Artificial Sequence
  Oligomer
agaaauuuccugacagccg

SEQ ID NO: 76170 - RNA, 19 nt, Artificial Sequence
  Oligomer
augaguuguucugguacac

SEQ ID NO: 76171 - RNA, 19 nt, Artificial Sequence
  Oligomer
uagucuugaucaugaccuc

SEQ ID NO: 76172 - RNA, 19 nt, Artificial Sequence
  Oligomer
uuaaugcaaccauccacau

SEQ ID NO: 76173 - RNA, 19 nt, Artificial Sequence
  Oligomer
aacauccagacacagguga

SEQ ID NO: 76174 - RNA, 19 nt, Artificial Sequence
  Oligomer
gauagcuguuaaugcaacc

SEQ ID NO: 76175 - RNA, 19 nt, Artificial Sequence
  Oligomer
aauuuacuagggaagcccu

SEQ ID NO: 76176 - RNA, 19 nt, Artificial Sequence
  Oligomer
acacacgaguuauuuuggg

SEQ ID NO: 76177 - RNA, 19 nt, Artificial Sequence
  Oligomer
gauaugagcucccaguugg

SEQ ID NO: 76178 - RNA, 19 nt, Artificial Sequence
  Oligomer
uacaacaaggagagcuucu

SEQ ID NO: 76179 - RNA, 19 nt, Artificial Sequence
  Oligomer
gcagaagaccuucuauggg

SEQ ID NO: 76180 - RNA, 19 nt, Artificial Sequence
  Oligomer
aagcagaagaccuucuaug

SEQ ID NO: 76181 - RNA, 19 nt, Artificial Sequence
  Oligomer
aacacggaugagugagcag

SEQ ID NO: 76182 - RNA, 19 nt, Artificial Sequence
  Oligomer
auaugguacaaaugcagug

SEQ ID NO: 76183 - RNA, 19 nt, Artificial Sequence
  Oligomer
uucacuacccagugugugu

SEQ ID NO: 76184 - RNA, 19 nt, Artificial Sequence
  Oligomer
cucuggaguccuggaacuu

SEQ ID NO: 76185 - RNA, 19 nt, Artificial Sequence
  Oligomer
uuucaacaagaaguuguca

SEQ ID NO: 76186 - RNA, 19 nt, Artificial Sequence
  Oligomer
uuuccugacagccgaagag

SEQ ID NO: 76187 - RNA, 19 nt, Artificial Sequence
  Oligomer
ccgugccucaauuuucugg

SEQ ID NO: 76188 - RNA, 19 nt, Artificial Sequence
  Oligomer
agggagaagaaauuuccug

SEQ ID NO: 76189 - RNA, 19 nt, Artificial Sequence
  Oligomer
caugaccucgucaacugag

SEQ ID NO: 76190 - RNA, 19 nt, Artificial Sequence
  Oligomer
gugagggagaagaaauuuc

SEQ ID NO: 76191 - RNA, 19 nt, Artificial Sequence
  Oligomer
auuuacuagggaagcccuu

SEQ ID NO: 76192 - RNA, 19 nt, Artificial Sequence
  Oligomer
uguuaaugcaaccauccac

SEQ ID NO: 76193 - RNA, 19 nt, Artificial Sequence
  Oligomer
uuucauucauaagaggaac

SEQ ID NO: 76194 - RNA, 19 nt, Artificial Sequence
  Oligomer
aggucaaguccaggcauug

SEQ ID NO: 76195 - RNA, 19 nt, Artificial Sequence
  Oligomer
cauauuaguacucucaugg

SEQ ID NO: 76196 - RNA, 19 nt, Artificial Sequence
  Oligomer
gaucucuuacucucccugg

SEQ ID NO: 76197 - RNA, 19 nt, Artificial Sequence
  Oligomer
ugcugaucucuuacucucc

SEQ ID NO: 76198 - RNA, 19 nt, Artificial Sequence
  Oligomer
gcugagcaagguguauuuc

SEQ ID NO: 76199 - RNA, 19 nt, Artificial Sequence
  Oligomer
aacaucaccuucuguagag

SEQ ID NO: 76200 - RNA, 19 nt, Artificial Sequence
  Oligomer
uucgaggccaaacccaaga

SEQ ID NO: 76201 - RNA, 19 nt, Artificial Sequence
  Oligomer
aguucaucagacaggccuc

SEQ ID NO: 76202 - RNA, 19 nt, Artificial Sequence
  Oligomer
cagauuucacaaacugguc

SEQ ID NO: 76203 - RNA, 19 nt, Artificial Sequence
  Oligomer
cucagauuucacaaacugg

SEQ ID NO: 76204 - RNA, 19 nt, Artificial Sequence
  Oligomer
aaccucagauuucacaaac

SEQ ID NO: 76205 - RNA, 19 nt, Artificial Sequence
  Oligomer
ccuguugauaugagcuccc

SEQ ID NO: 76206 - RNA, 19 nt, Artificial Sequence
  Oligomer
acuccaccaggaauuccug

SEQ ID NO: 76207 - RNA, 19 nt, Artificial Sequence
  Oligomer
aagaacuccaccaggaauu

SEQ ID NO: 76208 - RNA, 19 nt, Artificial Sequence
  Oligomer
ucucuccaccauauuagua

SEQ ID NO: 76209 - RNA, 19 nt, Artificial Sequence
  Oligomer
gugauuacaggcuuaaagc

SEQ ID NO: 76210 - RNA, 19 nt, Artificial Sequence
  Oligomer
gauuuugaaugagggucuc

SEQ ID NO: 76211 - RNA, 19 nt, Artificial Sequence
  Oligomer
aauuagguucuggcgauuu

SEQ ID NO: 76212 - RNA, 19 nt, Artificial Sequence
  Oligomer
cugaguucaucagacaggc

SEQ ID NO: 76213 - RNA, 19 nt, Artificial Sequence
  Oligomer
aggcaauuagacaaaaacc

SEQ ID NO: 76214 - RNA, 19 nt, Artificial Sequence
  Oligomer
auccgcacugugccugaau

SEQ ID NO: 76215 - RNA, 19 nt, Artificial Sequence
  Oligomer
augucauauacaacagaac

SEQ ID NO: 76216 - RNA, 19 nt, Artificial Sequence
  Oligomer
cuauuacaacaaggagagc

SEQ ID NO: 76217 - RNA, 19 nt, Artificial Sequence
  Oligomer
acuucaaaagaugugccac

SEQ ID NO: 76218 - RNA, 19 nt, Artificial Sequence
  Oligomer
aagcucucucgaggacacu

SEQ ID NO: 76219 - RNA, 19 nt, Artificial Sequence
  Oligomer
cuucuguggaccuaaagcu

SEQ ID NO: 76220 - RNA, 19 nt, Artificial Sequence
  Oligomer
caacuggaacaaugaguuc

SEQ ID NO: 76221 - RNA, 19 nt, Artificial Sequence
  Oligomer
auauauuucuuaccggcug

SEQ ID NO: 76222 - RNA, 19 nt, Artificial Sequence
  Oligomer
aaugcagugaggcacagac

SEQ ID NO: 76223 - RNA, 19 nt, Artificial Sequence
  Oligomer
ucuucugaaaucuauaugg

SEQ ID NO: 76224 - RNA, 19 nt, Artificial Sequence
  Oligomer
aagcguggcuuuaaaaugg

SEQ ID NO: 76225 - RNA, 19 nt, Artificial Sequence
  Oligomer
aucucucuggcuuuagucu

SEQ ID NO: 76226 - RNA, 19 nt, Artificial Sequence
  Oligomer
gugaucucucuggcuuuag

SEQ ID NO: 76227 - RNA, 19 nt, Artificial Sequence
  Oligomer
guauuugcugcagaggacc

SEQ ID NO: 76228 - RNA, 19 nt, Artificial Sequence
  Oligomer
aagaggaacaaguauuugc

SEQ ID NO: 76229 - RNA, 19 nt, Artificial Sequence
  Oligomer
cugaauuuuaacugcaugc

SEQ ID NO: 76230 - RNA, 19 nt, Artificial Sequence
  Oligomer
auuuuggguucaacacugg

SEQ ID NO: 76231 - RNA, 19 nt, Artificial Sequence
  Oligomer
acucucauggcugggaaua

SEQ ID NO: 76232 - RNA, 19 nt, Artificial Sequence
  Oligomer
uacucucccuggaaacacg

SEQ ID NO: 76233 - RNA, 19 nt, Artificial Sequence
  Oligomer
aguccuggaacuucacaug

SEQ ID NO: 76234 - RNA, 19 nt, Artificial Sequence
  Oligomer
auuucaacaagaaguuguc

SEQ ID NO: 76235 - RNA, 19 nt, Artificial Sequence
  Oligomer
ucugcacaacaucaccuuc

SEQ ID NO: 76236 - RNA, 19 nt, Artificial Sequence
  Oligomer
ucucucugcacaacaucac

SEQ ID NO: 76237 - RNA, 19 nt, Artificial Sequence
  Oligomer
uuuccaagcugggcaacac

SEQ ID NO: 76238 - RNA, 19 nt, Artificial Sequence
  Oligomer
gcuguuaaugcaaccaucc

SEQ ID NO: 76239 - RNA, 19 nt, Artificial Sequence
  Oligomer
auaugagcucccaguuggg

SEQ ID NO: 76240 - RNA, 19 nt, Artificial Sequence
  Oligomer
cuccaccaggaauuccugu

SEQ ID NO: 76241 - RNA, 19 nt, Artificial Sequence
  Oligomer
uuaguacucucauggcugg

SEQ ID NO: 76242 - RNA, 19 nt, Artificial Sequence
  Oligomer
accuaaagcucucucgagg

SEQ ID NO: 76243 - RNA, 19 nt, Artificial Sequence
  Oligomer
augguacaaaugcagugag

SEQ ID NO: 76244 - RNA, 19 nt, Artificial Sequence
  Oligomer
ucuucuuucucagccuggc

SEQ ID NO: 76245 - RNA, 19 nt, Artificial Sequence
  Oligomer
aauuccugugacggccugu

SEQ ID NO: 76246 - RNA, 19 nt, Artificial Sequence
  Oligomer
aggcauuguguuuucaauc

SEQ ID NO: 76247 - RNA, 19 nt, Artificial Sequence
  Oligomer
cuuguauucaucagcugac

SEQ ID NO: 76248 - RNA, 19 nt, Artificial Sequence
  Oligomer
aacuggaacaaugaguuca

SEQ ID NO: 76249 - RNA, 19 nt, Artificial Sequence
  Oligomer
uauauuucuuaccggcugg

SEQ ID NO: 76250 - RNA, 19 nt, Artificial Sequence
  Oligomer
uuuggaacugcccugacag

SEQ ID NO: 76251 - RNA, 19 nt, Artificial Sequence
  Oligomer
cuuuuucagcgugcacauc

SEQ ID NO: 76252 - RNA, 19 nt, Artificial Sequence
  Oligomer
aaagcguggcuuuaaaaug

SEQ ID NO: 76253 - RNA, 19 nt, Artificial Sequence
  Oligomer
aaauggauuuuaggcccug

SEQ ID NO: 76254 - RNA, 19 nt, Artificial Sequence
  Oligomer
ucucucucugcacaacauc

SEQ ID NO: 76255 - RNA, 19 nt, Artificial Sequence
  Oligomer
uucugguacacacaccaug

SEQ ID NO: 76256 - RNA, 19 nt, Artificial Sequence
  Oligomer
aauugcuaaggacaauagc

SEQ ID NO: 76257 - RNA, 19 nt, Artificial Sequence
  Oligomer
auuucuucaaccuggaacg

SEQ ID NO: 76258 - RNA, 19 nt, Artificial Sequence
  Oligomer
gaagaggaggagucuuucc

SEQ ID NO: 76259 - RNA, 19 nt, Artificial Sequence
  Oligomer
uaugagcucccaguuggga

SEQ ID NO: 76260 - RNA, 19 nt, Artificial Sequence
  Oligomer
agggaagcccuuacuaacg

SEQ ID NO: 76261 - RNA, 19 nt, Artificial Sequence
  Oligomer
auuggcguguucuucugug

SEQ ID NO: 76262 - RNA, 19 nt, Artificial Sequence
  Oligomer
ucuuacucucccuggaaac

SEQ ID NO: 76263 - RNA, 19 nt, Artificial Sequence
  Oligomer
gagcuuuugagugguuugc

SEQ ID NO: 76264 - RNA, 19 nt, Artificial Sequence
  Oligomer
gguacaaaugcagugaggc

SEQ ID NO: 76265 - RNA, 19 nt, Artificial Sequence
  Oligomer
aagaauaauuagguucugg

SEQ ID NO: 76266 - RNA, 19 nt, Artificial Sequence
  Oligomer
ucucugcacaacaucaccu

SEQ ID NO: 76267 - RNA, 19 nt, Artificial Sequence
  Oligomer
acaggccuccuaugaguug

SEQ ID NO: 76268 - RNA, 19 nt, Artificial Sequence
  Oligomer
augcuaauucuaauaccug

SEQ ID NO: 76269 - RNA, 19 nt, Artificial Sequence
  Oligomer
uuuggguucaacacuggcu

SEQ ID NO: 76270 - RNA, 19 nt, Artificial Sequence
  Oligomer
uauugacacguucuacugg

SEQ ID NO: 76271 - RNA, 19 nt, Artificial Sequence
  Oligomer
aacuccaccaggaauuccu

SEQ ID NO: 76272 - RNA, 19 nt, Artificial Sequence
  Oligomer
uauugauuccaaagaacuc

SEQ ID NO: 76273 - RNA, 19 nt, Artificial Sequence
  Oligomer
auuaguacucucauggcug

SEQ ID NO: 76274 - RNA, 19 nt, Artificial Sequence
  Oligomer
ucuguggaccuaaagcucu

SEQ ID NO: 76275 - RNA, 19 nt, Artificial Sequence
  Oligomer
uuggcguguucuucugugg

SEQ ID NO: 76276 - RNA, 19 nt, Artificial Sequence
  Oligomer
auacugacgugauuacagg

SEQ ID NO: 76277 - RNA, 19 nt, Artificial Sequence
  Oligomer
uagcuuuacacugggacga

SEQ ID NO: 76278 - RNA, 19 nt, Artificial Sequence
  Oligomer
aucaggcucuucacauagc

SEQ ID NO: 76279 - RNA, 19 nt, Artificial Sequence
  Oligomer
uuucuuaccggcugggaug

SEQ ID NO: 76280 - RNA, 19 nt, Artificial Sequence
  Oligomer
uuacuagggaagcccuuac

SEQ ID NO: 76281 - RNA, 19 nt, Artificial Sequence
  Oligomer
uucaucgucuucuuucuca

SEQ ID NO: 76282 - RNA, 19 nt, Artificial Sequence
  Oligomer
guuuucaucgucuucuuuc

SEQ ID NO: 76283 - RNA, 19 nt, Artificial Sequence
  Oligomer
uacacacaccauguuuuca

SEQ ID NO: 76284 - RNA, 19 nt, Artificial Sequence
  Oligomer
gauuucacaaacuggucgc

SEQ ID NO: 76285 - RNA, 19 nt, Artificial Sequence
  Oligomer
auuccugugacggccuguu

SEQ ID NO: 76286 - RNA, 19 nt, Artificial Sequence
  Oligomer
uuccaaagaacuccaccag

SEQ ID NO: 76287 - RNA, 19 nt, Artificial Sequence
  Oligomer
uggaacaaugaguucaagc

SEQ ID NO: 76288 - RNA, 19 nt, Artificial Sequence
  Oligomer
auagcuuuacacugggacg

SEQ ID NO: 76289 - RNA, 19 nt, Artificial Sequence
  Oligomer
acugcccugacagauguau

SEQ ID NO: 76290 - RNA, 19 nt, Artificial Sequence
  Oligomer
ucuaauugccuccuccacg

SEQ ID NO: 76291 - RNA, 19 nt, Artificial Sequence
  Oligomer
ugugaagagccugauuuuc

SEQ ID NO: 76292 - RNA, 19 nt, Artificial Sequence
  Oligomer
augugaagagccugauuuu

SEQ ID NO: 76293 - RNA, 19 nt, Artificial Sequence
  Oligomer
ucuucauaccaguagaacg

SEQ ID NO: 76294 - RNA, 19 nt, Artificial Sequence
  Oligomer
uguugaaaucgccagaacc

SEQ ID NO: 76295 - RNA, 19 nt, Artificial Sequence
  Oligomer
uuuucgucccaguguaaag

SEQ ID NO: 76296 - RNA, 19 nt, Artificial Sequence
  Oligomer
uguccuuagcaauucagug

SEQ ID NO: 76297 - RNA, 19 nt, Artificial Sequence
  Oligomer
uacaaguggcacaucuuuu

SEQ ID NO: 76298 - RNA, 19 nt, Artificial Sequence
  Oligomer
aauuucuucucccucaccu

SEQ ID NO: 76299 - RNA, 19 nt, Artificial Sequence
  Oligomer
uguugggucguuaguaagg

SEQ ID NO: 76300 - RNA, 19 nt, Artificial Sequence
  Oligomer
ucuugcaucccggcaaauc

SEQ ID NO: 76301 - RNA, 19 nt, Artificial Sequence
  Oligomer
uguugaacccaaaauaacu

SEQ ID NO: 76302 - RNA, 19 nt, Artificial Sequence
  Oligomer
uuuugaaguguccucgaga

SEQ ID NO: 76303 - RNA, 19 nt, Artificial Sequence
  Oligomer
uuggguuuggccucgaaca

SEQ ID NO: 76304 - RNA, 19 nt, Artificial Sequence
  Oligomer
guguguaauggaaagacuc

SEQ ID NO: 76305 - RNA, 19 nt, Artificial Sequence
  Oligomer
uuuuaaagccacgcuuuuu

SEQ ID NO: 76306 - RNA, 19 nt, Artificial Sequence
  Oligomer
uucugcauagcggucucua

SEQ ID NO: 76307 - RNA, 19 nt, Artificial Sequence
  Oligomer
uguguguaccagaacaacu

SEQ ID NO: 76308 - RNA, 19 nt, Artificial Sequence
  Oligomer
uuagguccacagaagaaca

SEQ ID NO: 76309 - RNA, 19 nt, Artificial Sequence
  Oligomer
ugucagggcaguuccaaag

SEQ ID NO: 76310 - RNA, 19 nt, Artificial Sequence
  Oligomer
uucggcugucaggaaauuu

SEQ ID NO: 76311 - RNA, 19 nt, Artificial Sequence
  Oligomer
uaucccauaggcgaccagu

SEQ ID NO: 76312 - RNA, 19 nt, Artificial Sequence
  Oligomer
ugucuaauugccuccucca

SEQ ID NO: 76313 - RNA, 19 nt, Artificial Sequence
  Oligomer
uaucaacaggccgucacag

SEQ ID NO: 76314 - RNA, 19 nt, Artificial Sequence
  Oligomer
uugaaaucgccagaaccua

SEQ ID NO: 76315 - RNA, 19 nt, Artificial Sequence
  Oligomer
uauaguguacuguucacaa

SEQ ID NO: 76316 - RNA, 19 nt, Artificial Sequence
  Oligomer
uuagaauuagcaugcaguu

SEQ ID NO: 76317 - RNA, 19 nt, Artificial Sequence
  Oligomer
uaguguacuguucacaaua

SEQ ID NO: 76318 - RNA, 19 nt, Artificial Sequence
  Oligomer
uccugguggaguucuuugg

SEQ ID NO: 76319 - RNA, 19 nt, Artificial Sequence
  Oligomer
ucuccuuguuguaauagaa

SEQ ID NO: 76320 - RNA, 19 nt, Artificial Sequence
  Oligomer
ugcauagcggucucuacag

SEQ ID NO: 76321 - RNA, 19 nt, Artificial Sequence
  Oligomer
aaauuuauucccagccaug

SEQ ID NO: 76322 - RNA, 19 nt, Artificial Sequence
  Oligomer
uccucgagagagcuuuagg

SEQ ID NO: 76323 - RNA, 19 nt, Artificial Sequence
  Oligomer
ucugcuugaacucauuguu

SEQ ID NO: 76324 - RNA, 19 nt, Artificial Sequence
  Oligomer
ugcauuuguaccauauaga

SEQ ID NO: 76325 - RNA, 19 nt, Artificial Sequence
  Oligomer
ugaugaacucaguugacga

SEQ ID NO: 76326 - RNA, 19 nt, Artificial Sequence
  Oligomer
guuccuugccagaaaauug

SEQ ID NO: 76327 - RNA, 19 nt, Artificial Sequence
  Oligomer
ucaguugacgaggucauga

SEQ ID NO: 76328 - RNA, 19 nt, Artificial Sequence
  Oligomer
uauucaccaguucccaacu

SEQ ID NO: 76329 - RNA, 19 nt, Artificial Sequence
  Oligomer
ccuuguuguaauagaaaug

SEQ ID NO: 76330 - RNA, 19 nt, Artificial Sequence
  Oligomer
acuaauaugguggagagac

SEQ ID NO: 76331 - RNA, 19 nt, Artificial Sequence
  Oligomer
uuucaucccagccgguaag

SEQ ID NO: 76332 - RNA, 19 nt, Artificial Sequence
  Oligomer
ugauguugugcagagagag

SEQ ID NO: 76333 - RNA, 19 nt, Artificial Sequence
  Oligomer
ugaucaagacuaaagccag

SEQ ID NO: 76334 - RNA, 19 nt, Artificial Sequence
  Oligomer
uaggcaaucugcuugaacu

SEQ ID NO: 76335 - RNA, 19 nt, Artificial Sequence
  Oligomer
ucugcuuuaagccuguaau

SEQ ID NO: 76336 - RNA, 19 nt, Artificial Sequence
  Oligomer
aagauauggcugggcacug

SEQ ID NO: 76337 - RNA, 19 nt, Artificial Sequence
  Oligomer
cuugguaaugacaacuucu

SEQ ID NO: 76338 - RNA, 19 nt, Artificial Sequence
  Oligomer
uuguccuuagcaauucagu

SEQ ID NO: 76339 - RNA, 19 nt, Artificial Sequence
  Oligomer
ugaaauaagguuucgacug

SEQ ID NO: 76340 - RNA, 19 nt, Artificial Sequence
  Oligomer
aggaaguaugguauagugu

SEQ ID NO: 76341 - RNA, 19 nt, Artificial Sequence
  Oligomer
ugaugaauacaaguggcac

SEQ ID NO: 76342 - RNA, 19 nt, Artificial Sequence
  Oligomer
agccgguaagaaauauaug

SEQ ID NO: 76343 - RNA, 19 nt, Artificial Sequence
  Oligomer
acucaaaagcucuugcauc

SEQ ID NO: 76344 - RNA, 19 nt, Artificial Sequence
  Oligomer
agucuagaagcucuccuug

SEQ ID NO: 76345 - RNA, 19 nt, Artificial Sequence
  Oligomer
ucaguauuuucgucccagu

SEQ ID NO: 76346 - RNA, 19 nt, Artificial Sequence
  Oligomer
ucagcaaaccacucaaaag

SEQ ID NO: 76347 - RNA, 19 nt, Artificial Sequence
  Oligomer
uugcaucccggcaaaucca

SEQ ID NO: 76348 - RNA, 19 nt, Artificial Sequence
  Oligomer
cccucauucaaaauccagc

SEQ ID NO: 76349 - RNA, 19 nt, Artificial Sequence
  Oligomer
uguggaugguugcauuaac

SEQ ID NO: 76350 - RNA, 19 nt, Artificial Sequence
  Oligomer
auguugggucguuaguaag

SEQ ID NO: 76351 - RNA, 19 nt, Artificial Sequence
  Oligomer
ucuuuugaaguguccucga

SEQ ID NO: 76352 - RNA, 19 nt, Artificial Sequence
  Oligomer
ccugauuuucaucccagcc

SEQ ID NO: 76353 - RNA, 19 nt, Artificial Sequence
  Oligomer
uaguaagggcuucccuagu

SEQ ID NO: 76354 - RNA, 19 nt, Artificial Sequence
  Oligomer
uggaugguugcauuaacag

SEQ ID NO: 76355 - RNA, 19 nt, Artificial Sequence
  Oligomer
cuuguuccucuuaugaaug

SEQ ID NO: 76356 - RNA, 19 nt, Artificial Sequence
  Oligomer
gugaagagccugauuuuca

SEQ ID NO: 76357 - RNA, 19 nt, Artificial Sequence
  Oligomer
uuuucaucccagccgguaa

SEQ ID NO: 76358 - RNA, 19 nt, Artificial Sequence
  Oligomer
uccagcgaagauauggcug

SEQ ID NO: 76359 - RNA, 19 nt, Artificial Sequence
  Oligomer
uccucugcagcaaauacuu

SEQ ID NO: 76360 - RNA, 19 nt, Artificial Sequence
  Oligomer
uccuccucuucauaccagu

SEQ ID NO: 76361 - RNA, 19 nt, Artificial Sequence
  Oligomer
aguauuuucgucccagugu

SEQ ID NO: 76362 - RNA, 19 nt, Artificial Sequence
  Oligomer
acucguguguaauggaaag

SEQ ID NO: 76363 - RNA, 19 nt, Artificial Sequence
  Oligomer
agacuccuccucuucauac

SEQ ID NO: 76364 - RNA, 19 nt, Artificial Sequence
  Oligomer
ucuagaagcucuccuuguu

SEQ ID NO: 76365 - RNA, 19 nt, Artificial Sequence
  Oligomer
ugaaguguccucgagagag

SEQ ID NO: 76366 - RNA, 19 nt, Artificial Sequence
  Oligomer
uccacagaagaacacgcca

SEQ ID NO: 76367 - RNA, 19 nt, Artificial Sequence
  Oligomer
uccaguagaaauacaccuu

SEQ ID NO: 76368 - RNA, 19 nt, Artificial Sequence
  Oligomer
uguaccagaacaacucaua

SEQ ID NO: 76369 - RNA, 19 nt, Artificial Sequence
  Oligomer
acaaugccuggacuugacc

SEQ ID NO: 76370 - RNA, 19 nt, Artificial Sequence
  Oligomer
accuccaaagucuagaagc

SEQ ID NO: 76371 - RNA, 19 nt, Artificial Sequence
  Oligomer
agugaaauacaucugucag

SEQ ID NO: 76372 - RNA, 19 nt, Artificial Sequence
  Oligomer
ccuaaaauccauuuccaag

SEQ ID NO: 76373 - RNA, 19 nt, Artificial Sequence
  Oligomer
ucccauaggcgaccaguuu

SEQ ID NO: 76374 - RNA, 19 nt, Artificial Sequence
  Oligomer
uacuuguuccucuuaugaa

SEQ ID NO: 76375 - RNA, 19 nt, Artificial Sequence
  Oligomer
auuauucaccaguucccaa

SEQ ID NO: 76376 - RNA, 19 nt, Artificial Sequence
  Oligomer
ugaagagccugauuuucau

SEQ ID NO: 76377 - RNA, 19 nt, Artificial Sequence
  Oligomer
uccagggagaguaagagau

SEQ ID NO: 76378 - RNA, 19 nt, Artificial Sequence
  Oligomer
ucugcauagcggucucuac

SEQ ID NO: 76379 - RNA, 19 nt, Artificial Sequence
  Oligomer
uguugugcagagagagacu

SEQ ID NO: 76380 - RNA, 19 nt, Artificial Sequence
  Oligomer
acugucuuggguuuggccu

SEQ ID NO: 76381 - RNA, 19 nt, Artificial Sequence
  Oligomer
aucccauaggcgaccaguu

SEQ ID NO: 76382 - RNA, 19 nt, Artificial Sequence
  Oligomer
auuuucgucccaguguaaa

SEQ ID NO: 76383 - RNA, 19 nt, Artificial Sequence
  Oligomer
aaagccacgcuuuuucaug

SEQ ID NO: 76384 - RNA, 19 nt, Artificial Sequence
  Oligomer
ugaaaucgccagaaccuaa

SEQ ID NO: 76385 - RNA, 19 nt, Artificial Sequence
  Oligomer
augaaauaagguuucgacu

SEQ ID NO: 76386 - RNA, 19 nt, Artificial Sequence
  Oligomer
acugggagcucauaucaac

SEQ ID NO: 76387 - RNA, 19 nt, Artificial Sequence
  Oligomer
cugggagcucauaucaaca

SEQ ID NO: 76388 - RNA, 19 nt, Artificial Sequence
  Oligomer
ucacaggaauuccuggugg

SEQ ID NO: 76389 - RNA, 19 nt, Artificial Sequence
  Oligomer
uguaaucacgucaguauuu

SEQ ID NO: 76390 - RNA, 19 nt, Artificial Sequence
  Oligomer
gucaguauuuucgucccag

SEQ ID NO: 76391 - RNA, 19 nt, Artificial Sequence
  Oligomer
auucuuucacaugcauaca

SEQ ID NO: 76392 - RNA, 19 nt, Artificial Sequence
  Oligomer
ugguauaguguacuguuca

SEQ ID NO: 76393 - RNA, 19 nt, Artificial Sequence
  Oligomer
acacaaugccuggacuuga

SEQ ID NO: 76394 - RNA, 19 nt, Artificial Sequence
  Oligomer
cucuccuuguuguaauaga

SEQ ID NO: 76395 - RNA, 19 nt, Artificial Sequence
  Oligomer
ugauuguaggcaaucugcu

SEQ ID NO: 76396 - RNA, 19 nt, Artificial Sequence
  Oligomer
aagagaucagcaaaccacu

SEQ ID NO: 76397 - RNA, 19 nt, Artificial Sequence
  Oligomer
ugccucacugcauuuguac

SEQ ID NO: 76398 - RNA, 19 nt, Artificial Sequence
  Oligomer
acccucauucaaaauccag

SEQ ID NO: 76399 - RNA, 19 nt, Artificial Sequence
  Oligomer
cuggguagugaaauacauc

SEQ ID NO: 76400 - RNA, 19 nt, Artificial Sequence
  Oligomer
gcugaaaaagucuuccugg

SEQ ID NO: 76401 - RNA, 19 nt, Artificial Sequence
  Oligomer
ucaugugaaguuccaggac

SEQ ID NO: 76402 - RNA, 19 nt, Artificial Sequence
  Oligomer
guugaaaucgccagaaccu

SEQ ID NO: 76403 - RNA, 19 nt, Artificial Sequence
  Oligomer
aauccauuuccaagccgag

SEQ ID NO: 76404 - RNA, 19 nt, Artificial Sequence
  Oligomer
ucugagguuuuugucuaau

SEQ ID NO: 76405 - RNA, 19 nt, Artificial Sequence
  Oligomer
guccucugcagcaaauacu

SEQ ID NO: 76406 - RNA, 19 nt, Artificial Sequence
  Oligomer
aacucguguguaauggaaa

SEQ ID NO: 76407 - RNA, 19 nt, Artificial Sequence
  Oligomer
auaucaacaggccgucaca

SEQ ID NO: 76408 - RNA, 19 nt, Artificial Sequence
  Oligomer
caguauuuucgucccagug

SEQ ID NO: 76409 - RNA, 19 nt, Artificial Sequence
  Oligomer
aucagcaaaccacucaaaa

SEQ ID NO: 76410 - RNA, 19 nt, Artificial Sequence
  Oligomer
augugcacgcugaaaaagu

SEQ ID NO: 76411 - RNA, 19 nt, Artificial Sequence
  Oligomer
guugacgaggucaugauca

SEQ ID NO: 76412 - RNA, 19 nt, Artificial Sequence
  Oligomer
acgccugcuauuguccuua

SEQ ID NO: 76413 - RNA, 19 nt, Artificial Sequence
  Oligomer
uccucuucauaccaguaga

SEQ ID NO: 76414 - RNA, 19 nt, Artificial Sequence
  Oligomer
cuaugugaagagccugauu

SEQ ID NO: 76415 - RNA, 19 nt, Artificial Sequence
  Oligomer
uucaucccagccgguaaga

SEQ ID NO: 76416 - RNA, 19 nt, Artificial Sequence
  Oligomer
ugugccucacugcauuugu

SEQ ID NO: 76417 - RNA, 19 nt, Artificial Sequence
  Oligomer
uugugaaaucugagguuuu

SEQ ID NO: 76418 - RNA, 19 nt, Artificial Sequence
  Oligomer
ucuggauguugggucguua

SEQ ID NO: 76419 - RNA, 19 nt, Artificial Sequence
  Oligomer
cuggacuugaccuccaaag

SEQ ID NO: 76420 - RNA, 19 nt, Artificial Sequence
  Oligomer
auagaaggucuucugcuuu

SEQ ID NO: 76421 - RNA, 19 nt, Artificial Sequence
  Oligomer
aucccagccgguaagaaau

SEQ ID NO: 76422 - RNA, 19 nt, Artificial Sequence
  Oligomer
gccgguaagaaauauauga

SEQ ID NO: 76423 - RNA, 19 nt, Artificial Sequence
  Oligomer
uacaucugucagggcaguu

SEQ ID NO: 76424 - RNA, 19 nt, Artificial Sequence
  Oligomer
ucuucggcugucaggaaau

SEQ ID NO: 76425 - RNA, 19 nt, Artificial Sequence
  Oligomer
cuacagaaggugauguugu

SEQ ID NO: 76426 - RNA, 19 nt, Artificial Sequence
  Oligomer
acagcuaucccauaggcga

SEQ ID NO: 76427 - RNA, 19 nt, Artificial Sequence
  Oligomer
uguucuguuguauaugaca

SEQ ID NO: 76428 - RNA, 19 nt, Artificial Sequence
  Oligomer
cuccuuguuguaauagaaa

SEQ ID NO: 76429 - RNA, 19 nt, Artificial Sequence
  Oligomer
agagaucagcaaaccacuc

SEQ ID NO: 76430 - RNA, 19 nt, Artificial Sequence
  Oligomer
agaaauacaccuugcucag

SEQ ID NO: 76431 - RNA, 19 nt, Artificial Sequence
  Oligomer
ucugugccucacugcauuu

SEQ ID NO: 76432 - RNA, 19 nt, Artificial Sequence
  Oligomer
cacugcaccaagauguacu

SEQ ID NO: 76433 - RNA, 19 nt, Artificial Sequence
  Oligomer
acaugcauacaagaccaca

SEQ ID NO: 76434 - RNA, 19 nt, Artificial Sequence
  Oligomer
ugguguguguaccagaaca

SEQ ID NO: 76435 - RNA, 19 nt, Artificial Sequence
  Oligomer
gugaaaucugagguuuuug

SEQ ID NO: 76436 - RNA, 19 nt, Artificial Sequence
  Oligomer
gucuaauugccuccuccac

SEQ ID NO: 76437 - RNA, 19 nt, Artificial Sequence
  Oligomer
ucgacugacagguauuaga

SEQ ID NO: 76438 - RNA, 19 nt, Artificial Sequence
  Oligomer
uguacuguucacaauaguu

SEQ ID NO: 76439 - RNA, 19 nt, Artificial Sequence
  Oligomer
ucauaucaacaggccguca

SEQ ID NO: 76440 - RNA, 19 nt, Artificial Sequence
  Oligomer
aauacaaguggcacaucuu

SEQ ID NO: 76441 - RNA, 19 nt, Artificial Sequence
  Oligomer
aguggcacaucuuuugaag

SEQ ID NO: 76442 - RNA, 19 nt, Artificial Sequence
  Oligomer
agguccacagaagaacacg

SEQ ID NO: 76443 - RNA, 19 nt, Artificial Sequence
  Oligomer
ugcuuuaagccuguaauca

SEQ ID NO: 76444 - RNA, 19 nt, Artificial Sequence
  Oligomer
cugucugccauucugcaua

SEQ ID NO: 76445 - RNA, 19 nt, Artificial Sequence
  Oligomer
acaugguguguguaccaga

SEQ ID NO: 76446 - RNA, 19 nt, Artificial Sequence
  Oligomer
uggauguugggucguuagu

SEQ ID NO: 76447 - RNA, 19 nt, Artificial Sequence
  Oligomer
acuccuccucuucauacca

SEQ ID NO: 76448 - RNA, 19 nt, Artificial Sequence
  Oligomer
uucccaacugggagcucau

SEQ ID NO: 76449 - RNA, 19 nt, Artificial Sequence
  Oligomer
agaagaacacgccaauacu

SEQ ID NO: 76450 - RNA, 19 nt, Artificial Sequence
  Oligomer
auuuucaucccagccggua

SEQ ID NO: 76451 - RNA, 19 nt, Artificial Sequence
  Oligomer
ugcacgcugaaaaagucuu

SEQ ID NO: 76452 - RNA, 19 nt, Artificial Sequence
  Oligomer
cuucuuguugaaaucgcca

SEQ ID NO: 76453 - RNA, 19 nt, Artificial Sequence
  Oligomer
ugcagagagagacugucuu

SEQ ID NO: 76454 - RNA, 19 nt, Artificial Sequence
  Oligomer
aggaaauuucuucucccuc

SEQ ID NO: 76455 - RNA, 19 nt, Artificial Sequence
  Oligomer
ugacgccugcuauuguccu

SEQ ID NO: 76456 - RNA, 19 nt, Artificial Sequence
  Oligomer
uuggaaagugcggccagaa

SEQ ID NO: 76457 - RNA, 19 nt, Artificial Sequence
  Oligomer
cuccaaagucuagaagcuc

SEQ ID NO: 76458 - RNA, 19 nt, Artificial Sequence
  Oligomer
ucagcugaugaauacaagu

SEQ ID NO: 76459 - RNA, 19 nt, Artificial Sequence
  Oligomer
uugaaguguccucgagaga

SEQ ID NO: 76460 - RNA, 19 nt, Artificial Sequence
  Oligomer
augguggagagacccucau

SEQ ID NO: 76461 - RNA, 19 nt, Artificial Sequence
  Oligomer
uuccagggagaguaagaga

SEQ ID NO: 76462 - RNA, 19 nt, Artificial Sequence
  Oligomer
ucgccagaaccuaauuauu

SEQ ID NO: 76463 - RNA, 19 nt, Artificial Sequence
  Oligomer
uccuugccagaaaauugag

SEQ ID NO: 76464 - RNA, 19 nt, Artificial Sequence
  Oligomer
cugcauagcggucucuaca

SEQ ID NO: 76465 - RNA, 19 nt, Artificial Sequence
  Oligomer
aaagaagacgaugaaaaca

SEQ ID NO: 76466 - RNA, 19 nt, Artificial Sequence
  Oligomer
aacucauaggaggccuguc

SEQ ID NO: 76467 - RNA, 19 nt, Artificial Sequence
  Oligomer
ucaagacuaaagccagaga

SEQ ID NO: 76468 - RNA, 19 nt, Artificial Sequence
  Oligomer
acuuguuccucuuaugaau

SEQ ID NO: 76469 - RNA, 19 nt, Artificial Sequence
  Oligomer
agaacgugucaauaaacag

SEQ ID NO: 76470 - RNA, 19 nt, Artificial Sequence
  Oligomer
auuccugguggaguucuuu

SEQ ID NO: 76471 - RNA, 19 nt, Artificial Sequence
  Oligomer
uauuuucgucccaguguaa

SEQ ID NO: 76472 - RNA, 19 nt, Artificial Sequence
  Oligomer
ugguggagagacccucauu

SEQ ID NO: 76473 - RNA, 19 nt, Artificial Sequence
  Oligomer
caaaccacucaaaagcucu

SEQ ID NO: 76474 - RNA, 19 nt, Artificial Sequence
  Oligomer
cgccagaaccuaauuauuc

SEQ ID NO: 76475 - RNA, 19 nt, Artificial Sequence
  Oligomer
uguugcccagcuuggaaag

SEQ ID NO: 76476 - RNA, 19 nt, Artificial Sequence
  Oligomer
cuggauguugggucguuag

SEQ ID NO: 76477 - RNA, 19 nt, Artificial Sequence
  Oligomer
ugaauacaaguggcacauc

SEQ ID NO: 76478 - RNA, 19 nt, Artificial Sequence
  Oligomer
aguacuaauaugguggaga

SEQ ID NO: 76479 - RNA, 19 nt, Artificial Sequence
  Oligomer
ugcucacucauccguguuu

SEQ ID NO: 76480 - RNA, 19 nt, Artificial Sequence
  Oligomer
ccucacugcauuuguacca

SEQ ID NO: 76481 - RNA, 19 nt, Artificial Sequence
  Oligomer
ucugucagggcaguuccaa

SEQ ID NO: 76482 - RNA, 19 nt, Artificial Sequence
  Oligomer
caccuugguaaugacaacu

SEQ ID NO: 76483 - RNA, 19 nt, Artificial Sequence
  Oligomer
accuugguaaugacaacuu

SEQ ID NO: 76484 - RNA, 19 nt, Artificial Sequence
  Oligomer
gaccacagggccuaaaauc

SEQ ID NO: 76485 - RNA, 19 nt, Artificial Sequence
  Oligomer
ugccauucugcauagcggu

SEQ ID NO: 76486 - RNA, 19 nt, Artificial Sequence
  Oligomer
auucccagccaugagagua

SEQ ID NO: 76487 - RNA, 19 nt, Artificial Sequence
  Oligomer
acaccuugcucagcuucag

SEQ ID NO: 76488 - RNA, 19 nt, Artificial Sequence
  Oligomer
ugccacuccagcgaagaua

SEQ ID NO: 76489 - RNA, 19 nt, Artificial Sequence
  Oligomer
auuuuaaagccacgcuuuu

SEQ ID NO: 76490 - RNA, 19 nt, Artificial Sequence
  Oligomer
uggcuuaccaccuugguaa

SEQ ID NO: 76491 - RNA, 19 nt, Artificial Sequence
  Oligomer
uaccaccuugguaaugaca

SEQ ID NO: 76492 - RNA, 19 nt, Artificial Sequence
  Oligomer
guaccagaacaacucauag

SEQ ID NO: 76493 - RNA, 19 nt, Artificial Sequence
  Oligomer
guugagguagcucucguua

SEQ ID NO: 76494 - RNA, 19 nt, Artificial Sequence
  Oligomer
agaaaugcgccacgaugug

SEQ ID NO: 76495 - RNA, 19 nt, Artificial Sequence
  Oligomer
gaaagacuccuccucuuca

SEQ ID NO: 76496 - RNA, 19 nt, Artificial Sequence
  Oligomer
ggaaguaugguauagugua

SEQ ID NO: 76497 - RNA, 19 nt, Artificial Sequence
  Oligomer
aagcucuccuuguuguaau

SEQ ID NO: 76498 - RNA, 19 nt, Artificial Sequence
  Oligomer
ggugauuguaggcaaucug

SEQ ID NO: 76499 - RNA, 19 nt, Artificial Sequence
  Oligomer
cugcuugaacucauuguuc

SEQ ID NO: 76500 - RNA, 19 nt, Artificial Sequence
  Oligomer
acaacucauaggaggccug

SEQ ID NO: 76501 - RNA, 19 nt, Artificial Sequence
  Oligomer
aggccugucugaugaacuc

SEQ ID NO: 76502 - RNA, 19 nt, Artificial Sequence
  Oligomer
cucuucauaccaguagaac

SEQ ID NO: 76503 - RNA, 19 nt, Artificial Sequence
  Oligomer
aaacacaaugccuggacuu

SEQ ID NO: 76504 - RNA, 19 nt, Artificial Sequence
  Oligomer
gucuagaagcucuccuugu

SEQ ID NO: 76505 - RNA, 19 nt, Artificial Sequence
  Oligomer
guuaguaagggcuucccua

SEQ ID NO: 76506 - RNA, 19 nt, Artificial Sequence
  Oligomer
agaacacgccaauacugcu

SEQ ID NO: 76507 - RNA, 19 nt, Artificial Sequence
  Oligomer
ucccggcaaauccaguaga

SEQ ID NO: 76508 - RNA, 19 nt, Artificial Sequence
  Oligomer
auuucagaagagcagcgaa

SEQ ID NO: 76509 - RNA, 19 nt, Artificial Sequence
  Oligomer
ccucauucaaaauccagca

SEQ ID NO: 76510 - RNA, 19 nt, Artificial Sequence
  Oligomer
aucugucagggcaguucca

SEQ ID NO: 76511 - RNA, 19 nt, Artificial Sequence
  Oligomer
ugcccuggcgccauuuuaa

SEQ ID NO: 76512 - RNA, 19 nt, Artificial Sequence
  Oligomer
cuuguugcucuucggcugu

SEQ ID NO: 76513 - RNA, 19 nt, Artificial Sequence
  Oligomer
acagggccuaaaauccauu

SEQ ID NO: 76514 - RNA, 19 nt, Artificial Sequence
  Oligomer
uaagggcuucccuaguaaa

SEQ ID NO: 76515 - RNA, 19 nt, Artificial Sequence
  Oligomer
augguguguguaccagaac

SEQ ID NO: 76516 - RNA, 19 nt, Artificial Sequence
  Oligomer
aguugacgaggucaugauc

SEQ ID NO: 76517 - RNA, 19 nt, Artificial Sequence
  Oligomer
ugacgaggucaugaucaag

SEQ ID NO: 76518 - RNA, 19 nt, Artificial Sequence
  Oligomer
gucaugaucaagacuaaag

SEQ ID NO: 76519 - RNA, 19 nt, Artificial Sequence
  Oligomer
agugguagcguuccagguu

SEQ ID NO: 76520 - RNA, 19 nt, Artificial Sequence
  Oligomer
ucugcagcaaauacuuguu

SEQ ID NO: 76521 - RNA, 19 nt, Artificial Sequence
  Oligomer
cguguguaauggaaagacu

SEQ ID NO: 76522 - RNA, 19 nt, Artificial Sequence
  Oligomer
gcucauaucaacaggccgu

SEQ ID NO: 76523 - RNA, 19 nt, Artificial Sequence
  Oligomer
gaagaacacgccaauacug

SEQ ID NO: 76524 - RNA, 19 nt, Artificial Sequence
  Oligomer
cugcuuuaagccuguaauc

SEQ ID NO: 76525 - RNA, 19 nt, Artificial Sequence
  Oligomer
cuguaaucacgucaguauu

SEQ ID NO: 76526 - RNA, 19 nt, Artificial Sequence
  Oligomer
ucacugcauuuguaccaua

SEQ ID NO: 76527 - RNA, 19 nt, Artificial Sequence
  Oligomer
ucugaugaacucaguugac

SEQ ID NO: 76528 - RNA, 19 nt, Artificial Sequence
  Oligomer
agccagagagaucaccaga

SEQ ID NO: 76529 - RNA, 19 nt, Artificial Sequence
  Oligomer
ugaagaaaugcgccacgau

SEQ ID NO: 76530 - RNA, 19 nt, Artificial Sequence
  Oligomer
aagccaguguugaacccaa

SEQ ID NO: 76531 - RNA, 19 nt, Artificial Sequence
  Oligomer
guguugaacccaaaauaac

SEQ ID NO: 76532 - RNA, 19 nt, Artificial Sequence
  Oligomer
gucacaggaauuccuggug

SEQ ID NO: 76533 - RNA, 19 nt, Artificial Sequence
  Oligomer
cccaguguaaagcuaugug

SEQ ID NO: 76534 - RNA, 19 nt, Artificial Sequence
  Oligomer
aguguaaagcuaugugaag

SEQ ID NO: 76535 - RNA, 19 nt, Artificial Sequence
  Oligomer
uaaagccacgcuuuuucau

SEQ ID NO: 76536 - RNA, 19 nt, Artificial Sequence
  Oligomer
uggguuuggccucgaacaa

SEQ ID NO: 76537 - RNA, 19 nt, Artificial Sequence
  Oligomer
ugcuauuguccuuagcaau

SEQ ID NO: 76538 - RNA, 19 nt, Artificial Sequence
  Oligomer
cucaccugugucuggaugu

SEQ ID NO: 76539 - RNA, 19 nt, Artificial Sequence
  Oligomer
caccugugucuggauguug

SEQ ID NO: 76540 - RNA, 19 nt, Artificial Sequence
  Oligomer
ugucuggauguugggucgu

SEQ ID NO: 76541 - RNA, 19 nt, Artificial Sequence
  Oligomer
aagacuccuccucuucaua

SEQ ID NO: 76542 - RNA, 19 nt, Artificial Sequence
  Oligomer
guagaacgugucaauaaac

SEQ ID NO: 76543 - RNA, 19 nt, Artificial Sequence
  Oligomer
guucuuuggaaucaauaac

SEQ ID NO: 76544 - RNA, 19 nt, Artificial Sequence
  Oligomer
uggacuugaccuccaaagu

SEQ ID NO: 76545 - RNA, 19 nt, Artificial Sequence
  Oligomer
acaucuuuugaaguguccu

SEQ ID NO: 76546 - RNA, 19 nt, Artificial Sequence
  Oligomer
guguccucgagagagcuuu

SEQ ID NO: 76547 - RNA, 19 nt, Artificial Sequence
  Oligomer
cucacucauccguguuucc

SEQ ID NO: 76548 - RNA, 19 nt, Artificial Sequence
  Oligomer
gugaaguuccaggacucca

SEQ ID NO: 76549 - RNA, 19 nt, Artificial Sequence
  Oligomer
ccauucugcauagcggucu

SEQ ID NO: 76550 - RNA, 19 nt, Artificial Sequence
  Oligomer
cugagguuuuugucuaauu

SEQ ID NO: 76551 - RNA, 19 nt, Artificial Sequence
  Oligomer
uggaaagacuccuccucuu

SEQ ID NO: 76552 - RNA, 19 nt, Artificial Sequence
  Oligomer
ucccagccaugagaguacu

SEQ ID NO: 76553 - RNA, 19 nt, Artificial Sequence
  Oligomer
gaagagccugauuuucauc

SEQ ID NO: 76554 - RNA, 19 nt, Artificial Sequence
  Oligomer
ccgguaagaaauauaugau

SEQ ID NO: 76555 - RNA, 19 nt, Artificial Sequence
  Oligomer
agaucagcaaaccacucaa

SEQ ID NO: 76556 - RNA, 19 nt, Artificial Sequence
  Oligomer
acugcauuuguaccauaua

SEQ ID NO: 76557 - RNA, 19 nt, Artificial Sequence
  Oligomer
ggugauguugugcagagag

SEQ ID NO: 76558 - RNA, 19 nt, Artificial Sequence
  Oligomer
gcaguuaaaauucaggcac

SEQ ID NO: 76559 - RNA, 19 nt, Artificial Sequence
  Oligomer
cuugaccuccaaagucuag

SEQ ID NO: 76560 - RNA, 19 nt, Artificial Sequence
  Oligomer
agccaugagaguacuaaua

SEQ ID NO: 76561 - RNA, 19 nt, Artificial Sequence
  Oligomer
aaguguccucgagagagcu

SEQ ID NO: 76562 - RNA, 19 nt, Artificial Sequence
  Oligomer
uguccucgagagagcuuua

SEQ ID NO: 76563 - RNA, 19 nt, Artificial Sequence
  Oligomer
ccauagaaggucuucugcu

SEQ ID NO: 76564 - RNA, 19 nt, Artificial Sequence
  Oligomer
gccugauuuucaucccagc

SEQ ID NO: 76565 - RNA, 19 nt, Artificial Sequence
  Oligomer
guaccauauagauuucaga

SEQ ID NO: 76566 - RNA, 19 nt, Artificial Sequence
  Oligomer
acacacuggguagugaaau

SEQ ID NO: 76567 - RNA, 19 nt, Artificial Sequence
  Oligomer
ugaacucaguugacgaggu

SEQ ID NO: 76568 - RNA, 19 nt, Artificial Sequence
  Oligomer
agaauuagcaugcaguuaa

SEQ ID NO: 76569 - RNA, 19 nt, Artificial Sequence
  Oligomer
guuaaaauucaggcacagu

SEQ ID NO: 76570 - RNA, 19 nt, Artificial Sequence
  Oligomer
caacugggagcucauauca

SEQ ID NO: 76571 - RNA, 19 nt, Artificial Sequence
  Oligomer
aacugggagcucauaucaa

SEQ ID NO: 76572 - RNA, 19 nt, Artificial Sequence
  Oligomer
uggaguucuuuggaaucaa

SEQ ID NO: 76573 - RNA, 19 nt, Artificial Sequence
  Oligomer
gagagcuuuagguccacag

SEQ ID NO: 76574 - RNA, 19 nt, Artificial Sequence
  Oligomer
guauuuucgucccagugua

SEQ ID NO: 76575 - RNA, 19 nt, Artificial Sequence
  Oligomer
guguaaagcuaugugaaga

SEQ ID NO: 76576 - RNA, 19 nt, Artificial Sequence
  Oligomer
acucagaaagugaguuuuc

SEQ ID NO: 76577 - RNA, 19 nt, Artificial Sequence
  Oligomer
cacucauccguguuuccag

SEQ ID NO: 76578 - RNA, 19 nt, Artificial Sequence
  Oligomer
agcaaaccacucaaaagcu

SEQ ID NO: 76579 - RNA, 19 nt, Artificial Sequence
  Oligomer
gugcacgcugaaaaagucu

SEQ ID NO: 76580 - RNA, 19 nt, Artificial Sequence
  Oligomer
caccaagauguacugcccu

SEQ ID NO: 76581 - RNA, 19 nt, Artificial Sequence
  Oligomer
acgcuuuuucaugugaagu

SEQ ID NO: 76582 - RNA, 19 nt, Artificial Sequence
  Oligomer
gugcagagagagacugucu

SEQ ID NO: 76583 - RNA, 19 nt, Artificial Sequence
  Oligomer
uguguaccagaacaacuca

SEQ ID NO: 76584 - RNA, 19 nt, Artificial Sequence
  Oligomer
caguguugaacccaaaaua

SEQ ID NO: 76585 - RNA, 19 nt, Artificial Sequence
  Oligomer
accaguagaacgugucaau

SEQ ID NO: 76586 - RNA, 19 nt, Artificial Sequence
  Oligomer
auaguguacuguucacaau

SEQ ID NO: 76587 - RNA, 19 nt, Artificial Sequence
  Oligomer
cucgagagagcuuuagguc

SEQ ID NO: 76588 - RNA, 19 nt, Artificial Sequence
  Oligomer
gcucacucauccguguuuc

SEQ ID NO: 76589 - RNA, 19 nt, Artificial Sequence
  Oligomer
uguuuccagggagaguaag

SEQ ID NO: 76590 - RNA, 19 nt, Artificial Sequence
  Oligomer
gggagaguaagagaucagc

SEQ ID NO: 76591 - RNA, 19 nt, Artificial Sequence
  Oligomer
gaguaagagaucagcaaac

SEQ ID NO: 76592 - RNA, 19 nt, Artificial Sequence
  Oligomer
caccuugcucagcuucagu

SEQ ID NO: 76593 - RNA, 19 nt, Artificial Sequence
  Oligomer
acuggguagugaaauacau

SEQ ID NO: 76594 - RNA, 19 nt, Artificial Sequence
  Oligomer
ccuugguaaugacaacuuc

SEQ ID NO: 76595 - RNA, 19 nt, Artificial Sequence
  Oligomer
cuuucacaugcauacaaga

SEQ ID NO: 76596 - RNA, 19 nt, Artificial Sequence
  Oligomer
auggccaggcugagaaaga

SEQ ID NO: 76597 - RNA, 19 nt, Artificial Sequence
  Oligomer
gcugagaaagaagacgaug

SEQ ID NO: 76598 - RNA, 19 nt, Artificial Sequence
  Oligomer
agaaagaagacgaugaaaa

SEQ ID NO: 76599 - RNA, 19 nt, Artificial Sequence
  Oligomer
cugucugaugaacucaguu

SEQ ID NO: 76600 - RNA, 19 nt, Artificial Sequence
  Oligomer
cugugucuggauguugggu

SEQ ID NO: 76601 - RNA, 19 nt, Artificial Sequence
  Oligomer
aguguugaacccaaaauaa

SEQ ID NO: 76602 - RNA, 19 nt, Artificial Sequence
  Oligomer
gaugaauacaaguggcaca

SEQ ID NO: 76603 - RNA, 19 nt, Artificial Sequence
  Oligomer
guaaucacgucaguauuuu

SEQ ID NO: 76604 - RNA, 19 nt, Artificial Sequence
  Oligomer
uggagagacccucauucaa

SEQ ID NO: 76605 - RNA, 19 nt, Artificial Sequence
  Oligomer
cuuguugaaaucgccagaa

SEQ ID NO: 76606 - RNA, 19 nt, Artificial Sequence
  Oligomer
cauagcggucucuacagaa

SEQ ID NO: 76607 - RNA, 19 nt, Artificial Sequence
  Oligomer
agaagacgaugaaaacaug

SEQ ID NO: 76608 - RNA, 19 nt, Artificial Sequence
  Oligomer
agcaauucagugguugugu

SEQ ID NO: 76609 - RNA, 19 nt, Artificial Sequence
  Oligomer
guagcguuccagguugaag

SEQ ID NO: 76610 - RNA, 19 nt, Artificial Sequence
  Oligomer
ugugaaaucugagguuuuu

SEQ ID NO: 76611 - RNA, 19 nt, Artificial Sequence
  Oligomer
acugacagguauuagaauu

SEQ ID NO: 76612 - RNA, 19 nt, Artificial Sequence
  Oligomer
caagccaguguugaaccca

SEQ ID NO: 76613 - RNA, 19 nt, Artificial Sequence
  Oligomer
cucguguguaauggaaaga

SEQ ID NO: 76614 - RNA, 19 nt, Artificial Sequence
  Oligomer
acuugaccuccaaagucua

SEQ ID NO: 76615 - RNA, 19 nt, Artificial Sequence
  Oligomer
aguaagggcuucccuagua

SEQ ID NO: 76616 - RNA, 19 nt, Artificial Sequence
  Oligomer
accaccuugguaaugacaa

SEQ ID NO: 76617 - RNA, 19 nt, Artificial Sequence
  Oligomer
agagacugucuuggguuug

SEQ ID NO: 76618 - RNA, 19 nt, Artificial Sequence
  Oligomer
gacgaggucaugaucaaga

SEQ ID NO: 76619 - RNA, 19 nt, Artificial Sequence
  Oligomer
aagacuaaagccagagaga

SEQ ID NO: 76620 - RNA, 19 nt, Artificial Sequence
  Oligomer
gacuaaagccagagagauc

SEQ ID NO: 76621 - RNA, 19 nt, Artificial Sequence
  Oligomer
guuccagguugaagaaaug

SEQ ID NO: 76622 - RNA, 19 nt, Artificial Sequence
  Oligomer
acgauguggaugguugcau

SEQ ID NO: 76623 - RNA, 19 nt, Artificial Sequence
  Oligomer
ccucugcagcaaauacuug

SEQ ID NO: 76624 - RNA, 19 nt, Artificial Sequence
  Oligomer
uguuccucuuaugaaugaa

SEQ ID NO: 76625 - RNA, 19 nt, Artificial Sequence
  Oligomer
ugcccaagccaguguugaa

SEQ ID NO: 76626 - RNA, 19 nt, Artificial Sequence
  Oligomer
guaggcaaucugcuugaac

SEQ ID NO: 76627 - RNA, 19 nt, Artificial Sequence
  Oligomer
aggcaaucugcuugaacuc

SEQ ID NO: 76628 - RNA, 19 nt, Artificial Sequence
  Oligomer
ucaucccagccgguaagaa

SEQ ID NO: 76629 - RNA, 19 nt, Artificial Sequence
  Oligomer
auccguguuuccagggaga

SEQ ID NO: 76630 - RNA, 19 nt, Artificial Sequence
  Oligomer
caucccggcaaauccagua

SEQ ID NO: 76631 - RNA, 19 nt, Artificial Sequence
  Oligomer
gaagauauggcugggcacu

SEQ ID NO: 76632 - RNA, 19 nt, Artificial Sequence
  Oligomer
gcgccauuuuaaagccacg

SEQ ID NO: 76633 - RNA, 19 nt, Artificial Sequence
  Oligomer
acaacuucuuguugaaauc

SEQ ID NO: 76634 - RNA, 19 nt, Artificial Sequence
  Oligomer
acugucugccauucugcau

SEQ ID NO: 76635 - RNA, 19 nt, Artificial Sequence
  Oligomer
agagagacugucuuggguu

SEQ ID NO: 76636 - RNA, 19 nt, Artificial Sequence
  Oligomer
gguuuggccucgaacaauc

SEQ ID NO: 76637 - RNA, 19 nt, Artificial Sequence
  Oligomer
gaaaacaugguguguguac

SEQ ID NO: 76638 - RNA, 19 nt, Artificial Sequence
  Oligomer
guguguguaccagaacaac

SEQ ID NO: 76639 - RNA, 19 nt, Artificial Sequence
  Oligomer
acucaguugacgaggucau

SEQ ID NO: 76640 - RNA, 19 nt, Artificial Sequence
  Oligomer
ccugcuauuguccuuagca

SEQ ID NO: 76641 - RNA, 19 nt, Artificial Sequence
  Oligomer
cagcaaauacuuguuccuc

SEQ ID NO: 76642 - RNA, 19 nt, Artificial Sequence
  Oligomer
ugguggaguucuuuggaau

SEQ ID NO: 76643 - RNA, 19 nt, Artificial Sequence
  Oligomer
acagaagaacacgccaaua

SEQ ID NO: 76644 - RNA, 19 nt, Artificial Sequence
  Oligomer
gucccaguguaaagcuaug

SEQ ID NO: 76645 - RNA, 19 nt, Artificial Sequence
  Oligomer
guggagagacccucauuca

SEQ ID NO: 76646 - RNA, 19 nt, Artificial Sequence
  Oligomer
aauacaccuugcucagcuu

SEQ ID NO: 76647 - RNA, 19 nt, Artificial Sequence
  Oligomer
cccuggcgccauuuuaaag

SEQ ID NO: 76648 - RNA, 19 nt, Artificial Sequence
  Oligomer
caugauacuuguugcucuu

SEQ ID NO: 76649 - RNA, 19 nt, Artificial Sequence
  Oligomer
gaaaucgccagaaccuaau

SEQ ID NO: 76650 - RNA, 19 nt, Artificial Sequence
  Oligomer
gccagaaccuaauuauucu

SEQ ID NO: 76651 - RNA, 19 nt, Artificial Sequence
  Oligomer
aguagaacgugucaauaaa

SEQ ID NO: 76652 - RNA, 19 nt, Artificial Sequence
  Oligomer
cgucacaggaauuccuggu

SEQ ID NO: 76653 - RNA, 19 nt, Artificial Sequence
  Oligomer
aguugggccucccauagaa

SEQ ID NO: 76654 - RNA, 19 nt, Artificial Sequence
  Oligomer
ucccagccgguaagaaaua

SEQ ID NO: 76655 - RNA, 19 nt, Artificial Sequence
  Oligomer
agaguaagagaucagcaaa

SEQ ID NO: 76656 - RNA, 19 nt, Artificial Sequence
  Oligomer
guaagagaucagcaaacca

SEQ ID NO: 76657 - RNA, 19 nt, Artificial Sequence
  Oligomer
acacacacacuggguagug

SEQ ID NO: 76658 - RNA, 19 nt, Artificial Sequence
  Oligomer
cgcugaaaaagucuuccug

SEQ ID NO: 76659 - RNA, 19 nt, Artificial Sequence
  Oligomer
gccauuuuaaagccacgcu

SEQ ID NO: 76660 - RNA, 19 nt, Artificial Sequence
  Oligomer
cggcugucaggaaauuucu

SEQ ID NO: 76661 - RNA, 19 nt, Artificial Sequence
  Oligomer
guguaccagaacaacucau

SEQ ID NO: 76662 - RNA, 19 nt, Artificial Sequence
  Oligomer
gaggucaugaucaagacua

SEQ ID NO: 76663 - RNA, 19 nt, Artificial Sequence
  Oligomer
auguggaugguugcauuaa

SEQ ID NO: 76664 - RNA, 19 nt, Artificial Sequence
  Oligomer
ucaccugugucuggauguu

SEQ ID NO: 76665 - RNA, 19 nt, Artificial Sequence
  Oligomer
gguugcauuaacagcuauc

SEQ ID NO: 76666 - RNA, 19 nt, Artificial Sequence
  Oligomer
agggcuucccuaguaaauu

SEQ ID NO: 76667 - RNA, 19 nt, Artificial Sequence
  Oligomer
cccaaaauaacucgugugu

SEQ ID NO: 76668 - RNA, 19 nt, Artificial Sequence
  Oligomer
ccaacugggagcucauauc

SEQ ID NO: 76669 - RNA, 19 nt, Artificial Sequence
  Oligomer
agaagcucuccuuguugua

SEQ ID NO: 76670 - RNA, 19 nt, Artificial Sequence
  Oligomer
cccauagaaggucuucugc

SEQ ID NO: 76671 - RNA, 19 nt, Artificial Sequence
  Oligomer
cauagaaggucuucugcuu

SEQ ID NO: 76672 - RNA, 19 nt, Artificial Sequence
  Oligomer
cugcucacucauccguguu

SEQ ID NO: 76673 - RNA, 19 nt, Artificial Sequence
  Oligomer
cacugcauuuguaccauau

SEQ ID NO: 76674 - RNA, 19 nt, Artificial Sequence
  Oligomer
acacacacuggguagugaa

SEQ ID NO: 76675 - RNA, 19 nt, Artificial Sequence
  Oligomer
aaguuccaggacuccagag

SEQ ID NO: 76676 - RNA, 19 nt, Artificial Sequence
  Oligomer
ugacaacuucuuguugaaa

SEQ ID NO: 76677 - RNA, 19 nt, Artificial Sequence
  Oligomer
cucuucggcugucaggaaa

SEQ ID NO: 76678 - RNA, 19 nt, Artificial Sequence
  Oligomer
ccagaaaauugaggcacgg

SEQ ID NO: 76679 - RNA, 19 nt, Artificial Sequence
  Oligomer
caggaaauuucuucucccu

SEQ ID NO: 76680 - RNA, 19 nt, Artificial Sequence
  Oligomer
cucaguugacgaggucaug

SEQ ID NO: 76681 - RNA, 19 nt, Artificial Sequence
  Oligomer
gaaauuucuucucccucac

SEQ ID NO: 76682 - RNA, 19 nt, Artificial Sequence
  Oligomer
aagggcuucccuaguaaau

SEQ ID NO: 76683 - RNA, 19 nt, Artificial Sequence
  Oligomer
guggaugguugcauuaaca

SEQ ID NO: 76684 - RNA, 19 nt, Artificial Sequence
  Oligomer
guuccucuuaugaaugaaa

SEQ ID NO: 76685 - RNA, 19 nt, Artificial Sequence
  Oligomer
caaugccuggacuugaccu

SEQ ID NO: 76686 - RNA, 19 nt, Artificial Sequence
  Oligomer
ccaugagaguacuaauaug

SEQ ID NO: 76687 - RNA, 19 nt, Artificial Sequence
  Oligomer
ccagggagaguaagagauc

SEQ ID NO: 76688 - RNA, 19 nt, Artificial Sequence
  Oligomer
ggagaguaagagaucagca

SEQ ID NO: 76689 - RNA, 19 nt, Artificial Sequence
  Oligomer
gaaauacaccuugcucagc

SEQ ID NO: 76690 - RNA, 19 nt, Artificial Sequence
  Oligomer
cucuacagaaggugauguu

SEQ ID NO: 76691 - RNA, 19 nt, Artificial Sequence
  Oligomer
ucuuggguuuggccucgaa

SEQ ID NO: 76692 - RNA, 19 nt, Artificial Sequence
  Oligomer
gaggccugucugaugaacu

SEQ ID NO: 76693 - RNA, 19 nt, Artificial Sequence
  Oligomer
gaccaguuugugaaaucug

SEQ ID NO: 76694 - RNA, 19 nt, Artificial Sequence
  Oligomer
ccaguuugugaaaucugag

SEQ ID NO: 76695 - RNA, 19 nt, Artificial Sequence
  Oligomer
guuugugaaaucugagguu

SEQ ID NO: 76696 - RNA, 19 nt, Artificial Sequence
  Oligomer
gggagcucauaucaacagg

SEQ ID NO: 76697 - RNA, 19 nt, Artificial Sequence
  Oligomer
caggaauuccugguggagu

SEQ ID NO: 76698 - RNA, 19 nt, Artificial Sequence
  Oligomer
aauuccugguggaguucuu

SEQ ID NO: 76699 - RNA, 19 nt, Artificial Sequence
  Oligomer
uacuaauaugguggagaga

SEQ ID NO: 76700 - RNA, 19 nt, Artificial Sequence
  Oligomer
gcuuuaagccuguaaucac

SEQ ID NO: 76701 - RNA, 19 nt, Artificial Sequence
  Oligomer
gagacccucauucaaaauc

SEQ ID NO: 76702 - RNA, 19 nt, Artificial Sequence
  Oligomer
aaaucgccagaaccuaauu

SEQ ID NO: 76703 - RNA, 19 nt, Artificial Sequence
  Oligomer
gccugucugaugaacucag

SEQ ID NO: 76704 - RNA, 19 nt, Artificial Sequence
  Oligomer
gguuuuugucuaauugccu

SEQ ID NO: 76705 - RNA, 19 nt, Artificial Sequence
  Oligomer
auucaggcacagugcggau

SEQ ID NO: 76706 - RNA, 19 nt, Artificial Sequence
  Oligomer
guucuguuguauaugacau

SEQ ID NO: 76707 - RNA, 19 nt, Artificial Sequence
  Oligomer
gcucuccuuguuguaauag

SEQ ID NO: 76708 - RNA, 19 nt, Artificial Sequence
  Oligomer
guggcacaucuuuugaagu

SEQ ID NO: 76709 - RNA, 19 nt, Artificial Sequence
  Oligomer
aguguccucgagagagcuu

SEQ ID NO: 76710 - RNA, 19 nt, Artificial Sequence
  Oligomer
agcuuuagguccacagaag

SEQ ID NO: 76711 - RNA, 19 nt, Artificial Sequence
  Oligomer
gaacucauuguuccaguug

SEQ ID NO: 76712 - RNA, 19 nt, Artificial Sequence
  Oligomer
cagccgguaagaaauauau

SEQ ID NO: 76713 - RNA, 19 nt, Artificial Sequence
  Oligomer
gucugugccucacugcauu

SEQ ID NO: 76714 - RNA, 19 nt, Artificial Sequence
  Oligomer
ccauauagauuucagaaga

SEQ ID NO: 76715 - RNA, 19 nt, Artificial Sequence
  Oligomer
ccauuuuaaagccacgcuu

SEQ ID NO: 76716 - RNA, 19 nt, Artificial Sequence
  Oligomer
agacuaaagccagagagau

SEQ ID NO: 76717 - RNA, 19 nt, Artificial Sequence
  Oligomer
cuaaagccagagagaucac

SEQ ID NO: 76718 - RNA, 19 nt, Artificial Sequence
  Oligomer
gguccucugcagcaaauac

SEQ ID NO: 76719 - RNA, 19 nt, Artificial Sequence
  Oligomer
gcaaauacuuguuccucuu

SEQ ID NO: 76720 - RNA, 19 nt, Artificial Sequence
  Oligomer
gcaugcaguuaaaauucag

SEQ ID NO: 76721 - RNA, 19 nt, Artificial Sequence
  Oligomer
ccaguguugaacccaaaau

SEQ ID NO: 76722 - RNA, 19 nt, Artificial Sequence
  Oligomer
uauucccagccaugagagu

SEQ ID NO: 76723 - RNA, 19 nt, Artificial Sequence
  Oligomer
cguguuuccagggagagua

SEQ ID NO: 76724 - RNA, 19 nt, Artificial Sequence
  Oligomer
caugugaaguuccaggacu

SEQ ID NO: 76725 - RNA, 19 nt, Artificial Sequence
  Oligomer
gacaacuucuuguugaaau

SEQ ID NO: 76726 - RNA, 19 nt, Artificial Sequence
  Oligomer
gaaggugauguugugcaga

SEQ ID NO: 76727 - RNA, 19 nt, Artificial Sequence
  Oligomer
gugauguugugcagagaga

SEQ ID NO: 76728 - RNA, 19 nt, Artificial Sequence
  Oligomer
guguugcccagcuuggaaa

SEQ ID NO: 76729 - RNA, 19 nt, Artificial Sequence
  Oligomer
ggaugguugcauuaacagc

SEQ ID NO: 76730 - RNA, 19 nt, Artificial Sequence
  Oligomer
cccaacugggagcucauau

SEQ ID NO: 76731 - RNA, 19 nt, Artificial Sequence
  Oligomer
acaggaauuccugguggag

SEQ ID NO: 76732 - RNA, 19 nt, Artificial Sequence
  Oligomer
ccagccaugagaguacuaa

SEQ ID NO: 76733 - RNA, 19 nt, Artificial Sequence
  Oligomer
ccucgagagagcuuuaggu

SEQ ID NO: 76734 - RNA, 19 nt, Artificial Sequence
  Oligomer
cucacugcauuuguaccau

SEQ ID NO: 76735 - RNA, 19 nt, Artificial Sequence
  Oligomer
gccaggcugagaaagaaga

SEQ ID NO: 76736 - RNA, 19 nt, Artificial Sequence
  Oligomer
acaggccgucacaggaauu

SEQ ID NO: 76737 - RNA, 19 nt, Artificial Sequence
  Oligomer
gauugaaaacacaaugccu

SEQ ID NO: 76738 - RNA, 19 nt, Artificial Sequence
  Oligomer
gucagcugaugaauacaag

SEQ ID NO: 76739 - RNA, 19 nt, Artificial Sequence
  Oligomer
ugaacucauuguuccaguu

SEQ ID NO: 76740 - RNA, 19 nt, Artificial Sequence
  Oligomer
ccagccgguaagaaauaua

SEQ ID NO: 76741 - RNA, 19 nt, Artificial Sequence
  Oligomer
cugucagggcaguuccaaa

SEQ ID NO: 76742 - RNA, 19 nt, Artificial Sequence
  Oligomer
gaugugcacgcugaaaaag

SEQ ID NO: 76743 - RNA, 19 nt, Artificial Sequence
  Oligomer
cauuuuaaagccacgcuuu

SEQ ID NO: 76744 - RNA, 19 nt, Artificial Sequence
  Oligomer
cagggccuaaaauccauuu

SEQ ID NO: 76745 - RNA, 19 nt, Artificial Sequence
  Oligomer
gauguugugcagagagaga

SEQ ID NO: 76746 - RNA, 19 nt, Artificial Sequence
  Oligomer
caugguguguguaccagaa

SEQ ID NO: 76747 - RNA, 19 nt, Artificial Sequence
  Oligomer
gcuauuguccuuagcaauu

SEQ ID NO: 76748 - RNA, 19 nt, Artificial Sequence
  Oligomer
cguuccagguugaagaaau

SEQ ID NO: 76749 - RNA, 19 nt, Artificial Sequence
  Oligomer
ggaaagacuccuccucuuc

SEQ ID NO: 76750 - RNA, 19 nt, Artificial Sequence
  Oligomer
ucccaacugggagcucaua

SEQ ID NO: 76751 - RNA, 19 nt, Artificial Sequence
  Oligomer
cguuaguaagggcuucccu

SEQ ID NO: 76752 - RNA, 19 nt, Artificial Sequence
  Oligomer
cacagaagaacacgccaau

SEQ ID NO: 76753 - RNA, 19 nt, Artificial Sequence
  Oligomer
guuuccagggagaguaaga

SEQ ID NO: 76754 - RNA, 19 nt, Artificial Sequence
  Oligomer
gcaaaccacucaaaagcuc

SEQ ID NO: 76755 - RNA, 19 nt, Artificial Sequence
  Oligomer
gccucacugcauuuguacc

SEQ ID NO: 76756 - RNA, 19 nt, Artificial Sequence
  Oligomer
ccagaaccuaauuauucuu

SEQ ID NO: 76757 - RNA, 19 nt, Artificial Sequence
  Oligomer
aggugauguugugcagaga

SEQ ID NO: 76758 - RNA, 19 nt, Artificial Sequence
  Oligomer
caacucauaggaggccugu

SEQ ID NO: 76759 - RNA, 19 nt, Artificial Sequence
  Oligomer
cagguauuagaauuagcau

SEQ ID NO: 76760 - RNA, 19 nt, Artificial Sequence
  Oligomer
agccaguguugaacccaaa

SEQ ID NO: 76761 - RNA, 19 nt, Artificial Sequence
  Oligomer
ccaguagaacgugucaaua

SEQ ID NO: 76762 - RNA, 19 nt, Artificial Sequence
  Oligomer
aggaauuccugguggaguu

SEQ ID NO: 76763 - RNA, 19 nt, Artificial Sequence
  Oligomer
gaguucuuuggaaucaaua

SEQ ID NO: 76764 - RNA, 19 nt, Artificial Sequence
  Oligomer
cagccaugagaguacuaau

SEQ ID NO: 76765 - RNA, 19 nt, Artificial Sequence
  Oligomer
agagcuuuagguccacaga

SEQ ID NO: 76766 - RNA, 19 nt, Artificial Sequence
  Oligomer
ccacagaagaacacgccaa

SEQ ID NO: 76767 - RNA, 19 nt, Artificial Sequence
  Oligomer
ccuguaaucacgucaguau

SEQ ID NO: 76768 - RNA, 19 nt, Artificial Sequence
  Oligomer
ucgucccaguguaaagcua

SEQ ID NO: 76769 - RNA, 19 nt, Artificial Sequence
  Oligomer
gcuaugugaagagccugau

SEQ ID NO: 76770 - RNA, 19 nt, Artificial Sequence
  Oligomer
caucccagccgguaagaaa

SEQ ID NO: 76771 - RNA, 19 nt, Artificial Sequence
  Oligomer
guaagggcuucccuaguaa

SEQ ID NO: 76772 - RNA, 19 nt, Artificial Sequence
  Oligomer
ugagaaagaagacgaugaa

SEQ ID NO: 76773 - RNA, 19 nt, Artificial Sequence
  Oligomer
gaaagaagacgaugaaaac

SEQ ID NO: 76774 - RNA, 19 nt, Artificial Sequence
  Oligomer
ugaaaacauggugugugua

SEQ ID NO: 76775 - RNA, 19 nt, Artificial Sequence
  Oligomer
gcgaccaguuugugaaauc

SEQ ID NO: 76776 - RNA, 19 nt, Artificial Sequence
  Oligomer
aacaggccgucacaggaau

SEQ ID NO: 76777 - RNA, 19 nt, Artificial Sequence
  Oligomer
cugguggaguucuuuggaa

SEQ ID NO: 76778 - RNA, 19 nt, Artificial Sequence
  Oligomer
gcuugaacucauuguucca

SEQ ID NO: 76779 - RNA, 19 nt, Artificial Sequence
  Oligomer
cgucccaguguaaagcuau

SEQ ID NO: 76780 - RNA, 19 nt, Artificial Sequence
  Oligomer
auacaucugucagggcagu

SEQ ID NO: 76781 - RNA, 21 nt, Artificial Sequence
  Oligomer
cguggaggaggcaauuagaca

SEQ ID NO: 76782 - RNA, 21 nt, Artificial Sequence
  Oligomer
caucguggcgcauuucuucaa

SEQ ID NO: 76783 - RNA, 21 nt, Artificial Sequence
  Oligomer
ucccuucgcugcucuucugaa

SEQ ID NO: 76784 - RNA, 21 nt, Artificial Sequence
  Oligomer
guugggaacuggugaauaaua

SEQ ID NO: 76785 - RNA, 21 nt, Artificial Sequence
  Oligomer
augaaaaucaggcucuucaca

SEQ ID NO: 76786 - RNA, 21 nt, Artificial Sequence
  Oligomer
uguagagaccgcuaugcagaa

SEQ ID NO: 76787 - RNA, 21 nt, Artificial Sequence
  Oligomer
aaaaucaggcucuucacauag

SEQ ID NO: 76788 - RNA, 21 nt, Artificial Sequence
  Oligomer
gauuguucgaggccaaaccca

SEQ ID NO: 76789 - RNA, 21 nt, Artificial Sequence
  Oligomer
gcaugugaaagaauaauuagg

SEQ ID NO: 76790 - RNA, 21 nt, Artificial Sequence
  Oligomer
ccuggaaacacggaugaguga

SEQ ID NO: 76791 - RNA, 21 nt, Artificial Sequence
  Oligomer
guggaggaggcaauuagacaa

SEQ ID NO: 76792 - RNA, 21 nt, Artificial Sequence
  Oligomer
acaacaaggagagcuucuaga

SEQ ID NO: 76793 - RNA, 21 nt, Artificial Sequence
  Oligomer
uggauuugccgggaugcaaga

SEQ ID NO: 76794 - RNA, 21 nt, Artificial Sequence
  Oligomer
uugggaacuggugaauaauaa

SEQ ID NO: 76795 - RNA, 21 nt, Artificial Sequence
  Oligomer
auuagguucuggcgauuucaa

SEQ ID NO: 76796 - RNA, 21 nt, Artificial Sequence
  Oligomer
cuuuccauuacacacgaguua

SEQ ID NO: 76797 - RNA, 21 nt, Artificial Sequence
  Oligomer
aaaucaggcucuucacauagc

SEQ ID NO: 76798 - RNA, 21 nt, Artificial Sequence
  Oligomer
cgugauuacaggcuuaaagca

SEQ ID NO: 76799 - RNA, 21 nt, Artificial Sequence
  Oligomer
aaggaacccucggcuuggaaa

SEQ ID NO: 76800 - RNA, 21 nt, Artificial Sequence
  Oligomer
ucuugaucaugaccucgucaa

SEQ ID NO: 76801 - RNA, 21 nt, Artificial Sequence
  Oligomer
agcugagcaagguguauuucu

SEQ ID NO: 76802 - RNA, 21 nt, Artificial Sequence
  Oligomer
aguccuggaacuucacaugaa

SEQ ID NO: 76803 - RNA, 21 nt, Artificial Sequence
  Oligomer
acuucuggccgcacuuuccaa

SEQ ID NO: 76804 - RNA, 21 nt, Artificial Sequence
  Oligomer
agcagaagaccuucuauggga

SEQ ID NO: 76805 - RNA, 21 nt, Artificial Sequence
  Oligomer
ugauuacaggcuuaaagcaga

SEQ ID NO: 76806 - RNA, 21 nt, Artificial Sequence
  Oligomer
uguggucuuguaugcauguga

SEQ ID NO: 76807 - RNA, 21 nt, Artificial Sequence
  Oligomer
uacuagggaagcccuuacuaa

SEQ ID NO: 76808 - RNA, 21 nt, Artificial Sequence
  Oligomer
ccuaugaguuguucugguaca

SEQ ID NO: 76809 - RNA, 21 nt, Artificial Sequence
  Oligomer
uggcuuuagucuugaucauga

SEQ ID NO: 76810 - RNA, 21 nt, Artificial Sequence
  Oligomer
guucuacugguaugaagagga

SEQ ID NO: 76811 - RNA, 21 nt, Artificial Sequence
  Oligomer
aaaagaugugccacuuguauu

SEQ ID NO: 76812 - RNA, 21 nt, Artificial Sequence
  Oligomer
gucuuguaugcaugugaaaga

SEQ ID NO: 76813 - RNA, 21 nt, Artificial Sequence
  Oligomer
gucucucucugcacaacauca

SEQ ID NO: 76814 - RNA, 21 nt, Artificial Sequence
  Oligomer
acaucguggcgcauuucuuca

SEQ ID NO: 76815 - RNA, 21 nt, Artificial Sequence
  Oligomer
acaaaaaccucagauuucaca

SEQ ID NO: 76816 - RNA, 21 nt, Artificial Sequence
  Oligomer
caggcauuguguuuucaauca

SEQ ID NO: 76817 - RNA, 21 nt, Artificial Sequence
  Oligomer
ggugcuggauuuugaaugagg

SEQ ID NO: 76818 - RNA, 21 nt, Artificial Sequence
  Oligomer
cuuuggaacugcccugacaga

SEQ ID NO: 76819 - RNA, 21 nt, Artificial Sequence
  Oligomer
auuguucgaggccaaacccaa

SEQ ID NO: 76820 - RNA, 21 nt, Artificial Sequence
  Oligomer
gaucaugaccucgucaacuga

SEQ ID NO: 76821 - RNA, 21 nt, Artificial Sequence
  Oligomer
aaacuggucgccuaugggaua

SEQ ID NO: 76822 - RNA, 21 nt, Artificial Sequence
  Oligomer
caugcuaauucuaauaccugu

SEQ ID NO: 76823 - RNA, 21 nt, Artificial Sequence
  Oligomer
acacugggacgaaaauacuga

SEQ ID NO: 76824 - RNA, 21 nt, Artificial Sequence
  Oligomer
ccaaagaacuccaccaggaau

SEQ ID NO: 76825 - RNA, 21 nt, Artificial Sequence
  Oligomer
caagcagauugccuacaauca

SEQ ID NO: 76826 - RNA, 21 nt, Artificial Sequence
  Oligomer
cuuuacacugggacgaaaaua

SEQ ID NO: 76827 - RNA, 21 nt, Artificial Sequence
  Oligomer
cacuuuccaagcugggcaaca

SEQ ID NO: 76828 - RNA, 21 nt, Artificial Sequence
  Oligomer
uauugacacguucuacuggua

SEQ ID NO: 76829 - RNA, 21 nt, Artificial Sequence
  Oligomer
caaagaacuccaccaggaauu

SEQ ID NO: 76830 - RNA, 21 nt, Artificial Sequence
  Oligomer
uccaaagaacuccaccaggaa

SEQ ID NO: 76831 - RNA, 21 nt, Artificial Sequence
  Oligomer
acuggauuugccgggaugcaa

SEQ ID NO: 76832 - RNA, 21 nt, Artificial Sequence
  Oligomer
cuguagagaccgcuaugcaga

SEQ ID NO: 76833 - RNA, 21 nt, Artificial Sequence
  Oligomer
gguacacacaccauguuuuca

SEQ ID NO: 76834 - RNA, 21 nt, Artificial Sequence
  Oligomer
caucagacaggccuccuauga

SEQ ID NO: 76835 - RNA, 21 nt, Artificial Sequence
  Oligomer
cacugugccugaauuuuaacu

SEQ ID NO: 76836 - RNA, 21 nt, Artificial Sequence
  Oligomer
gaacaguacacuauaccauac

SEQ ID NO: 76837 - RNA, 21 nt, Artificial Sequence
  Oligomer
ucucauggcugggaauaaauu

SEQ ID NO: 76838 - RNA, 21 nt, Artificial Sequence
  Oligomer
agacuuuggaggucaagucca

SEQ ID NO: 76839 - RNA, 21 nt, Artificial Sequence
  Oligomer
cuggaguccuggaacuucaca

SEQ ID NO: 76840 - RNA, 21 nt, Artificial Sequence
  Oligomer
uuccauuacacacgaguuauu

SEQ ID NO: 76841 - RNA, 21 nt, Artificial Sequence
  Oligomer
cuacugguaugaagaggagga

SEQ ID NO: 76842 - RNA, 21 nt, Artificial Sequence
  Oligomer
cauuucuauuacaacaaggag

SEQ ID NO: 76843 - RNA, 21 nt, Artificial Sequence
  Oligomer
aaugagggucucuccaccaua

SEQ ID NO: 76844 - RNA, 21 nt, Artificial Sequence
  Oligomer
agaauaauuagguucuggcga

SEQ ID NO: 76845 - RNA, 21 nt, Artificial Sequence
  Oligomer
agcuguuaaugcaaccaucca

SEQ ID NO: 76846 - RNA, 21 nt, Artificial Sequence
  Oligomer
augugccacuuguauucauca

SEQ ID NO: 76847 - RNA, 21 nt, Artificial Sequence
  Oligomer
guucuggcgauuucaacaaga

SEQ ID NO: 76848 - RNA, 21 nt, Artificial Sequence
  Oligomer
aacccucggcuuggaaaugga

SEQ ID NO: 76849 - RNA, 21 nt, Artificial Sequence
  Oligomer
agaccgcuaugcagaauggca

SEQ ID NO: 76850 - RNA, 21 nt, Artificial Sequence
  Oligomer
cacaacaucaccuucuguaga

SEQ ID NO: 76851 - RNA, 21 nt, Artificial Sequence
  Oligomer
aagaaauuuccugacagccga

SEQ ID NO: 76852 - RNA, 21 nt, Artificial Sequence
  Oligomer
acacguucuacugguaugaag

SEQ ID NO: 76853 - RNA, 21 nt, Artificial Sequence
  Oligomer
uacacuauaccauacuuccuu

SEQ ID NO: 76854 - RNA, 21 nt, Artificial Sequence
  Oligomer
aacacaaccacugaauugcua

SEQ ID NO: 76855 - RNA, 21 nt, Artificial Sequence
  Oligomer
aacaguacacuauaccauacu

SEQ ID NO: 76856 - RNA, 21 nt, Artificial Sequence
  Oligomer
uauugauuccaaagaacucca

SEQ ID NO: 76857 - RNA, 21 nt, Artificial Sequence
  Oligomer
aguccaggcauuguguuuuca

SEQ ID NO: 76858 - RNA, 21 nt, Artificial Sequence
  Oligomer
aguucaagcagauugccuaca

SEQ ID NO: 76859 - RNA, 21 nt, Artificial Sequence
  Oligomer
cauauauuucuuaccggcugg

SEQ ID NO: 76860 - RNA, 21 nt, Artificial Sequence
  Oligomer
agauguauuucacuacccagu

SEQ ID NO: 76861 - RNA, 21 nt, Artificial Sequence
  Oligomer
gaauugcuaaggacaauagca

SEQ ID NO: 76862 - RNA, 21 nt, Artificial Sequence
  Oligomer
agacacaggugagggagaaga

SEQ ID NO: 76863 - RNA, 21 nt, Artificial Sequence
  Oligomer
caaacuggucgccuaugggau

SEQ ID NO: 76864 - RNA, 21 nt, Artificial Sequence
  Oligomer
cuuaccggcugggaugaaaau

SEQ ID NO: 76865 - RNA, 21 nt, Artificial Sequence
  Oligomer
ugaucucuuacucucccugga

SEQ ID NO: 76866 - RNA, 21 nt, Artificial Sequence
  Oligomer
cuucgcugcucuucugaaauc

SEQ ID NO: 76867 - RNA, 21 nt, Artificial Sequence
  Oligomer
cucuggaguccuggaacuuca

SEQ ID NO: 76868 - RNA, 21 nt, Artificial Sequence
  Oligomer
uguucgaggccaaacccaaga

SEQ ID NO: 76869 - RNA, 21 nt, Artificial Sequence
  Oligomer
ccucagauuucacaaacuggu

SEQ ID NO: 76870 - RNA, 21 nt, Artificial Sequence
  Oligomer
cacugaagcugagcaaggugu

SEQ ID NO: 76871 - RNA, 21 nt, Artificial Sequence
  Oligomer
uagguucuggcgauuucaaca

SEQ ID NO: 76872 - RNA, 21 nt, Artificial Sequence
  Oligomer
uguuuauugacacguucuacu

SEQ ID NO: 76873 - RNA, 21 nt, Artificial Sequence
  Oligomer
ugugacggccuguugauauga

SEQ ID NO: 76874 - RNA, 21 nt, Artificial Sequence
  Oligomer
gucaaguccaggcauuguguu

SEQ ID NO: 76875 - RNA, 21 nt, Artificial Sequence
  Oligomer
aauuagguucuggcgauuuca

SEQ ID NO: 76876 - RNA, 21 nt, Artificial Sequence
  Oligomer
uuccugacagccgaagagcaa

SEQ ID NO: 76877 - RNA, 21 nt, Artificial Sequence
  Oligomer
aaauuuccugacagccgaaga

SEQ ID NO: 76878 - RNA, 21 nt, Artificial Sequence
  Oligomer
gaguuauuuuggguucaacac

SEQ ID NO: 76879 - RNA, 21 nt, Artificial Sequence
  Oligomer
uuuccauuacacacgaguuau

SEQ ID NO: 76880 - RNA, 21 nt, Artificial Sequence
  Oligomer
agucuuuccauuacacacgag

SEQ ID NO: 76881 - RNA, 21 nt, Artificial Sequence
  Oligomer
aguauuggcguguucuucugu

SEQ ID NO: 76882 - RNA, 21 nt, Artificial Sequence
  Oligomer
gcuuaaagcagaagaccuucu

SEQ ID NO: 76883 - RNA, 21 nt, Artificial Sequence
  Oligomer
cacugggacgaaaauacugac

SEQ ID NO: 76884 - RNA, 21 nt, Artificial Sequence
  Oligomer
aucaggcucuucacauagcuu

SEQ ID NO: 76885 - RNA, 21 nt, Artificial Sequence
  Oligomer
gaguccuggaacuucacauga

SEQ ID NO: 76886 - RNA, 21 nt, Artificial Sequence
  Oligomer
gacagccgaagagcaacaagu

SEQ ID NO: 76887 - RNA, 21 nt, Artificial Sequence
  Oligomer
caucgucuucuuucucagccu

SEQ ID NO: 76888 - RNA, 21 nt, Artificial Sequence
  Oligomer
acaaguauuugcugcagagga

SEQ ID NO: 76889 - RNA, 21 nt, Artificial Sequence
  Oligomer
acuaacgacccaacauccaga

SEQ ID NO: 76890 - RNA, 21 nt, Artificial Sequence
  Oligomer
ugaagaggaggagucuuucca

SEQ ID NO: 76891 - RNA, 21 nt, Artificial Sequence
  Oligomer
caugucauauacaacagaaca

SEQ ID NO: 76892 - RNA, 21 nt, Artificial Sequence
  Oligomer
ucucgaggacacuucaaaaga

SEQ ID NO: 76893 - RNA, 21 nt, Artificial Sequence
  Oligomer
caggcuuaaagcagaagaccu

SEQ ID NO: 76894 - RNA, 21 nt, Artificial Sequence
  Oligomer
ugcccugacagauguauuuca

SEQ ID NO: 76895 - RNA, 21 nt, Artificial Sequence
  Oligomer
gaacugcccugacagauguau

SEQ ID NO: 76896 - RNA, 21 nt, Artificial Sequence
  Oligomer
uaaaauggcgccagggcagua

SEQ ID NO: 76897 - RNA, 21 nt, Artificial Sequence
  Oligomer
gauuuuaggcccuguggucuu

SEQ ID NO: 76898 - RNA, 21 nt, Artificial Sequence
  Oligomer
uagggaagcccuuacuaacga

SEQ ID NO: 76899 - RNA, 21 nt, Artificial Sequence
  Oligomer
cugggacgaaaauacugacgu

SEQ ID NO: 76900 - RNA, 21 nt, Artificial Sequence
  Oligomer
uagcuuuacacugggacgaaa

SEQ ID NO: 76901 - RNA, 21 nt, Artificial Sequence
  Oligomer
aucucuuacucucccuggaaa

SEQ ID NO: 76902 - RNA, 21 nt, Artificial Sequence
  Oligomer
cuuuaaaauggcgccagggca

SEQ ID NO: 76903 - RNA, 21 nt, Artificial Sequence
  Oligomer
uggaguccuggaacuucacau

SEQ ID NO: 76904 - RNA, 21 nt, Artificial Sequence
  Oligomer
gaaauuuccugacagccgaag

SEQ ID NO: 76905 - RNA, 21 nt, Artificial Sequence
  Oligomer
gaguuguucugguacacacac

SEQ ID NO: 76906 - RNA, 21 nt, Artificial Sequence
  Oligomer
uuacuaacgacccaacaucca

SEQ ID NO: 76907 - RNA, 21 nt, Artificial Sequence
  Oligomer
aggagucuuuccauuacacac

SEQ ID NO: 76908 - RNA, 21 nt, Artificial Sequence
  Oligomer
auuccugugacggccuguuga

SEQ ID NO: 76909 - RNA, 21 nt, Artificial Sequence
  Oligomer
aucauauauuucuuaccggcu

SEQ ID NO: 76910 - RNA, 21 nt, Artificial Sequence
  Oligomer
cuggcgauuucaacaagaagu

SEQ ID NO: 76911 - RNA, 21 nt, Artificial Sequence
  Oligomer
acaacaucaccuucuguagag

SEQ ID NO: 76912 - RNA, 21 nt, Artificial Sequence
  Oligomer
aauuuacuagggaagcccuua

SEQ ID NO: 76913 - RNA, 21 nt, Artificial Sequence
  Oligomer
ucuaauaccugucagucgaaa

SEQ ID NO: 76914 - RNA, 21 nt, Artificial Sequence
  Oligomer
cugugacggccuguugauaug

SEQ ID NO: 76915 - RNA, 21 nt, Artificial Sequence
  Oligomer
cugaagcugagcaagguguau

SEQ ID NO: 76916 - RNA, 21 nt, Artificial Sequence
  Oligomer
guucaucagacaggccuccua

SEQ ID NO: 76917 - RNA, 21 nt, Artificial Sequence
  Oligomer
gaucucucuggcuuuagucuu

SEQ ID NO: 76918 - RNA, 21 nt, Artificial Sequence
  Oligomer
acaaacuggucgccuauggga

SEQ ID NO: 76919 - RNA, 21 nt, Artificial Sequence
  Oligomer
gaggcaauuagacaaaaaccu

SEQ ID NO: 76920 - RNA, 21 nt, Artificial Sequence
  Oligomer
aagcccuuacuaacgacccaa

SEQ ID NO: 76921 - RNA, 21 nt, Artificial Sequence
  Oligomer
aucuguuuauugacacguucu

SEQ ID NO: 76922 - RNA, 21 nt, Artificial Sequence
  Oligomer
gagagcuucuagacuuuggag

SEQ ID NO: 76923 - RNA, 21 nt, Artificial Sequence
  Oligomer
agugguuugcugaucucuuac

SEQ ID NO: 76924 - RNA, 21 nt, Artificial Sequence
  Oligomer
gagcaacaaguaucaugaugg

SEQ ID NO: 76925 - RNA, 21 nt, Artificial Sequence
  Oligomer
ggucuuguaugcaugugaaag

SEQ ID NO: 76926 - RNA, 21 nt, Artificial Sequence
  Oligomer
aagacagucucucucugcaca

SEQ ID NO: 76927 - RNA, 21 nt, Artificial Sequence
  Oligomer
guuguucugguacacacacca

SEQ ID NO: 76928 - RNA, 21 nt, Artificial Sequence
  Oligomer
gugacggccuguugauaugag

SEQ ID NO: 76929 - RNA, 21 nt, Artificial Sequence
  Oligomer
caguauuggcguguucuucug

SEQ ID NO: 76930 - RNA, 21 nt, Artificial Sequence
  Oligomer
gugguuugcugaucucuuacu

SEQ ID NO: 76931 - RNA, 21 nt, Artificial Sequence
  Oligomer
cuauaugguacaaaugcagug

SEQ ID NO: 76932 - RNA, 21 nt, Artificial Sequence
  Oligomer
uuagguucuggcgauuucaac

SEQ ID NO: 76933 - RNA, 21 nt, Artificial Sequence
  Oligomer
uucuguagagaccgcuaugca

SEQ ID NO: 76934 - RNA, 21 nt, Artificial Sequence
  Oligomer
cucugcacaacaucaccuucu

SEQ ID NO: 76935 - RNA, 21 nt, Artificial Sequence
  Oligomer
cauccgcacugugccugaauu

SEQ ID NO: 76936 - RNA, 21 nt, Artificial Sequence
  Oligomer
auuacaacaaggagagcuucu

SEQ ID NO: 76937 - RNA, 21 nt, Artificial Sequence
  Oligomer
auuggcguguucuucugugga

SEQ ID NO: 76938 - RNA, 21 nt, Artificial Sequence
  Oligomer
uuacaggcuuaaagcagaaga

SEQ ID NO: 76939 - RNA, 21 nt, Artificial Sequence
  Oligomer
gacgugauuacaggcuuaaag

SEQ ID NO: 76940 - RNA, 21 nt, Artificial Sequence
  Oligomer
augagggucucuccaccauau

SEQ ID NO: 76941 - RNA, 21 nt, Artificial Sequence
  Oligomer
auuucuuaccggcugggauga

SEQ ID NO: 76942 - RNA, 21 nt, Artificial Sequence
  Oligomer
ucuauaugguacaaaugcagu

SEQ ID NO: 76943 - RNA, 21 nt, Artificial Sequence
  Oligomer
ccuccuaugaguuguucuggu

SEQ ID NO: 76944 - RNA, 21 nt, Artificial Sequence
  Oligomer
ucuggcuuuagucuugaucau

SEQ ID NO: 76945 - RNA, 21 nt, Artificial Sequence
  Oligomer
ugaucucucuggcuuuagucu

SEQ ID NO: 76946 - RNA, 21 nt, Artificial Sequence
  Oligomer
aggugagggagaagaaauuuc

SEQ ID NO: 76947 - RNA, 21 nt, Artificial Sequence
  Oligomer
gucuggugaucucucuggcuu

SEQ ID NO: 76948 - RNA, 21 nt, Artificial Sequence
  Oligomer
aagaggaggagucuuuccauu

SEQ ID NO: 76949 - RNA, 21 nt, Artificial Sequence
  Oligomer
auugacacguucuacugguau

SEQ ID NO: 76950 - RNA, 21 nt, Artificial Sequence
  Oligomer
guacacuauaccauacuuccu

SEQ ID NO: 76951 - RNA, 21 nt, Artificial Sequence
  Oligomer
aggagagcuucuagacuuugg

SEQ ID NO: 76952 - RNA, 21 nt, Artificial Sequence
  Oligomer
uuacaacaaggagagcuucua

SEQ ID NO: 76953 - RNA, 21 nt, Artificial Sequence
  Oligomer
cuggaacaaugaguucaagca

SEQ ID NO: 76954 - RNA, 21 nt, Artificial Sequence
  Oligomer
agagcaacaaguaucaugaug

SEQ ID NO: 76955 - RNA, 21 nt, Artificial Sequence
  Oligomer
gcuuggaaauggauuuuaggc

SEQ ID NO: 76956 - RNA, 21 nt, Artificial Sequence
  Oligomer
ucgucuucuuucucagccugg

SEQ ID NO: 76957 - RNA, 21 nt, Artificial Sequence
  Oligomer
ucucucuggcuuuagucuuga

SEQ ID NO: 76958 - RNA, 21 nt, Artificial Sequence
  Oligomer
ccuaacgagagcuaccucaac

SEQ ID NO: 76959 - RNA, 21 nt, Artificial Sequence
  Oligomer
gaggaggagucuuuccauuac

SEQ ID NO: 76960 - RNA, 21 nt, Artificial Sequence
  Oligomer
acguucuacugguaugaagag

SEQ ID NO: 76961 - RNA, 21 nt, Artificial Sequence
  Oligomer
acuagggaagcccuuacuaac

SEQ ID NO: 76962 - RNA, 21 nt, Artificial Sequence
  Oligomer
aaaauacugacgugauuacag

SEQ ID NO: 76963 - RNA, 21 nt, Artificial Sequence
  Oligomer
aaucaggcucuucacauagcu

SEQ ID NO: 76964 - RNA, 21 nt, Artificial Sequence
  Oligomer
ucauauauuucuuaccggcug

SEQ ID NO: 76965 - RNA, 21 nt, Artificial Sequence
  Oligomer
ugguacaaaugcagugaggca

SEQ ID NO: 76966 - RNA, 21 nt, Artificial Sequence
  Oligomer
uugucauuaccaaggugguaa

SEQ ID NO: 76967 - RNA, 21 nt, Artificial Sequence
  Oligomer
aacaagaaguugucauuacca

SEQ ID NO: 76968 - RNA, 21 nt, Artificial Sequence
  Oligomer
gaagaaauuuccugacagccg

SEQ ID NO: 76969 - RNA, 21 nt, Artificial Sequence
  Oligomer
acugguaugaagaggaggagu

SEQ ID NO: 76970 - RNA, 21 nt, Artificial Sequence
  Oligomer
ugugaacaguacacuauacca

SEQ ID NO: 76971 - RNA, 21 nt, Artificial Sequence
  Oligomer
uacucucauggcugggaauaa

SEQ ID NO: 76972 - RNA, 21 nt, Artificial Sequence
  Oligomer
ucuauuacaacaaggagagcu

SEQ ID NO: 76973 - RNA, 21 nt, Artificial Sequence
  Oligomer
gugauuacaggcuuaaagcag

SEQ ID NO: 76974 - RNA, 21 nt, Artificial Sequence
  Oligomer
cauagcuuuacacugggacga

SEQ ID NO: 76975 - RNA, 21 nt, Artificial Sequence
  Oligomer
aagacuuuuucagcgugcaca

SEQ ID NO: 76976 - RNA, 21 nt, Artificial Sequence
  Oligomer
cauuaccaaggugguaagcca

SEQ ID NO: 76977 - RNA, 21 nt, Artificial Sequence
  Oligomer
uuuaggcccuguggucuugua

SEQ ID NO: 76978 - RNA, 21 nt, Artificial Sequence
  Oligomer
uuuucaucgucuucuuucuca

SEQ ID NO: 76979 - RNA, 21 nt, Artificial Sequence
  Oligomer
uguucugguacacacaccaug

SEQ ID NO: 76980 - RNA, 21 nt, Artificial Sequence
  Oligomer
cauccacaucguggcgcauuu

SEQ ID NO: 76981 - RNA, 21 nt, Artificial Sequence
  Oligomer
gauaugagcucccaguuggga

SEQ ID NO: 76982 - RNA, 21 nt, Artificial Sequence
  Oligomer
uccugugacggccuguugaua

SEQ ID NO: 76983 - RNA, 21 nt, Artificial Sequence
  Oligomer
uuccugugacggccuguugau

SEQ ID NO: 76984 - RNA, 21 nt, Artificial Sequence
  Oligomer
uuucuauuacaacaaggagag

SEQ ID NO: 76985 - RNA, 21 nt, Artificial Sequence
  Oligomer
ucuggaguccuggaacuucac

SEQ ID NO: 76986 - RNA, 21 nt, Artificial Sequence
  Oligomer
gauuucaacaagaaguuguca

SEQ ID NO: 76987 - RNA, 21 nt, Artificial Sequence
  Oligomer
acucucauggcugggaauaaa

SEQ ID NO: 76988 - RNA, 21 nt, Artificial Sequence
  Oligomer
cauauuaguacucucauggcu

SEQ ID NO: 76989 - RNA, 21 nt, Artificial Sequence
  Oligomer
cuggaaacacggaugagugag

SEQ ID NO: 76990 - RNA, 21 nt, Artificial Sequence
  Oligomer
ucucccuggaaacacggauga

SEQ ID NO: 76991 - RNA, 21 nt, Artificial Sequence
  Oligomer
ugagcaagguguauuucuacu

SEQ ID NO: 76992 - RNA, 21 nt, Artificial Sequence
  Oligomer
cugaguucaucagacaggccu

SEQ ID NO: 76993 - RNA, 21 nt, Artificial Sequence
  Oligomer
ucaugaccucgucaacugagu

SEQ ID NO: 76994 - RNA, 21 nt, Artificial Sequence
  Oligomer
ugaucaugaccucgucaacug

SEQ ID NO: 76995 - RNA, 21 nt, Artificial Sequence
  Oligomer
ggagucuuuccauuacacacg

SEQ ID NO: 76996 - RNA, 21 nt, Artificial Sequence
  Oligomer
gaagcccuuacuaacgaccca

SEQ ID NO: 76997 - RNA, 21 nt, Artificial Sequence
  Oligomer
aaagcucucucgaggacacuu

SEQ ID NO: 76998 - RNA, 21 nt, Artificial Sequence
  Oligomer
uuuggaacugcccugacagau

SEQ ID NO: 76999 - RNA, 21 nt, Artificial Sequence
  Oligomer
aggccaaacccaagacagucu

SEQ ID NO: 77000 - RNA, 21 nt, Artificial Sequence
  Oligomer
caacugaguucaucagacagg

SEQ ID NO: 77001 - RNA, 21 nt, Artificial Sequence
  Oligomer
uaauuuacuagggaagcccuu

SEQ ID NO: 77002 - RNA, 21 nt, Artificial Sequence
  Oligomer
cauuacacacgaguuauuuug

SEQ ID NO: 77003 - RNA, 21 nt, Artificial Sequence
  Oligomer
cugguaugaagaggaggaguc

SEQ ID NO: 77004 - RNA, 21 nt, Artificial Sequence
  Oligomer
cguucuacugguaugaagagg

SEQ ID NO: 77005 - RNA, 21 nt, Artificial Sequence
  Oligomer
uaccauacuuccuuagcuuau

SEQ ID NO: 77006 - RNA, 21 nt, Artificial Sequence
  Oligomer
gacuuuggaggucaaguccag

SEQ ID NO: 77007 - RNA, 21 nt, Artificial Sequence
  Oligomer
uaaagcucucucgaggacacu

SEQ ID NO: 77008 - RNA, 21 nt, Artificial Sequence
  Oligomer
agggucucuccaccauauuag

SEQ ID NO: 77009 - RNA, 21 nt, Artificial Sequence
  Oligomer
uacacugggacgaaaauacug

SEQ ID NO: 77010 - RNA, 21 nt, Artificial Sequence
  Oligomer
uuuugaaugagggucucucca

SEQ ID NO: 77011 - RNA, 21 nt, Artificial Sequence
  Oligomer
caaaugcagugaggcacagac

SEQ ID NO: 77012 - RNA, 21 nt, Artificial Sequence
  Oligomer
aauaauuagguucuggcgauu

SEQ ID NO: 77013 - RNA, 21 nt, Artificial Sequence
  Oligomer
aaagaauaauuagguucuggc

SEQ ID NO: 77014 - RNA, 21 nt, Artificial Sequence
  Oligomer
uagagaccgcuaugcagaaug

SEQ ID NO: 77015 - RNA, 21 nt, Artificial Sequence
  Oligomer
agucucucucugcacaacauc

SEQ ID NO: 77016 - RNA, 21 nt, Artificial Sequence
  Oligomer
agacaggccuccuaugaguug

SEQ ID NO: 77017 - RNA, 21 nt, Artificial Sequence
  Oligomer
cgucaacugaguucaucagac

SEQ ID NO: 77018 - RNA, 21 nt, Artificial Sequence
  Oligomer
uagucuugaucaugaccucgu

SEQ ID NO: 77019 - RNA, 21 nt, Artificial Sequence
  Oligomer
auuucacaaacuggucgccua

SEQ ID NO: 77020 - RNA, 21 nt, Artificial Sequence
  Oligomer
auaccugucagucgaaaccuu

SEQ ID NO: 77021 - RNA, 21 nt, Artificial Sequence
  Oligomer
uacuaacgacccaacauccag

SEQ ID NO: 77022 - RNA, 21 nt, Artificial Sequence
  Oligomer
aguuauuuuggguucaacacu

SEQ ID NO: 77023 - RNA, 21 nt, Artificial Sequence
  Oligomer
ugacggccuguugauaugagc

SEQ ID NO: 77024 - RNA, 21 nt, Artificial Sequence
  Oligomer
agaacuccaccaggaauuccu

SEQ ID NO: 77025 - RNA, 21 nt, Artificial Sequence
  Oligomer
agagcuucuagacuuuggagg

SEQ ID NO: 77026 - RNA, 21 nt, Artificial Sequence
  Oligomer
acuggaacaaugaguucaagc

SEQ ID NO: 77027 - RNA, 21 nt, Artificial Sequence
  Oligomer
uuucuuaccggcugggaugaa

SEQ ID NO: 77028 - RNA, 21 nt, Artificial Sequence
  Oligomer
uaucauauauuucuuaccggc

SEQ ID NO: 77029 - RNA, 21 nt, Artificial Sequence
  Oligomer
uuuugagugguuugcugaucu

SEQ ID NO: 77030 - RNA, 21 nt, Artificial Sequence
  Oligomer
gaugcaagagcuuuugagugg

SEQ ID NO: 77031 - RNA, 21 nt, Artificial Sequence
  Oligomer
cauaucuucgcuggaguggca

SEQ ID NO: 77032 - RNA, 21 nt, Artificial Sequence
  Oligomer
ucaucagacaggccuccuaug

SEQ ID NO: 77033 - RNA, 21 nt, Artificial Sequence
  Oligomer
aguucaucagacaggccuccu

SEQ ID NO: 77034 - RNA, 21 nt, Artificial Sequence
  Oligomer
uaacgacccaacauccagaca

SEQ ID NO: 77035 - RNA, 21 nt, Artificial Sequence
  Oligomer
auucuaauaccugucagucga

SEQ ID NO: 77036 - RNA, 21 nt, Artificial Sequence
  Oligomer
cuguugauaugagcucccagu

SEQ ID NO: 77037 - RNA, 21 nt, Artificial Sequence
  Oligomer
gaauuccugugacggccuguu

SEQ ID NO: 77038 - RNA, 21 nt, Artificial Sequence
  Oligomer
gaggucaaguccaggcauugu

SEQ ID NO: 77039 - RNA, 21 nt, Artificial Sequence
  Oligomer
guauuggcguguucuucugug

SEQ ID NO: 77040 - RNA, 21 nt, Artificial Sequence
  Oligomer
cagaagaccuucuaugggagg

SEQ ID NO: 77041 - RNA, 21 nt, Artificial Sequence
  Oligomer
auauuucuuaccggcugggau

SEQ ID NO: 77042 - RNA, 21 nt, Artificial Sequence
  Oligomer
gacagauguauuucacuaccc

SEQ ID NO: 77043 - RNA, 21 nt, Artificial Sequence
  Oligomer
uggaacugcccugacagaugu

SEQ ID NO: 77044 - RNA, 21 nt, Artificial Sequence
  Oligomer
aguugucauuaccaagguggu

SEQ ID NO: 77045 - RNA, 21 nt, Artificial Sequence
  Oligomer
uaaggacaauagcaggcguca

SEQ ID NO: 77046 - RNA, 21 nt, Artificial Sequence
  Oligomer
ucaaccuggaacgcuaccacu

SEQ ID NO: 77047 - RNA, 21 nt, Artificial Sequence
  Oligomer
cuagggaagcccuuacuaacg

SEQ ID NO: 77048 - RNA, 21 nt, Artificial Sequence
  Oligomer
cuucuguggaccuaaagcucu

SEQ ID NO: 77049 - RNA, 21 nt, Artificial Sequence
  Oligomer
aggcccaacuggaacaaugag

SEQ ID NO: 77050 - RNA, 21 nt, Artificial Sequence
  Oligomer
auuacaggcuuaaagcagaag

SEQ ID NO: 77051 - RNA, 21 nt, Artificial Sequence
  Oligomer
uaccggcugggaugaaaauca

SEQ ID NO: 77052 - RNA, 21 nt, Artificial Sequence
  Oligomer
uacucucccuggaaacacgga

SEQ ID NO: 77053 - RNA, 21 nt, Artificial Sequence
  Oligomer
auaugguacaaaugcagugag

SEQ ID NO: 77054 - RNA, 21 nt, Artificial Sequence
  Oligomer
auuucacuacccagugugugu

SEQ ID NO: 77055 - RNA, 21 nt, Artificial Sequence
  Oligomer
agccgaagagcaacaaguauc

SEQ ID NO: 77056 - RNA, 21 nt, Artificial Sequence
  Oligomer
uuuccugacagccgaagagca

SEQ ID NO: 77057 - RNA, 21 nt, Artificial Sequence
  Oligomer
uccacaucguggcgcauuucu

SEQ ID NO: 77058 - RNA, 21 nt, Artificial Sequence
  Oligomer
guugauaugagcucccaguug

SEQ ID NO: 77059 - RNA, 21 nt, Artificial Sequence
  Oligomer
uuacacugggacgaaaauacu

SEQ ID NO: 77060 - RNA, 21 nt, Artificial Sequence
  Oligomer
ucuacuggauuugccgggaug

SEQ ID NO: 77061 - RNA, 21 nt, Artificial Sequence
  Oligomer
aacugcccugacagauguauu

SEQ ID NO: 77062 - RNA, 21 nt, Artificial Sequence
  Oligomer
guucugguacacacaccaugu

SEQ ID NO: 77063 - RNA, 21 nt, Artificial Sequence
  Oligomer
uaugaguuguucugguacaca

SEQ ID NO: 77064 - RNA, 21 nt, Artificial Sequence
  Oligomer
gcuguuaaugcaaccauccac

SEQ ID NO: 77065 - RNA, 21 nt, Artificial Sequence
  Oligomer
ugggauagcuguuaaugcaac

SEQ ID NO: 77066 - RNA, 21 nt, Artificial Sequence
  Oligomer
uaugggauagcuguuaaugca

SEQ ID NO: 77067 - RNA, 21 nt, Artificial Sequence
  Oligomer
auaagaggaacaaguauuugc

SEQ ID NO: 77068 - RNA, 21 nt, Artificial Sequence
  Oligomer
ugugccugaauuuuaacugca

SEQ ID NO: 77069 - RNA, 21 nt, Artificial Sequence
  Oligomer
uacacacgaguuauuuugggu

SEQ ID NO: 77070 - RNA, 21 nt, Artificial Sequence
  Oligomer
uuauugacacguucuacuggu

SEQ ID NO: 77071 - RNA, 21 nt, Artificial Sequence
  Oligomer
aaggagagcuucuagacuuug

SEQ ID NO: 77072 - RNA, 21 nt, Artificial Sequence
  Oligomer
aagaugugccacuuguauuca

SEQ ID NO: 77073 - RNA, 21 nt, Artificial Sequence
  Oligomer
cacuucaaaagaugugccacu

SEQ ID NO: 77074 - RNA, 21 nt, Artificial Sequence
  Oligomer
cguggcuuuaaaauggcgcca

SEQ ID NO: 77075 - RNA, 21 nt, Artificial Sequence
  Oligomer
ucuggcgauuucaacaagaag

SEQ ID NO: 77076 - RNA, 21 nt, Artificial Sequence
  Oligomer
auggauuuuaggcccuguggu

SEQ ID NO: 77077 - RNA, 21 nt, Artificial Sequence
  Oligomer
aauggcagacaguggcccaau

SEQ ID NO: 77078 - RNA, 21 nt, Artificial Sequence
  Oligomer
cacacaccauguuuucaucgu

SEQ ID NO: 77079 - RNA, 21 nt, Artificial Sequence
  Oligomer
uucugguacacacaccauguu

SEQ ID NO: 77080 - RNA, 21 nt, Artificial Sequence
  Oligomer
cuaacgacccaacauccagac

SEQ ID NO: 77081 - RNA, 21 nt, Artificial Sequence
  Oligomer
guuauuuuggguucaacacug

SEQ ID NO: 77082 - RNA, 21 nt, Artificial Sequence
  Oligomer
guuuauugacacguucuacug

SEQ ID NO: 77083 - RNA, 21 nt, Artificial Sequence
  Oligomer
ugauaugagcucccaguuggg

SEQ ID NO: 77084 - RNA, 21 nt, Artificial Sequence
  Oligomer
uuccaaagaacuccaccagga

SEQ ID NO: 77085 - RNA, 21 nt, Artificial Sequence
  Oligomer
ugauuccaaagaacuccacca

SEQ ID NO: 77086 - RNA, 21 nt, Artificial Sequence
  Oligomer
aggucaaguccaggcauugug

SEQ ID NO: 77087 - RNA, 21 nt, Artificial Sequence
  Oligomer
cucucgaggacacuucaaaag

SEQ ID NO: 77088 - RNA, 21 nt, Artificial Sequence
  Oligomer
cuaaagcucucucgaggacac

SEQ ID NO: 77089 - RNA, 21 nt, Artificial Sequence
  Oligomer
cucuuacucucccuggaaaca

SEQ ID NO: 77090 - RNA, 21 nt, Artificial Sequence
  Oligomer
guuugcugaucucuuacucuc

SEQ ID NO: 77091 - RNA, 21 nt, Artificial Sequence
  Oligomer
uguauuucacuacccagugug

SEQ ID NO: 77092 - RNA, 21 nt, Artificial Sequence
  Oligomer
uuaaaauggcgccagggcagu

SEQ ID NO: 77093 - RNA, 21 nt, Artificial Sequence
  Oligomer
aaauggauuuuaggcccugug

SEQ ID NO: 77094 - RNA, 21 nt, Artificial Sequence
  Oligomer
acugcaugcuaauucuaauac

SEQ ID NO: 77095 - RNA, 21 nt, Artificial Sequence
  Oligomer
aguacacuauaccauacuucc

SEQ ID NO: 77096 - RNA, 21 nt, Artificial Sequence
  Oligomer
uuuggaggucaaguccaggca

SEQ ID NO: 77097 - RNA, 21 nt, Artificial Sequence
  Oligomer
uacugacgugauuacaggcuu

SEQ ID NO: 77098 - RNA, 21 nt, Artificial Sequence
  Oligomer
gcuggauuuugaaugaggguc

SEQ ID NO: 77099 - RNA, 21 nt, Artificial Sequence
  Oligomer
gcucuucugaaaucuauaugg

SEQ ID NO: 77100 - RNA, 21 nt, Artificial Sequence
  Oligomer
ugucauuaccaaggugguaag

SEQ ID NO: 77101 - RNA, 21 nt, Artificial Sequence
  Oligomer
auguuuucaucgucuucuuuc

SEQ ID NO: 77102 - RNA, 21 nt, Artificial Sequence
  Oligomer
cuucaaccuggaacgcuacca

SEQ ID NO: 77103 - RNA, 21 nt, Artificial Sequence
  Oligomer
uuucuucaaccuggaacgcua

SEQ ID NO: 77104 - RNA, 21 nt, Artificial Sequence
  Oligomer
auuucuucaaccuggaacgcu

SEQ ID NO: 77105 - RNA, 21 nt, Artificial Sequence
  Oligomer
aguauuugcugcagaggaccg

SEQ ID NO: 77106 - RNA, 21 nt, Artificial Sequence
  Oligomer
uauuuuggguucaacacuggc

SEQ ID NO: 77107 - RNA, 21 nt, Artificial Sequence
  Oligomer
ucuacugguaugaagaggagg

SEQ ID NO: 77108 - RNA, 21 nt, Artificial Sequence
  Oligomer
gacggccuguugauaugagcu

SEQ ID NO: 77109 - RNA, 21 nt, Artificial Sequence
  Oligomer
uuaguacucucauggcuggga

SEQ ID NO: 77110 - RNA, 21 nt, Artificial Sequence
  Oligomer
aacaaggagagcuucuagacu

SEQ ID NO: 77111 - RNA, 21 nt, Artificial Sequence
  Oligomer
cacuuguauucaucagcugac

SEQ ID NO: 77112 - RNA, 21 nt, Artificial Sequence
  Oligomer
caaugaguucaagcagauugc

SEQ ID NO: 77113 - RNA, 21 nt, Artificial Sequence
  Oligomer
gugcuggauuuugaaugaggg

SEQ ID NO: 77114 - RNA, 21 nt, Artificial Sequence
  Oligomer
guugucauuaccaagguggua

SEQ ID NO: 77115 - RNA, 21 nt, Artificial Sequence
  Oligomer
ucuguagagaccgcuaugcag

SEQ ID NO: 77116 - RNA, 21 nt, Artificial Sequence
  Oligomer
uuucucagccuggccauccau

SEQ ID NO: 77117 - RNA, 21 nt, Artificial Sequence
  Oligomer
gacaggccuccuaugaguugu

SEQ ID NO: 77118 - RNA, 21 nt, Artificial Sequence
  Oligomer
aucagacaggccuccuaugag

SEQ ID NO: 77119 - RNA, 21 nt, Artificial Sequence
  Oligomer
ugagggagaagaaauuuccug

SEQ ID NO: 77120 - RNA, 21 nt, Artificial Sequence
  Oligomer
gcuuuagucuugaucaugacc

SEQ ID NO: 77121 - RNA, 21 nt, Artificial Sequence
  Oligomer
cacaucguggcgcauuucuuc

SEQ ID NO: 77122 - RNA, 21 nt, Artificial Sequence
  Oligomer
auauuaguacucucauggcug

SEQ ID NO: 77123 - RNA, 21 nt, Artificial Sequence
  Oligomer
ugugccacuuguauucaucag

SEQ ID NO: 77124 - RNA, 21 nt, Artificial Sequence
  Oligomer
augaguucaagcagauugccu

SEQ ID NO: 77125 - RNA, 21 nt, Artificial Sequence
  Oligomer
gucucuccaccauauuaguac

SEQ ID NO: 77126 - RNA, 21 nt, Artificial Sequence
  Oligomer
uaaagcagaagaccuucuaug

SEQ ID NO: 77127 - RNA, 21 nt, Artificial Sequence
  Oligomer
uuuuaggcccuguggucuugu

SEQ ID NO: 77128 - RNA, 21 nt, Artificial Sequence
  Oligomer
ucucucugcacaacaucaccu

SEQ ID NO: 77129 - RNA, 21 nt, Artificial Sequence
  Oligomer
uuguucgaggccaaacccaag

SEQ ID NO: 77130 - RNA, 21 nt, Artificial Sequence
  Oligomer
aaccacugaauugcuaaggac

SEQ ID NO: 77131 - RNA, 21 nt, Artificial Sequence
  Oligomer
aaugcaaccauccacaucgug

SEQ ID NO: 77132 - RNA, 21 nt, Artificial Sequence
  Oligomer
accucagauuucacaaacugg

SEQ ID NO: 77133 - RNA, 21 nt, Artificial Sequence
  Oligomer
cauaagaggaacaaguauuug

SEQ ID NO: 77134 - RNA, 21 nt, Artificial Sequence
  Oligomer
ucauucauaagaggaacaagu

SEQ ID NO: 77135 - RNA, 21 nt, Artificial Sequence
  Oligomer
aacuccaccaggaauuccugu

SEQ ID NO: 77136 - RNA, 21 nt, Artificial Sequence
  Oligomer
cuguggaccuaaagcucucuc

SEQ ID NO: 77137 - RNA, 21 nt, Artificial Sequence
  Oligomer
uauauuucuuaccggcuggga

SEQ ID NO: 77138 - RNA, 21 nt, Artificial Sequence
  Oligomer
uggaaacacggaugagugagc

SEQ ID NO: 77139 - RNA, 21 nt, Artificial Sequence
  Oligomer
uacuggauuugccgggaugca

SEQ ID NO: 77140 - RNA, 21 nt, Artificial Sequence
  Oligomer
gguacaaaugcagugaggcac

SEQ ID NO: 77141 - RNA, 21 nt, Artificial Sequence
  Oligomer
uuuaaaauggcgccagggcag

SEQ ID NO: 77142 - RNA, 21 nt, Artificial Sequence
  Oligomer
ucagacaggccuccuaugagu

SEQ ID NO: 77143 - RNA, 21 nt, Artificial Sequence
  Oligomer
cuugaucaugaccucgucaac

SEQ ID NO: 77144 - RNA, 21 nt, Artificial Sequence
  Oligomer
gugagggagaagaaauuuccu

SEQ ID NO: 77145 - RNA, 21 nt, Artificial Sequence
  Oligomer
cuuuagucuugaucaugaccu

SEQ ID NO: 77146 - RNA, 21 nt, Artificial Sequence
  Oligomer
uuucacaaacuggucgccuau

SEQ ID NO: 77147 - RNA, 21 nt, Artificial Sequence
  Oligomer
guauuugcugcagaggaccgu

SEQ ID NO: 77148 - RNA, 21 nt, Artificial Sequence
  Oligomer
aaguauuugcugcagaggacc

SEQ ID NO: 77149 - RNA, 21 nt, Artificial Sequence
  Oligomer
cugcaugcuaauucuaauacc

SEQ ID NO: 77150 - RNA, 21 nt, Artificial Sequence
  Oligomer
uugugaacaguacacuauacc

SEQ ID NO: 77151 - RNA, 21 nt, Artificial Sequence
  Oligomer
gaggacacuucaaaagaugug

SEQ ID NO: 77152 - RNA, 21 nt, Artificial Sequence
  Oligomer
uggaccuaaagcucucucgag

SEQ ID NO: 77153 - RNA, 21 nt, Artificial Sequence
  Oligomer
acgugauuacaggcuuaaagc

SEQ ID NO: 77154 - RNA, 21 nt, Artificial Sequence
  Oligomer
uuuacacugggacgaaaauac

SEQ ID NO: 77155 - RNA, 21 nt, Artificial Sequence
  Oligomer
gcugggaugaaaaucaggcuc

SEQ ID NO: 77156 - RNA, 21 nt, Artificial Sequence
  Oligomer
uuugccgggaugcaagagcuu

SEQ ID NO: 77157 - RNA, 21 nt, Artificial Sequence
  Oligomer
uaugguacaaaugcagugagg

SEQ ID NO: 77158 - RNA, 21 nt, Artificial Sequence
  Oligomer
cuucugaaaucuauaugguac

SEQ ID NO: 77159 - RNA, 21 nt, Artificial Sequence
  Oligomer
aacccaagacagucucucucu

SEQ ID NO: 77160 - RNA, 21 nt, Artificial Sequence
  Oligomer
cacaaccacugaauugcuaag

SEQ ID NO: 77161 - RNA, 21 nt, Artificial Sequence
  Oligomer
acccaacauccagacacaggu

SEQ ID NO: 77162 - RNA, 21 nt, Artificial Sequence
  Oligomer
ccuuacuaacgacccaacauc

SEQ ID NO: 77163 - RNA, 21 nt, Artificial Sequence
  Oligomer
uuauuuuggguucaacacugg

SEQ ID NO: 77164 - RNA, 21 nt, Artificial Sequence
  Oligomer
uauaccauacuuccuuagcuu

SEQ ID NO: 77165 - RNA, 21 nt, Artificial Sequence
  Oligomer
ucuagacuuuggaggucaagu

SEQ ID NO: 77166 - RNA, 21 nt, Artificial Sequence
  Oligomer
accuaaagcucucucgaggac

SEQ ID NO: 77167 - RNA, 21 nt, Artificial Sequence
  Oligomer
acaaugaguucaagcagauug

SEQ ID NO: 77168 - RNA, 21 nt, Artificial Sequence
  Oligomer
aauacugacgugauuacaggc

SEQ ID NO: 77169 - RNA, 21 nt, Artificial Sequence
  Oligomer
uucuuaccggcugggaugaaa

SEQ ID NO: 77170 - RNA, 21 nt, Artificial Sequence
  Oligomer
acucucccuggaaacacggau

SEQ ID NO: 77171 - RNA, 21 nt, Artificial Sequence
  Oligomer
uucacuacccagugugugugu

SEQ ID NO: 77172 - RNA, 21 nt, Artificial Sequence
  Oligomer
uaauuagguucuggcgauuuc

SEQ ID NO: 77173 - RNA, 21 nt, Artificial Sequence
  Oligomer
cuuggaaauggauuuuaggcc

SEQ ID NO: 77174 - RNA, 21 nt, Artificial Sequence
  Oligomer
ucggauuguucgaggccaaac

SEQ ID NO: 77175 - RNA, 21 nt, Artificial Sequence
  Oligomer
aauugcuaaggacaauagcag

SEQ ID NO: 77176 - RNA, 21 nt, Artificial Sequence
  Oligomer
gagcuuuugagugguuugcug

SEQ ID NO: 77177 - RNA, 21 nt, Artificial Sequence
  Oligomer
aucuauaugguacaaaugcag

SEQ ID NO: 77178 - RNA, 21 nt, Artificial Sequence
  Oligomer
aggaagacuuuuucagcgugc

SEQ ID NO: 77179 - RNA, 21 nt, Artificial Sequence
  Oligomer
aaaaagcguggcuuuaaaaug

SEQ ID NO: 77180 - RNA, 21 nt, Artificial Sequence
  Oligomer
aagaaguugucauuaccaagg

SEQ ID NO: 77181 - RNA, 21 nt, Artificial Sequence
  Oligomer
uaugcagaauggcagacagug

SEQ ID NO: 77182 - RNA, 21 nt, Artificial Sequence
  Oligomer
ucucucucugcacaacaucac

SEQ ID NO: 77183 - RNA, 21 nt, Artificial Sequence
  Oligomer
ucuucuuucucagccuggcca

SEQ ID NO: 77184 - RNA, 21 nt, Artificial Sequence
  Oligomer
cuaugggauagcuguuaaugc

SEQ ID NO: 77185 - RNA, 21 nt, Artificial Sequence
  Oligomer
aaagaugugccacuuguauuc

SEQ ID NO: 77186 - RNA, 21 nt, Artificial Sequence
  Oligomer
uuggcguguucuucuguggac

SEQ ID NO: 77187 - RNA, 21 nt, Artificial Sequence
  Oligomer
aacucacuuucugaguuauca

SEQ ID NO: 77188 - RNA, 21 nt, Artificial Sequence
  Oligomer
augcaagagcuuuugaguggu

SEQ ID NO: 77189 - RNA, 21 nt, Artificial Sequence
  Oligomer
acugcccugacagauguauuu

SEQ ID NO: 77190 - RNA, 21 nt, Artificial Sequence
  Oligomer
aagcguggcuuuaaaauggcg

SEQ ID NO: 77191 - RNA, 21 nt, Artificial Sequence
  Oligomer
cuguggucuuguaugcaugug

SEQ ID NO: 77192 - RNA, 21 nt, Artificial Sequence
  Oligomer
cucucucugcacaacaucacc

SEQ ID NO: 77193 - RNA, 21 nt, Artificial Sequence
  Oligomer
augaguuguucugguacacac

SEQ ID NO: 77194 - RNA, 21 nt, Artificial Sequence
  Oligomer
aacuggucgccuaugggauag

SEQ ID NO: 77195 - RNA, 21 nt, Artificial Sequence
  Oligomer
uuuuggguucaacacuggcuu

SEQ ID NO: 77196 - RNA, 21 nt, Artificial Sequence
  Oligomer
auuuuggguucaacacuggcu

SEQ ID NO: 77197 - RNA, 21 nt, Artificial Sequence
  Oligomer
uugacacguucuacugguaug

SEQ ID NO: 77198 - RNA, 21 nt, Artificial Sequence
  Oligomer
acuccaccaggaauuccugug

SEQ ID NO: 77199 - RNA, 21 nt, Artificial Sequence
  Oligomer
uuggaggucaaguccaggcau

SEQ ID NO: 77200 - RNA, 21 nt, Artificial Sequence
  Oligomer
guauuucuacuggauuugccg

SEQ ID NO: 77201 - RNA, 21 nt, Artificial Sequence
  Oligomer
aauggauuuuaggcccugugg

SEQ ID NO: 77202 - RNA, 21 nt, Artificial Sequence
  Oligomer
agcagauugccuacaaucacc

SEQ ID NO: 77203 - RNA, 21 nt, Artificial Sequence
  Oligomer
aagcagauugccuacaaucac

SEQ ID NO: 77204 - RNA, 21 nt, Artificial Sequence
  Oligomer
aaagcagaagaccuucuaugg

SEQ ID NO: 77205 - RNA, 21 nt, Artificial Sequence
  Oligomer
uuugaaugagggucucuccac

SEQ ID NO: 77206 - RNA, 21 nt, Artificial Sequence
  Oligomer
uacaaaugcagugaggcacag

SEQ ID NO: 77207 - RNA, 21 nt, Artificial Sequence
  Oligomer
gauguauuucacuacccagug

SEQ ID NO: 77208 - RNA, 21 nt, Artificial Sequence
  Oligomer
uuggaacugcccugacagaug

SEQ ID NO: 77209 - RNA, 21 nt, Artificial Sequence
  Oligomer
uuuacuagggaagcccuuacu

SEQ ID NO: 77210 - RNA, 21 nt, Artificial Sequence
  Oligomer
uucgaggccaaacccaagaca

SEQ ID NO: 77211 - RNA, 21 nt, Artificial Sequence
  Oligomer
uguuuucaucgucuucuuucu

SEQ ID NO: 77212 - RNA, 21 nt, Artificial Sequence
  Oligomer
uuguucugguacacacaccau

SEQ ID NO: 77213 - RNA, 21 nt, Artificial Sequence
  Oligomer
aguuguucugguacacacacc

SEQ ID NO: 77214 - RNA, 21 nt, Artificial Sequence
  Oligomer
cuaacgagagcuaccucaacc

SEQ ID NO: 77215 - RNA, 21 nt, Artificial Sequence
  Oligomer
ucuucaaccuggaacgcuacc

SEQ ID NO: 77216 - RNA, 21 nt, Artificial Sequence
  Oligomer
aauucuaauaccugucagucg

SEQ ID NO: 77217 - RNA, 21 nt, Artificial Sequence
  Oligomer
acuuuggaggucaaguccagg

SEQ ID NO: 77218 - RNA, 21 nt, Artificial Sequence
  Oligomer
uauuaguacucucauggcugg

SEQ ID NO: 77219 - RNA, 21 nt, Artificial Sequence
  Oligomer
acuucacaugaaaaagcgugg

SEQ ID NO: 77220 - RNA, 21 nt, Artificial Sequence
  Oligomer
auugcuaaggacaauagcagg

SEQ ID NO: 77221 - RNA, 21 nt, Artificial Sequence
  Oligomer
agaggaacaaguauuugcugc

SEQ ID NO: 77222 - RNA, 21 nt, Artificial Sequence
  Oligomer
uaacuauugugaacaguacac

SEQ ID NO: 77223 - RNA, 21 nt, Artificial Sequence
  Oligomer
auugauuccaaagaacuccac

SEQ ID NO: 77224 - RNA, 21 nt, Artificial Sequence
  Oligomer
uacaacaaggagagcuucuag

SEQ ID NO: 77225 - RNA, 21 nt, Artificial Sequence
  Oligomer
uucuauuacaacaaggagagc

SEQ ID NO: 77226 - RNA, 21 nt, Artificial Sequence
  Oligomer
uguggaccuaaagcucucucg

SEQ ID NO: 77227 - RNA, 21 nt, Artificial Sequence
  Oligomer
acugggacgaaaauacugacg

SEQ ID NO: 77228 - RNA, 21 nt, Artificial Sequence
  Oligomer
uauaugguacaaaugcaguga

SEQ ID NO: 77229 - RNA, 21 nt, Artificial Sequence
  Oligomer
aaagcguggcuuuaaaauggc

SEQ ID NO: 77230 - RNA, 21 nt, Artificial Sequence
  Oligomer
ucugcacaacaucaccuucug

SEQ ID NO: 77231 - RNA, 21 nt, Artificial Sequence
  Oligomer
uagacaaaaaccucagauuuc

SEQ ID NO: 77232 - RNA, 21 nt, Artificial Sequence
  Oligomer
cuccaccaggaauuccuguga

SEQ ID NO: 77233 - RNA, 21 nt, Artificial Sequence
  Oligomer
uucaaaagaugugccacuugu

SEQ ID NO: 77234 - RNA, 21 nt, Artificial Sequence
  Oligomer
uauuggcguguucuucugugg

SEQ ID NO: 77235 - RNA, 21 nt, Artificial Sequence
  Oligomer
uucacauagcuuuacacuggg

SEQ ID NO: 77236 - RNA, 21 nt, Artificial Sequence
  Oligomer
aggcucuucacauagcuuuac

SEQ ID NO: 77237 - RNA, 21 nt, Artificial Sequence
  Oligomer
cugaucucuuacucucccugg

SEQ ID NO: 77238 - RNA, 21 nt, Artificial Sequence
  Oligomer
uugagugguuugcugaucucu

SEQ ID NO: 77239 - RNA, 21 nt, Artificial Sequence
  Oligomer
auaucuucgcuggaguggcac

SEQ ID NO: 77240 - RNA, 21 nt, Artificial Sequence
  Oligomer
aguacaucuuggugcagugcc

SEQ ID NO: 77241 - RNA, 21 nt, Artificial Sequence
  Oligomer
aauuuccugacagccgaagag

SEQ ID NO: 77242 - RNA, 21 nt, Artificial Sequence
  Oligomer
uacugguaugaagaggaggag

SEQ ID NO: 77243 - RNA, 21 nt, Artificial Sequence
  Oligomer
gauuccaaagaacuccaccag

SEQ ID NO: 77244 - RNA, 21 nt, Artificial Sequence
  Oligomer
gugccacuuguauucaucagc

SEQ ID NO: 77245 - RNA, 21 nt, Artificial Sequence
  Oligomer
gaugugccacuuguauucauc

SEQ ID NO: 77246 - RNA, 21 nt, Artificial Sequence
  Oligomer
agcaguauuggcguguucuuc

SEQ ID NO: 77247 - RNA, 21 nt, Artificial Sequence
  Oligomer
uauuucuuaccggcugggaug

SEQ ID NO: 77248 - RNA, 21 nt, Artificial Sequence
  Oligomer
guguauuucuacuggauuugc

SEQ ID NO: 77249 - RNA, 21 nt, Artificial Sequence
  Oligomer
auguauuucacuacccagugu

SEQ ID NO: 77250 - RNA, 21 nt, Artificial Sequence
  Oligomer
aauuuucuggcaaggaacccu

SEQ ID NO: 77251 - RNA, 21 nt, Artificial Sequence
  Oligomer
agagaccgcuaugcagaaugg

SEQ ID NO: 77252 - RNA, 21 nt, Artificial Sequence
  Oligomer
aucaugaccucgucaacugag

SEQ ID NO: 77253 - RNA, 21 nt, Artificial Sequence
  Oligomer
ugaauugcuaaggacaauagc

SEQ ID NO: 77254 - RNA, 21 nt, Artificial Sequence
  Oligomer
aaacacaaccacugaauugcu

SEQ ID NO: 77255 - RNA, 21 nt, Artificial Sequence
  Oligomer
uaaugcaaccauccacaucgu

SEQ ID NO: 77256 - RNA, 21 nt, Artificial Sequence
  Oligomer
guuaaugcaaccauccacauc

SEQ ID NO: 77257 - RNA, 21 nt, Artificial Sequence
  Oligomer
augcuaauucuaauaccuguc

SEQ ID NO: 77258 - RNA, 21 nt, Artificial Sequence
  Oligomer
auaauuuacuagggaagcccu

SEQ ID NO: 77259 - RNA, 21 nt, Artificial Sequence
  Oligomer
uaugaagaggaggagucuuuc

SEQ ID NO: 77260 - RNA, 21 nt, Artificial Sequence
  Oligomer
guuauugauuccaaagaacuc

SEQ ID NO: 77261 - RNA, 21 nt, Artificial Sequence
  Oligomer
uugccgggaugcaagagcuuu

SEQ ID NO: 77262 - RNA, 21 nt, Artificial Sequence
  Oligomer
uacaucuuggugcagugccca

SEQ ID NO: 77263 - RNA, 21 nt, Artificial Sequence
  Oligomer
aaguugucauuaccaaggugg

SEQ ID NO: 77264 - RNA, 21 nt, Artificial Sequence
  Oligomer
auuuacuagggaagcccuuac

SEQ ID NO: 77265 - RNA, 21 nt, Artificial Sequence
  Oligomer
gacagucucucucugcacaac

SEQ ID NO: 77266 - RNA, 21 nt, Artificial Sequence
  Oligomer
ccaaacccaagacagucucuc

SEQ ID NO: 77267 - RNA, 21 nt, Artificial Sequence
  Oligomer
ucucuggcuuuagucuugauc

SEQ ID NO: 77268 - RNA, 21 nt, Artificial Sequence
  Oligomer
aagaggaacaaguauuugcug

SEQ ID NO: 77269 - RNA, 21 nt, Artificial Sequence
  Oligomer
aaguccaggcauuguguuuuc

SEQ ID NO: 77270 - RNA, 21 nt, Artificial Sequence
  Oligomer
aagcagaagaccuucuauggg

SEQ ID NO: 77271 - RNA, 21 nt, Artificial Sequence
  Oligomer
uacaggcuuaaagcagaagac

SEQ ID NO: 77272 - RNA, 21 nt, Artificial Sequence
  Oligomer
auacugacgugauuacaggcu

SEQ ID NO: 77273 - RNA, 21 nt, Artificial Sequence
  Oligomer
ucuucacauagcuuuacacug

SEQ ID NO: 77274 - RNA, 21 nt, Artificial Sequence
  Oligomer
cuuacucucccuggaaacacg

SEQ ID NO: 77275 - RNA, 21 nt, Artificial Sequence
  Oligomer
aaaugcagugaggcacagacc

SEQ ID NO: 77276 - RNA, 21 nt, Artificial Sequence
  Oligomer
uucgcugcucuucugaaaucu

SEQ ID NO: 77277 - RNA, 21 nt, Artificial Sequence
  Oligomer
cccaggaagacuuuuucagcg

SEQ ID NO: 77278 - RNA, 21 nt, Artificial Sequence
  Oligomer
guggcuuuaaaauggcgccag

SEQ ID NO: 77279 - RNA, 21 nt, Artificial Sequence
  Oligomer
uucacaugaaaaagcguggcu

SEQ ID NO: 77280 - RNA, 21 nt, Artificial Sequence
  Oligomer
uuucaucgucuucuuucucag

SEQ ID NO: 77281 - RNA, 21 nt, Artificial Sequence
  Oligomer
ugucuaauugccuccuccacg

SEQ ID NO: 77282 - RNA, 21 nt, Artificial Sequence
  Oligomer
uugaagaaaugcgccacgaug

SEQ ID NO: 77283 - RNA, 21 nt, Artificial Sequence
  Oligomer
uucagaagagcagcgaaggga

SEQ ID NO: 77284 - RNA, 21 nt, Artificial Sequence
  Oligomer
uauuauucaccaguucccaac

SEQ ID NO: 77285 - RNA, 21 nt, Artificial Sequence
  Oligomer
ugugaagagccugauuuucau

SEQ ID NO: 77286 - RNA, 21 nt, Artificial Sequence
  Oligomer
uucugcauagcggucucuaca

SEQ ID NO: 77287 - RNA, 21 nt, Artificial Sequence
  Oligomer
cuaugugaagagccugauuuu

SEQ ID NO: 77288 - RNA, 21 nt, Artificial Sequence
  Oligomer
uggguuuggccucgaacaauc

SEQ ID NO: 77289 - RNA, 21 nt, Artificial Sequence
  Oligomer
ccuaauuauucuuucacaugc

SEQ ID NO: 77290 - RNA, 21 nt, Artificial Sequence
  Oligomer
ucacucauccguguuuccagg

SEQ ID NO: 77291 - RNA, 21 nt, Artificial Sequence
  Oligomer
uugucuaauugccuccuccac

SEQ ID NO: 77292 - RNA, 21 nt, Artificial Sequence
  Oligomer
ucuagaagcucuccuuguugu

SEQ ID NO: 77293 - RNA, 21 nt, Artificial Sequence
  Oligomer
ucuugcaucccggcaaaucca

SEQ ID NO: 77294 - RNA, 21 nt, Artificial Sequence
  Oligomer
uuauuauucaccaguucccaa

SEQ ID NO: 77295 - RNA, 21 nt, Artificial Sequence
  Oligomer
uugaaaucgccagaaccuaau

SEQ ID NO: 77296 - RNA, 21 nt, Artificial Sequence
  Oligomer
uaacucguguguaauggaaag

SEQ ID NO: 77297 - RNA, 21 nt, Artificial Sequence
  Oligomer
gcuaugugaagagccugauuu

SEQ ID NO: 77298 - RNA, 21 nt, Artificial Sequence
  Oligomer
ugcuuuaagccuguaaucacg

SEQ ID NO: 77299 - RNA, 21 nt, Artificial Sequence
  Oligomer
uuuccaagccgaggguuccuu

SEQ ID NO: 77300 - RNA, 21 nt, Artificial Sequence
  Oligomer
uugacgaggucaugaucaaga

SEQ ID NO: 77301 - RNA, 21 nt, Artificial Sequence
  Oligomer
agaaauacaccuugcucagcu

SEQ ID NO: 77302 - RNA, 21 nt, Artificial Sequence
  Oligomer
uucaugugaaguuccaggacu

SEQ ID NO: 77303 - RNA, 21 nt, Artificial Sequence
  Oligomer
uuggaaagugcggccagaagu

SEQ ID NO: 77304 - RNA, 21 nt, Artificial Sequence
  Oligomer
ucccauagaaggucuucugcu

SEQ ID NO: 77305 - RNA, 21 nt, Artificial Sequence
  Oligomer
ucugcuuuaagccuguaauca

SEQ ID NO: 77306 - RNA, 21 nt, Artificial Sequence
  Oligomer
ucacaugcauacaagaccaca

SEQ ID NO: 77307 - RNA, 21 nt, Artificial Sequence
  Oligomer
uuaguaagggcuucccuagua

SEQ ID NO: 77308 - RNA, 21 nt, Artificial Sequence
  Oligomer
uguaccagaacaacucauagg

SEQ ID NO: 77309 - RNA, 21 nt, Artificial Sequence
  Oligomer
ucaugaucaagacuaaagcca

SEQ ID NO: 77310 - RNA, 21 nt, Artificial Sequence
  Oligomer
uccucuucauaccaguagaac

SEQ ID NO: 77311 - RNA, 21 nt, Artificial Sequence
  Oligomer
aauacaaguggcacaucuuuu

SEQ ID NO: 77312 - RNA, 21 nt, Artificial Sequence
  Oligomer
ucuuucacaugcauacaagac

SEQ ID NO: 77313 - RNA, 21 nt, Artificial Sequence
  Oligomer
ugauguugugcagagagagac

SEQ ID NO: 77314 - RNA, 21 nt, Artificial Sequence
  Oligomer
ugaagaaaugcgccacgaugu

SEQ ID NO: 77315 - RNA, 21 nt, Artificial Sequence
  Oligomer
ugugaaaucugagguuuuugu

SEQ ID NO: 77316 - RNA, 21 nt, Artificial Sequence
  Oligomer
ugauugaaaacacaaugccug

SEQ ID NO: 77317 - RNA, 21 nt, Artificial Sequence
  Oligomer
ccucauucaaaauccagcacc

SEQ ID NO: 77318 - RNA, 21 nt, Artificial Sequence
  Oligomer
ucugucagggcaguuccaaag

SEQ ID NO: 77319 - RNA, 21 nt, Artificial Sequence
  Oligomer
uuggguuuggccucgaacaau

SEQ ID NO: 77320 - RNA, 21 nt, Artificial Sequence
  Oligomer
ucaguugacgaggucaugauc

SEQ ID NO: 77321 - RNA, 21 nt, Artificial Sequence
  Oligomer
uaucccauaggcgaccaguuu

SEQ ID NO: 77322 - RNA, 21 nt, Artificial Sequence
  Oligomer
acagguauuagaauuagcaug

SEQ ID NO: 77323 - RNA, 21 nt, Artificial Sequence
  Oligomer
ucaguauuuucgucccagugu

SEQ ID NO: 77324 - RNA, 21 nt, Artificial Sequence
  Oligomer
auuccugguggaguucuuugg

SEQ ID NO: 77325 - RNA, 21 nt, Artificial Sequence
  Oligomer
ugauuguaggcaaucugcuug

SEQ ID NO: 77326 - RNA, 21 nt, Artificial Sequence
  Oligomer
uauuuucgucccaguguaaag

SEQ ID NO: 77327 - RNA, 21 nt, Artificial Sequence
  Oligomer
uguugcccagcuuggaaagug

SEQ ID NO: 77328 - RNA, 21 nt, Artificial Sequence
  Oligomer
uaccaguagaacgugucaaua

SEQ ID NO: 77329 - RNA, 21 nt, Artificial Sequence
  Oligomer
aauuccugguggaguucuuug

SEQ ID NO: 77330 - RNA, 21 nt, Artificial Sequence
  Oligomer
uuccugguggaguucuuugga

SEQ ID NO: 77331 - RNA, 21 nt, Artificial Sequence
  Oligomer
uugcaucccggcaaauccagu

SEQ ID NO: 77332 - RNA, 21 nt, Artificial Sequence
  Oligomer
ucugcauagcggucucuacag

SEQ ID NO: 77333 - RNA, 21 nt, Artificial Sequence
  Oligomer
ugaaaacaugguguguguacc

SEQ ID NO: 77334 - RNA, 21 nt, Artificial Sequence
  Oligomer
ucauaggaggccugucugaug

SEQ ID NO: 77335 - RNA, 21 nt, Artificial Sequence
  Oligomer
aguuaaaauucaggcacagug

SEQ ID NO: 77336 - RNA, 21 nt, Artificial Sequence
  Oligomer
guaugguauaguguacuguuc

SEQ ID NO: 77337 - RNA, 21 nt, Artificial Sequence
  Oligomer
aauuuauucccagccaugaga

SEQ ID NO: 77338 - RNA, 21 nt, Artificial Sequence
  Oligomer
uggacuugaccuccaaagucu

SEQ ID NO: 77339 - RNA, 21 nt, Artificial Sequence
  Oligomer
ugugaaguuccaggacuccag

SEQ ID NO: 77340 - RNA, 21 nt, Artificial Sequence
  Oligomer
aauaacucguguguaauggaa

SEQ ID NO: 77341 - RNA, 21 nt, Artificial Sequence
  Oligomer
uccuccucuucauaccaguag

SEQ ID NO: 77342 - RNA, 21 nt, Artificial Sequence
  Oligomer
cuccuuguuguaauagaaaug

SEQ ID NO: 77343 - RNA, 21 nt, Artificial Sequence
  Oligomer
uaugguggagagacccucauu

SEQ ID NO: 77344 - RNA, 21 nt, Artificial Sequence
  Oligomer
ucgccagaaccuaauuauucu

SEQ ID NO: 77345 - RNA, 21 nt, Artificial Sequence
  Oligomer
uggaugguugcauuaacagcu

SEQ ID NO: 77346 - RNA, 21 nt, Artificial Sequence
  Oligomer
ugaugaauacaaguggcacau

SEQ ID NO: 77347 - RNA, 21 nt, Artificial Sequence
  Oligomer
ucuuguugaaaucgccagaac

SEQ ID NO: 77348 - RNA, 21 nt, Artificial Sequence
  Oligomer
uccauuuccaagccgaggguu

SEQ ID NO: 77349 - RNA, 21 nt, Artificial Sequence
  Oligomer
ugccauucugcauagcggucu

SEQ ID NO: 77350 - RNA, 21 nt, Artificial Sequence
  Oligomer
ucuacagaaggugauguugug

SEQ ID NO: 77351 - RNA, 21 nt, Artificial Sequence
  Oligomer
ucggcugucaggaaauuucuu

SEQ ID NO: 77352 - RNA, 21 nt, Artificial Sequence
  Oligomer
cuucauaccaguagaacgugu

SEQ ID NO: 77353 - RNA, 21 nt, Artificial Sequence
  Oligomer
aaggaaguaugguauagugua

SEQ ID NO: 77354 - RNA, 21 nt, Artificial Sequence
  Oligomer
uagcaauucagugguuguguu

SEQ ID NO: 77355 - RNA, 21 nt, Artificial Sequence
  Oligomer
aguaugguauaguguacuguu

SEQ ID NO: 77356 - RNA, 21 nt, Artificial Sequence
  Oligomer
uggaguucuuuggaaucaaua

SEQ ID NO: 77357 - RNA, 21 nt, Artificial Sequence
  Oligomer
ugaaaacacaaugccuggacu

SEQ ID NO: 77358 - RNA, 21 nt, Artificial Sequence
  Oligomer
uguaggcaaucugcuugaacu

SEQ ID NO: 77359 - RNA, 21 nt, Artificial Sequence
  Oligomer
ccagccgguaagaaauauaug

SEQ ID NO: 77360 - RNA, 21 nt, Artificial Sequence
  Oligomer
acuggguagugaaauacaucu

SEQ ID NO: 77361 - RNA, 21 nt, Artificial Sequence
  Oligomer
ugcuauuguccuuagcaauuc

SEQ ID NO: 77362 - RNA, 21 nt, Artificial Sequence
  Oligomer
ucuucucccucaccugugucu

SEQ ID NO: 77363 - RNA, 21 nt, Artificial Sequence
  Oligomer
aucccauaggcgaccaguuug

SEQ ID NO: 77364 - RNA, 21 nt, Artificial Sequence
  Oligomer
auuuucaucccagccgguaag

SEQ ID NO: 77365 - RNA, 21 nt, Artificial Sequence
  Oligomer
uccagggagaguaagagauca

SEQ ID NO: 77366 - RNA, 21 nt, Artificial Sequence
  Oligomer
gauuucagaagagcagcgaag

SEQ ID NO: 77367 - RNA, 21 nt, Artificial Sequence
  Oligomer
ugaaguuccaggacuccagag

SEQ ID NO: 77368 - RNA, 21 nt, Artificial Sequence
  Oligomer
ucuuggguuuggccucgaaca

SEQ ID NO: 77369 - RNA, 21 nt, Artificial Sequence
  Oligomer
accaguuugugaaaucugagg

SEQ ID NO: 77370 - RNA, 21 nt, Artificial Sequence
  Oligomer
acaccuugcucagcuucagug

SEQ ID NO: 77371 - RNA, 21 nt, Artificial Sequence
  Oligomer
uguugaaaucgccagaaccua

SEQ ID NO: 77372 - RNA, 21 nt, Artificial Sequence
  Oligomer
aguagaacgugucaauaaaca

SEQ ID NO: 77373 - RNA, 21 nt, Artificial Sequence
  Oligomer
ucauaucaacaggccgucaca

SEQ ID NO: 77374 - RNA, 21 nt, Artificial Sequence
  Oligomer
aacacaaugccuggacuugac

SEQ ID NO: 77375 - RNA, 21 nt, Artificial Sequence
  Oligomer
ugaaaucgccagaaccuaauu

SEQ ID NO: 77376 - RNA, 21 nt, Artificial Sequence
  Oligomer
uugcucuucggcugucaggaa

SEQ ID NO: 77377 - RNA, 21 nt, Artificial Sequence
  Oligomer
ucuucggcugucaggaaauuu

SEQ ID NO: 77378 - RNA, 21 nt, Artificial Sequence
  Oligomer
guguugaacccaaaauaacuc

SEQ ID NO: 77379 - RNA, 21 nt, Artificial Sequence
  Oligomer
auaacucguguguaauggaaa

SEQ ID NO: 77380 - RNA, 21 nt, Artificial Sequence
  Oligomer
cucguguguaauggaaagacu

SEQ ID NO: 77381 - RNA, 21 nt, Artificial Sequence
  Oligomer
acagaagaacacgccaauacu

SEQ ID NO: 77382 - RNA, 21 nt, Artificial Sequence
  Oligomer
agaaggucuucugcuuuaagc

SEQ ID NO: 77383 - RNA, 21 nt, Artificial Sequence
  Oligomer
gucaguauuuucgucccagug

SEQ ID NO: 77384 - RNA, 21 nt, Artificial Sequence
  Oligomer
aagcuaugugaagagccugau

SEQ ID NO: 77385 - RNA, 21 nt, Artificial Sequence
  Oligomer
ucaugugaaguuccaggacuc

SEQ ID NO: 77386 - RNA, 21 nt, Artificial Sequence
  Oligomer
acuuguugcucuucggcuguc

SEQ ID NO: 77387 - RNA, 21 nt, Artificial Sequence
  Oligomer
aggcugagaaagaagacgaug

SEQ ID NO: 77388 - RNA, 21 nt, Artificial Sequence
  Oligomer
uccucugcagcaaauacuugu

SEQ ID NO: 77389 - RNA, 21 nt, Artificial Sequence
  Oligomer
ucuggauguugggucguuagu

SEQ ID NO: 77390 - RNA, 21 nt, Artificial Sequence
  Oligomer
uggaaagacuccuccucuuca

SEQ ID NO: 77391 - RNA, 21 nt, Artificial Sequence
  Oligomer
uguucuguuguauaugacaug

SEQ ID NO: 77392 - RNA, 21 nt, Artificial Sequence
  Oligomer
ucuuuugaaguguccucgaga

SEQ ID NO: 77393 - RNA, 21 nt, Artificial Sequence
  Oligomer
aggucuucugcuuuaagccug

SEQ ID NO: 77394 - RNA, 21 nt, Artificial Sequence
  Oligomer
ugaaauacaucugucagggca

SEQ ID NO: 77395 - RNA, 21 nt, Artificial Sequence
  Oligomer
auacaucugucagggcaguuc

SEQ ID NO: 77396 - RNA, 21 nt, Artificial Sequence
  Oligomer
uacugcccuggcgccauuuua

SEQ ID NO: 77397 - RNA, 21 nt, Artificial Sequence
  Oligomer
aagaccacagggccuaaaauc

SEQ ID NO: 77398 - RNA, 21 nt, Artificial Sequence
  Oligomer
ucguuaguaagggcuucccua

SEQ ID NO: 77399 - RNA, 21 nt, Artificial Sequence
  Oligomer
acgucaguauuuucgucccag

SEQ ID NO: 77400 - RNA, 21 nt, Artificial Sequence
  Oligomer
uuucgucccaguguaaagcua

SEQ ID NO: 77401 - RNA, 21 nt, Artificial Sequence
  Oligomer
uuuccagggagaguaagagau

SEQ ID NO: 77402 - RNA, 21 nt, Artificial Sequence
  Oligomer
ugcccuggcgccauuuuaaag

SEQ ID NO: 77403 - RNA, 21 nt, Artificial Sequence
  Oligomer
augugaaguuccaggacucca

SEQ ID NO: 77404 - RNA, 21 nt, Artificial Sequence
  Oligomer
cuucggcugucaggaaauuuc

SEQ ID NO: 77405 - RNA, 21 nt, Artificial Sequence
  Oligomer
guguguguaccagaacaacuc

SEQ ID NO: 77406 - RNA, 21 nt, Artificial Sequence
  Oligomer
uggauguugggucguuaguaa

SEQ ID NO: 77407 - RNA, 21 nt, Artificial Sequence
  Oligomer
guguguaauggaaagacuccu

SEQ ID NO: 77408 - RNA, 21 nt, Artificial Sequence
  Oligomer
ucaacaggccgucacaggaau

SEQ ID NO: 77409 - RNA, 21 nt, Artificial Sequence
  Oligomer
agccgguaagaaauauaugau

SEQ ID NO: 77410 - RNA, 21 nt, Artificial Sequence
  Oligomer
acuucuuguugaaaucgccag

SEQ ID NO: 77411 - RNA, 21 nt, Artificial Sequence
  Oligomer
cucuacagaaggugauguugu

SEQ ID NO: 77412 - RNA, 21 nt, Artificial Sequence
  Oligomer
uaagggcuucccuaguaaauu

SEQ ID NO: 77413 - RNA, 21 nt, Artificial Sequence
  Oligomer
uuucgacugacagguauuaga

SEQ ID NO: 77414 - RNA, 21 nt, Artificial Sequence
  Oligomer
cauaucaacaggccgucacag

SEQ ID NO: 77415 - RNA, 21 nt, Artificial Sequence
  Oligomer
auacaccuugcucagcuucag

SEQ ID NO: 77416 - RNA, 21 nt, Artificial Sequence
  Oligomer
uaggaggccugucugaugaac

SEQ ID NO: 77417 - RNA, 21 nt, Artificial Sequence
  Oligomer
aagacuaaagccagagagauc

SEQ ID NO: 77418 - RNA, 21 nt, Artificial Sequence
  Oligomer
ucccauaggcgaccaguuugu

SEQ ID NO: 77419 - RNA, 21 nt, Artificial Sequence
  Oligomer
agguuuuugucuaauugccuc

SEQ ID NO: 77420 - RNA, 21 nt, Artificial Sequence
  Oligomer
uugggucguuaguaagggcuu

SEQ ID NO: 77421 - RNA, 21 nt, Artificial Sequence
  Oligomer
agaacgugucaauaaacagau

SEQ ID NO: 77422 - RNA, 21 nt, Artificial Sequence
  Oligomer
cuccaaagucuagaagcucuc

SEQ ID NO: 77423 - RNA, 21 nt, Artificial Sequence
  Oligomer
guaagagaucagcaaaccacu

SEQ ID NO: 77424 - RNA, 21 nt, Artificial Sequence
  Oligomer
ccaucaugauacuuguugcuc

SEQ ID NO: 77425 - RNA, 21 nt, Artificial Sequence
  Oligomer
cuuucacaugcauacaagacc

SEQ ID NO: 77426 - RNA, 21 nt, Artificial Sequence
  Oligomer
ugugcagagagagacugucuu

SEQ ID NO: 77427 - RNA, 21 nt, Artificial Sequence
  Oligomer
ugguguguguaccagaacaac

SEQ ID NO: 77428 - RNA, 21 nt, Artificial Sequence
  Oligomer
cucauaucaacaggccgucac

SEQ ID NO: 77429 - RNA, 21 nt, Artificial Sequence
  Oligomer
cagaagaacacgccaauacug

SEQ ID NO: 77430 - RNA, 21 nt, Artificial Sequence
  Oligomer
aguaagagaucagcaaaccac

SEQ ID NO: 77431 - RNA, 21 nt, Artificial Sequence
  Oligomer
cacugcauuuguaccauauag

SEQ ID NO: 77432 - RNA, 21 nt, Artificial Sequence
  Oligomer
guugaaaucgccagaaccuaa

SEQ ID NO: 77433 - RNA, 21 nt, Artificial Sequence
  Oligomer
ugcauagcggucucuacagaa

SEQ ID NO: 77434 - RNA, 21 nt, Artificial Sequence
  Oligomer
agaaggugauguugugcagag

SEQ ID NO: 77435 - RNA, 21 nt, Artificial Sequence
  Oligomer
aauucaggcacagugcggaug

SEQ ID NO: 77436 - RNA, 21 nt, Artificial Sequence
  Oligomer
agaagcucuccuuguuguaau

SEQ ID NO: 77437 - RNA, 21 nt, Artificial Sequence
  Oligomer
uccacagaagaacacgccaau

SEQ ID NO: 77438 - RNA, 21 nt, Artificial Sequence
  Oligomer
ucuucugcuuuaagccuguaa

SEQ ID NO: 77439 - RNA, 21 nt, Artificial Sequence
  Oligomer
cuuuaagccuguaaucacguc

SEQ ID NO: 77440 - RNA, 21 nt, Artificial Sequence
  Oligomer
auaugguggagagacccucau

SEQ ID NO: 77441 - RNA, 21 nt, Artificial Sequence
  Oligomer
ucaucccagccgguaagaaau

SEQ ID NO: 77442 - RNA, 21 nt, Artificial Sequence
  Oligomer
acugcauuuguaccauauaga

SEQ ID NO: 77443 - RNA, 21 nt, Artificial Sequence
  Oligomer
accagaacaacucauaggagg

SEQ ID NO: 77444 - RNA, 21 nt, Artificial Sequence
  Oligomer
augaucaagacuaaagccaga

SEQ ID NO: 77445 - RNA, 21 nt, Artificial Sequence
  Oligomer
agacuaaagccagagagauca

SEQ ID NO: 77446 - RNA, 21 nt, Artificial Sequence
  Oligomer
gaaauuucuucucccucaccu

SEQ ID NO: 77447 - RNA, 21 nt, Artificial Sequence
  Oligomer
aagccagagagaucaccagac

SEQ ID NO: 77448 - RNA, 21 nt, Artificial Sequence
  Oligomer
aauggaaagacuccuccucuu

SEQ ID NO: 77449 - RNA, 21 nt, Artificial Sequence
  Oligomer
auaccaguagaacgugucaau

SEQ ID NO: 77450 - RNA, 21 nt, Artificial Sequence
  Oligomer
aggaaguaugguauaguguac

SEQ ID NO: 77451 - RNA, 21 nt, Artificial Sequence
  Oligomer
ccaaagucuagaagcucuccu

SEQ ID NO: 77452 - RNA, 21 nt, Artificial Sequence
  Oligomer
uagaagcucuccuuguuguaa

SEQ ID NO: 77453 - RNA, 21 nt, Artificial Sequence
  Oligomer
ugcuugaacucauuguuccag

SEQ ID NO: 77454 - RNA, 21 nt, Artificial Sequence
  Oligomer
caucaugauacuuguugcucu

SEQ ID NO: 77455 - RNA, 21 nt, Artificial Sequence
  Oligomer
gccuaaaauccauuuccaagc

SEQ ID NO: 77456 - RNA, 21 nt, Artificial Sequence
  Oligomer
ccaggcugagaaagaagacga

SEQ ID NO: 77457 - RNA, 21 nt, Artificial Sequence
  Oligomer
ucaagacuaaagccagagaga

SEQ ID NO: 77458 - RNA, 21 nt, Artificial Sequence
  Oligomer
guugagguagcucucguuagg

SEQ ID NO: 77459 - RNA, 21 nt, Artificial Sequence
  Oligomer
guaauggaaagacuccuccuc

SEQ ID NO: 77460 - RNA, 21 nt, Artificial Sequence
  Oligomer
cucuucauaccaguagaacgu

SEQ ID NO: 77461 - RNA, 21 nt, Artificial Sequence
  Oligomer
guuaguaagggcuucccuagu

SEQ ID NO: 77462 - RNA, 21 nt, Artificial Sequence
  Oligomer
cuguaaucacgucaguauuuu

SEQ ID NO: 77463 - RNA, 21 nt, Artificial Sequence
  Oligomer
agcuaugugaagagccugauu

SEQ ID NO: 77464 - RNA, 21 nt, Artificial Sequence
  Oligomer
cagccgguaagaaauauauga

SEQ ID NO: 77465 - RNA, 21 nt, Artificial Sequence
  Oligomer
ugccucacugcauuuguacca

SEQ ID NO: 77466 - RNA, 21 nt, Artificial Sequence
  Oligomer
uuaccaccuugguaaugacaa

SEQ ID NO: 77467 - RNA, 21 nt, Artificial Sequence
  Oligomer
ugguaaugacaacuucuuguu

SEQ ID NO: 77468 - RNA, 21 nt, Artificial Sequence
  Oligomer
cggcugucaggaaauuucuuc

SEQ ID NO: 77469 - RNA, 21 nt, Artificial Sequence
  Oligomer
acuccuccucuucauaccagu

SEQ ID NO: 77470 - RNA, 21 nt, Artificial Sequence
  Oligomer
ugguauaguguacuguucaca

SEQ ID NO: 77471 - RNA, 21 nt, Artificial Sequence
  Oligomer
uuauucccagccaugagagua

SEQ ID NO: 77472 - RNA, 21 nt, Artificial Sequence
  Oligomer
agcucuccuuguuguaauaga

SEQ ID NO: 77473 - RNA, 21 nt, Artificial Sequence
  Oligomer
cugcuuuaagccuguaaucac

SEQ ID NO: 77474 - RNA, 21 nt, Artificial Sequence
  Oligomer
ucgucccaguguaaagcuaug

SEQ ID NO: 77475 - RNA, 21 nt, Artificial Sequence
  Oligomer
ugugcacgcugaaaaagucuu

SEQ ID NO: 77476 - RNA, 21 nt, Artificial Sequence
  Oligomer
uggcuuaccaccuugguaaug

SEQ ID NO: 77477 - RNA, 21 nt, Artificial Sequence
  Oligomer
uacaagaccacagggccuaaa

SEQ ID NO: 77478 - RNA, 21 nt, Artificial Sequence
  Oligomer
ugagaaagaagacgaugaaaa

SEQ ID NO: 77479 - RNA, 21 nt, Artificial Sequence
  Oligomer
caugguguguguaccagaaca

SEQ ID NO: 77480 - RNA, 21 nt, Artificial Sequence
  Oligomer
aaaugcgccacgauguggaug

SEQ ID NO: 77481 - RNA, 21 nt, Artificial Sequence
  Oligomer
ucccaacugggagcucauauc

SEQ ID NO: 77482 - RNA, 21 nt, Artificial Sequence
  Oligomer
uaucaacaggccgucacagga

SEQ ID NO: 77483 - RNA, 21 nt, Artificial Sequence
  Oligomer
aucaacaggccgucacaggaa

SEQ ID NO: 77484 - RNA, 21 nt, Artificial Sequence
  Oligomer
cucuccuuguuguaauagaaa

SEQ ID NO: 77485 - RNA, 21 nt, Artificial Sequence
  Oligomer
gugaaguuccaggacuccaga

SEQ ID NO: 77486 - RNA, 21 nt, Artificial Sequence
  Oligomer
ugacaacuucuuguugaaauc

SEQ ID NO: 77487 - RNA, 21 nt, Artificial Sequence
  Oligomer
uuuauucccagccaugagagu

SEQ ID NO: 77488 - RNA, 21 nt, Artificial Sequence
  Oligomer
agccaugagaguacuaauaug

SEQ ID NO: 77489 - RNA, 21 nt, Artificial Sequence
  Oligomer
cucacucauccguguuuccag

SEQ ID NO: 77490 - RNA, 21 nt, Artificial Sequence
  Oligomer
ucauccguguuuccagggaga

SEQ ID NO: 77491 - RNA, 21 nt, Artificial Sequence
  Oligomer
aguagaaauacaccuugcuca

SEQ ID NO: 77492 - RNA, 21 nt, Artificial Sequence
  Oligomer
aggccugucugaugaacucag

SEQ ID NO: 77493 - RNA, 21 nt, Artificial Sequence
  Oligomer
acucaguugacgaggucauga

SEQ ID NO: 77494 - RNA, 21 nt, Artificial Sequence
  Oligomer
caguugacgaggucaugauca

SEQ ID NO: 77495 - RNA, 21 nt, Artificial Sequence
  Oligomer
cguguguaauggaaagacucc

SEQ ID NO: 77496 - RNA, 21 nt, Artificial Sequence
  Oligomer
ugggucguuaguaagggcuuc

SEQ ID NO: 77497 - RNA, 21 nt, Artificial Sequence
  Oligomer
aaguguccucgagagagcuuu

SEQ ID NO: 77498 - RNA, 21 nt, Artificial Sequence
  Oligomer
aucugucagggcaguuccaaa

SEQ ID NO: 77499 - RNA, 21 nt, Artificial Sequence
  Oligomer
agacugucuuggguuuggccu

SEQ ID NO: 77500 - RNA, 21 nt, Artificial Sequence
  Oligomer
ccugucugaugaacucaguug

SEQ ID NO: 77501 - RNA, 21 nt, Artificial Sequence
  Oligomer
aagggcuucccuaguaaauua

SEQ ID NO: 77502 - RNA, 21 nt, Artificial Sequence
  Oligomer
caaaauaacucguguguaaug

SEQ ID NO: 77503 - RNA, 21 nt, Artificial Sequence
  Oligomer
gacuccuccucuucauaccag

SEQ ID NO: 77504 - RNA, 21 nt, Artificial Sequence
  Oligomer
ccucuucauaccaguagaacg

SEQ ID NO: 77505 - RNA, 21 nt, Artificial Sequence
  Oligomer
auaagcuaaggaaguauggua

SEQ ID NO: 77506 - RNA, 21 nt, Artificial Sequence
  Oligomer
cuggacuugaccuccaaaguc

SEQ ID NO: 77507 - RNA, 21 nt, Artificial Sequence
  Oligomer
aguguccucgagagagcuuua

SEQ ID NO: 77508 - RNA, 21 nt, Artificial Sequence
  Oligomer
cuaauaugguggagagacccu

SEQ ID NO: 77509 - RNA, 21 nt, Artificial Sequence
  Oligomer
caguauuuucgucccagugua

SEQ ID NO: 77510 - RNA, 21 nt, Artificial Sequence
  Oligomer
uggagagacccucauucaaaa

SEQ ID NO: 77511 - RNA, 21 nt, Artificial Sequence
  Oligomer
gucugugccucacugcauuug

SEQ ID NO: 77512 - RNA, 21 nt, Artificial Sequence
  Oligomer
aaucgccagaaccuaauuauu

SEQ ID NO: 77513 - RNA, 21 nt, Artificial Sequence
  Oligomer
gccagaaccuaauuauucuuu

SEQ ID NO: 77514 - RNA, 21 nt, Artificial Sequence
  Oligomer
cauucugcauagcggucucua

SEQ ID NO: 77515 - RNA, 21 nt, Artificial Sequence
  Oligomer
gauguugugcagagagagacu

SEQ ID NO: 77516 - RNA, 21 nt, Artificial Sequence
  Oligomer
caacucauaggaggccugucu

SEQ ID NO: 77517 - RNA, 21 nt, Artificial Sequence
  Oligomer
gucugaugaacucaguugacg

SEQ ID NO: 77518 - RNA, 21 nt, Artificial Sequence
  Oligomer
acgaggucaugaucaagacua

SEQ ID NO: 77519 - RNA, 21 nt, Artificial Sequence
  Oligomer
uaggcgaccaguuugugaaau

SEQ ID NO: 77520 - RNA, 21 nt, Artificial Sequence
  Oligomer
aagguuucgacugacagguau

SEQ ID NO: 77521 - RNA, 21 nt, Artificial Sequence
  Oligomer
cuggauguugggucguuagua

SEQ ID NO: 77522 - RNA, 21 nt, Artificial Sequence
  Oligomer
aguguugaacccaaaauaacu

SEQ ID NO: 77523 - RNA, 21 nt, Artificial Sequence
  Oligomer
gcucauaucaacaggccguca

SEQ ID NO: 77524 - RNA, 21 nt, Artificial Sequence
  Oligomer
aggaauuccugguggaguucu

SEQ ID NO: 77525 - RNA, 21 nt, Artificial Sequence
  Oligomer
ccuccaaagucuagaagcucu

SEQ ID NO: 77526 - RNA, 21 nt, Artificial Sequence
  Oligomer
gcuugaacucauuguuccagu

SEQ ID NO: 77527 - RNA, 21 nt, Artificial Sequence
  Oligomer
uucaucccagccgguaagaaa

SEQ ID NO: 77528 - RNA, 21 nt, Artificial Sequence
  Oligomer
gccgguaagaaauauaugaua

SEQ ID NO: 77529 - RNA, 21 nt, Artificial Sequence
  Oligomer
agaucagcaaaccacucaaaa

SEQ ID NO: 77530 - RNA, 21 nt, Artificial Sequence
  Oligomer
ccacucaaaagcucuugcauc

SEQ ID NO: 77531 - RNA, 21 nt, Artificial Sequence
  Oligomer
ugccacuccagcgaagauaug

SEQ ID NO: 77532 - RNA, 21 nt, Artificial Sequence
  Oligomer
cauaggaggccugucugauga

SEQ ID NO: 77533 - RNA, 21 nt, Artificial Sequence
  Oligomer
aggaggccugucugaugaacu

SEQ ID NO: 77534 - RNA, 21 nt, Artificial Sequence
  Oligomer
ugucuggauguugggucguua

SEQ ID NO: 77535 - RNA, 21 nt, Artificial Sequence
  Oligomer
ucgacugacagguauuagaau

SEQ ID NO: 77536 - RNA, 21 nt, Artificial Sequence
  Oligomer
acugggagcucauaucaacag

SEQ ID NO: 77537 - RNA, 21 nt, Artificial Sequence
  Oligomer
aacaggccgucacaggaauuc

SEQ ID NO: 77538 - RNA, 21 nt, Artificial Sequence
  Oligomer
acaaugccuggacuugaccuc

SEQ ID NO: 77539 - RNA, 21 nt, Artificial Sequence
  Oligomer
cacagaagaacacgccaauac

SEQ ID NO: 77540 - RNA, 21 nt, Artificial Sequence
  Oligomer
ccucccauagaaggucuucug

SEQ ID NO: 77541 - RNA, 21 nt, Artificial Sequence
  Oligomer
aucccagccgguaagaaauau

SEQ ID NO: 77542 - RNA, 21 nt, Artificial Sequence
  Oligomer
ggguagugaaauacaucuguc

SEQ ID NO: 77543 - RNA, 21 nt, Artificial Sequence
  Oligomer
acaucugucagggcaguucca

SEQ ID NO: 77544 - RNA, 21 nt, Artificial Sequence
  Oligomer
accaccuugguaaugacaacu

SEQ ID NO: 77545 - RNA, 21 nt, Artificial Sequence
  Oligomer
ugacgccugcuauuguccuua

SEQ ID NO: 77546 - RNA, 21 nt, Artificial Sequence
  Oligomer
agugguagcguuccagguuga

SEQ ID NO: 77547 - RNA, 21 nt, Artificial Sequence
  Oligomer
cguuaguaagggcuucccuag

SEQ ID NO: 77548 - RNA, 21 nt, Artificial Sequence
  Oligomer
agagcuuuagguccacagaag

SEQ ID NO: 77549 - RNA, 21 nt, Artificial Sequence
  Oligomer
cucauuguuccaguugggccu

SEQ ID NO: 77550 - RNA, 21 nt, Artificial Sequence
  Oligomer
cuucugcuuuaagccuguaau

SEQ ID NO: 77551 - RNA, 21 nt, Artificial Sequence
  Oligomer
ugauuuucaucccagccggua

SEQ ID NO: 77552 - RNA, 21 nt, Artificial Sequence
  Oligomer
uccguguuuccagggagagua

SEQ ID NO: 77553 - RNA, 21 nt, Artificial Sequence
  Oligomer
cucacugcauuuguaccauau

SEQ ID NO: 77554 - RNA, 21 nt, Artificial Sequence
  Oligomer
acacacacuggguagugaaau

SEQ ID NO: 77555 - RNA, 21 nt, Artificial Sequence
  Oligomer
gauacuuguugcucuucggcu

SEQ ID NO: 77556 - RNA, 21 nt, Artificial Sequence
  Oligomer
ugcucuucggcugucaggaaa

SEQ ID NO: 77557 - RNA, 21 nt, Artificial Sequence
  Oligomer
agaaaugcgccacgaugugga

SEQ ID NO: 77558 - RNA, 21 nt, Artificial Sequence
  Oligomer
caacugggagcucauaucaac

SEQ ID NO: 77559 - RNA, 21 nt, Artificial Sequence
  Oligomer
aguauuuucgucccaguguaa

SEQ ID NO: 77560 - RNA, 21 nt, Artificial Sequence
  Oligomer
caucccggcaaauccaguaga

SEQ ID NO: 77561 - RNA, 21 nt, Artificial Sequence
  Oligomer
aauacaucugucagggcaguu

SEQ ID NO: 77562 - RNA, 21 nt, Artificial Sequence
  Oligomer
acaugguguguguaccagaac

SEQ ID NO: 77563 - RNA, 21 nt, Artificial Sequence
  Oligomer
uguguaccagaacaacucaua

SEQ ID NO: 77564 - RNA, 21 nt, Artificial Sequence
  Oligomer
guggaugguugcauuaacagc

SEQ ID NO: 77565 - RNA, 21 nt, Artificial Sequence
  Oligomer
guugcauuaacagcuauccca

SEQ ID NO: 77566 - RNA, 21 nt, Artificial Sequence
  Oligomer
ugcauuaacagcuaucccaua

SEQ ID NO: 77567 - RNA, 21 nt, Artificial Sequence
  Oligomer
gcaaauacuuguuccucuuau

SEQ ID NO: 77568 - RNA, 21 nt, Artificial Sequence
  Oligomer
ugcaguuaaaauucaggcaca

SEQ ID NO: 77569 - RNA, 21 nt, Artificial Sequence
  Oligomer
acccaaaauaacucgugugua

SEQ ID NO: 77570 - RNA, 21 nt, Artificial Sequence
  Oligomer
accaguagaacgugucaauaa

SEQ ID NO: 77571 - RNA, 21 nt, Artificial Sequence
  Oligomer
caaagucuagaagcucuccuu

SEQ ID NO: 77572 - RNA, 21 nt, Artificial Sequence
  Oligomer
ugaauacaaguggcacaucuu

SEQ ID NO: 77573 - RNA, 21 nt, Artificial Sequence
  Oligomer
aguggcacaucuuuugaagug

SEQ ID NO: 77574 - RNA, 21 nt, Artificial Sequence
  Oligomer
uggcgccauuuuaaagccacg

SEQ ID NO: 77575 - RNA, 21 nt, Artificial Sequence
  Oligomer
cuucuuguugaaaucgccaga

SEQ ID NO: 77576 - RNA, 21 nt, Artificial Sequence
  Oligomer
accacagggccuaaaauccau

SEQ ID NO: 77577 - RNA, 21 nt, Artificial Sequence
  Oligomer
auugggccacugucugccauu

SEQ ID NO: 77578 - RNA, 21 nt, Artificial Sequence
  Oligomer
acgaugaaaacauggugugug

SEQ ID NO: 77579 - RNA, 21 nt, Artificial Sequence
  Oligomer
aacaugguguguguaccagaa

SEQ ID NO: 77580 - RNA, 21 nt, Artificial Sequence
  Oligomer
gucuggauguugggucguuag

SEQ ID NO: 77581 - RNA, 21 nt, Artificial Sequence
  Oligomer
caguguugaacccaaaauaac

SEQ ID NO: 77582 - RNA, 21 nt, Artificial Sequence
  Oligomer
caguagaacgugucaauaaac

SEQ ID NO: 77583 - RNA, 21 nt, Artificial Sequence
  Oligomer
cccaacugggagcucauauca

SEQ ID NO: 77584 - RNA, 21 nt, Artificial Sequence
  Oligomer
uccugguggaguucuuuggaa

SEQ ID NO: 77585 - RNA, 21 nt, Artificial Sequence
  Oligomer
ugguggaguucuuuggaauca

SEQ ID NO: 77586 - RNA, 21 nt, Artificial Sequence
  Oligomer
cacaaugccuggacuugaccu

SEQ ID NO: 77587 - RNA, 21 nt, Artificial Sequence
  Oligomer
cuuuugaaguguccucgagag

SEQ ID NO: 77588 - RNA, 21 nt, Artificial Sequence
  Oligomer
guguccucgagagagcuuuag

SEQ ID NO: 77589 - RNA, 21 nt, Artificial Sequence
  Oligomer
uguuuccagggagaguaagag

SEQ ID NO: 77590 - RNA, 21 nt, Artificial Sequence
  Oligomer
gagaguaagagaucagcaaac

SEQ ID NO: 77591 - RNA, 21 nt, Artificial Sequence
  Oligomer
cacacuggguagugaaauaca

SEQ ID NO: 77592 - RNA, 21 nt, Artificial Sequence
  Oligomer
acugcccuggcgccauuuuaa

SEQ ID NO: 77593 - RNA, 21 nt, Artificial Sequence
  Oligomer
cacagggccuaaaauccauuu

SEQ ID NO: 77594 - RNA, 21 nt, Artificial Sequence
  Oligomer
guauuagaauuagcaugcagu

SEQ ID NO: 77595 - RNA, 21 nt, Artificial Sequence
  Oligomer
ggaaguaugguauaguguacu

SEQ ID NO: 77596 - RNA, 21 nt, Artificial Sequence
  Oligomer
ugccuggacuugaccuccaaa

SEQ ID NO: 77597 - RNA, 21 nt, Artificial Sequence
  Oligomer
aagccuguaaucacgucagua

SEQ ID NO: 77598 - RNA, 21 nt, Artificial Sequence
  Oligomer
gacccucauucaaaauccagc

SEQ ID NO: 77599 - RNA, 21 nt, Artificial Sequence
  Oligomer
ccauauagauuucagaagagc

SEQ ID NO: 77600 - RNA, 21 nt, Artificial Sequence
  Oligomer
cuuaccaccuugguaaugaca

SEQ ID NO: 77601 - RNA, 21 nt, Artificial Sequence
  Oligomer
gaaagaagacgaugaaaacau

SEQ ID NO: 77602 - RNA, 21 nt, Artificial Sequence
  Oligomer
ugguagcguuccagguugaag

SEQ ID NO: 77603 - RNA, 21 nt, Artificial Sequence
  Oligomer
uagcguuccagguugaagaaa

SEQ ID NO: 77604 - RNA, 21 nt, Artificial Sequence
  Oligomer
agcguuccagguugaagaaau

SEQ ID NO: 77605 - RNA, 21 nt, Artificial Sequence
  Oligomer
cgguccucugcagcaaauacu

SEQ ID NO: 77606 - RNA, 21 nt, Artificial Sequence
  Oligomer
gccaguguugaacccaaaaua

SEQ ID NO: 77607 - RNA, 21 nt, Artificial Sequence
  Oligomer
ccuccucuucauaccaguaga

SEQ ID NO: 77608 - RNA, 21 nt, Artificial Sequence
  Oligomer
agcucauaucaacaggccguc

SEQ ID NO: 77609 - RNA, 21 nt, Artificial Sequence
  Oligomer
ucccagccaugagaguacuaa

SEQ ID NO: 77610 - RNA, 21 nt, Artificial Sequence
  Oligomer
agucuagaagcucuccuuguu

SEQ ID NO: 77611 - RNA, 21 nt, Artificial Sequence
  Oligomer
gucagcugaugaauacaagug

SEQ ID NO: 77612 - RNA, 21 nt, Artificial Sequence
  Oligomer
gcaaucugcuugaacucauug

SEQ ID NO: 77613 - RNA, 21 nt, Artificial Sequence
  Oligomer
cccucauucaaaauccagcac

SEQ ID NO: 77614 - RNA, 21 nt, Artificial Sequence
  Oligomer
uaccaccuugguaaugacaac

SEQ ID NO: 77615 - RNA, 21 nt, Artificial Sequence
  Oligomer
cugcauagcggucucuacaga

SEQ ID NO: 77616 - RNA, 21 nt, Artificial Sequence
  Oligomer
auggauggccaggcugagaaa

SEQ ID NO: 77617 - RNA, 21 nt, Artificial Sequence
  Oligomer
acaacucauaggaggccuguc

SEQ ID NO: 77618 - RNA, 21 nt, Artificial Sequence
  Oligomer
cucauaggaggccugucugau

SEQ ID NO: 77619 - RNA, 21 nt, Artificial Sequence
  Oligomer
caggaaauuucuucucccuca

SEQ ID NO: 77620 - RNA, 21 nt, Artificial Sequence
  Oligomer
ggucaugaucaagacuaaagc

SEQ ID NO: 77621 - RNA, 21 nt, Artificial Sequence
  Oligomer
gaagaaaugcgccacgaugug

SEQ ID NO: 77622 - RNA, 21 nt, Artificial Sequence
  Oligomer
cagccaugagaguacuaauau

SEQ ID NO: 77623 - RNA, 21 nt, Artificial Sequence
  Oligomer
cugaugaauacaaguggcaca

SEQ ID NO: 77624 - RNA, 21 nt, Artificial Sequence
  Oligomer
aggcaaucugcuugaacucau

SEQ ID NO: 77625 - RNA, 21 nt, Artificial Sequence
  Oligomer
guacuaauaugguggagagac

SEQ ID NO: 77626 - RNA, 21 nt, Artificial Sequence
  Oligomer
cauagaaggucuucugcuuua

SEQ ID NO: 77627 - RNA, 21 nt, Artificial Sequence
  Oligomer
acaagaccacagggccuaaaa

SEQ ID NO: 77628 - RNA, 21 nt, Artificial Sequence
  Oligomer
aggugauguugugcagagaga

SEQ ID NO: 77629 - RNA, 21 nt, Artificial Sequence
  Oligomer
cuuggguuuggccucgaacaa

SEQ ID NO: 77630 - RNA, 21 nt, Artificial Sequence
  Oligomer
guccuuagcaauucagugguu

SEQ ID NO: 77631 - RNA, 21 nt, Artificial Sequence
  Oligomer
cacgauguggaugguugcauu

SEQ ID NO: 77632 - RNA, 21 nt, Artificial Sequence
  Oligomer
ccaguuugugaaaucugaggu

SEQ ID NO: 77633 - RNA, 21 nt, Artificial Sequence
  Oligomer
caaauacuuguuccucuuaug

SEQ ID NO: 77634 - RNA, 21 nt, Artificial Sequence
  Oligomer
acuuguuccucuuaugaauga

SEQ ID NO: 77635 - RNA, 21 nt, Artificial Sequence
  Oligomer
acaggaauuccugguggaguu

SEQ ID NO: 77636 - RNA, 21 nt, Artificial Sequence
  Oligomer
gagagagcuuuagguccacag

SEQ ID NO: 77637 - RNA, 21 nt, Artificial Sequence
  Oligomer
ucccagccgguaagaaauaua

SEQ ID NO: 77638 - RNA, 21 nt, Artificial Sequence
  Oligomer
gcucacucauccguguuucca

SEQ ID NO: 77639 - RNA, 21 nt, Artificial Sequence
  Oligomer
ugcaucccggcaaauccagua

SEQ ID NO: 77640 - RNA, 21 nt, Artificial Sequence
  Oligomer
gugccucacugcauuuguacc

SEQ ID NO: 77641 - RNA, 21 nt, Artificial Sequence
  Oligomer
cugcccuggcgccauuuuaaa

SEQ ID NO: 77642 - RNA, 21 nt, Artificial Sequence
  Oligomer
acucauaggaggccugucuga

SEQ ID NO: 77643 - RNA, 21 nt, Artificial Sequence
  Oligomer
guugacgaggucaugaucaag

SEQ ID NO: 77644 - RNA, 21 nt, Artificial Sequence
  Oligomer
aggaaauuucuucucccucac

SEQ ID NO: 77645 - RNA, 21 nt, Artificial Sequence
  Oligomer
aggucaugaucaagacuaaag

SEQ ID NO: 77646 - RNA, 21 nt, Artificial Sequence
  Oligomer
auaggcgaccaguuugugaaa

SEQ ID NO: 77647 - RNA, 21 nt, Artificial Sequence
  Oligomer
acgguccucugcagcaaauac

SEQ ID NO: 77648 - RNA, 21 nt, Artificial Sequence
  Oligomer
gguccucugcagcaaauacuu

SEQ ID NO: 77649 - RNA, 21 nt, Artificial Sequence
  Oligomer
gguauuagaauuagcaugcag

SEQ ID NO: 77650 - RNA, 21 nt, Artificial Sequence
  Oligomer
gguauaguguacuguucacaa

SEQ ID NO: 77651 - RNA, 21 nt, Artificial Sequence
  Oligomer
cacaucuuuugaaguguccuc

SEQ ID NO: 77652 - RNA, 21 nt, Artificial Sequence
  Oligomer
cucgagagagcuuuaggucca

SEQ ID NO: 77653 - RNA, 21 nt, Artificial Sequence
  Oligomer
gcuuuaagccuguaaucacgu

SEQ ID NO: 77654 - RNA, 21 nt, Artificial Sequence
  Oligomer
guauuuucgucccaguguaaa

SEQ ID NO: 77655 - RNA, 21 nt, Artificial Sequence
  Oligomer
gagccugauuuucaucccagc

SEQ ID NO: 77656 - RNA, 21 nt, Artificial Sequence
  Oligomer
aagcucuugcaucccggcaaa

SEQ ID NO: 77657 - RNA, 21 nt, Artificial Sequence
  Oligomer
ccucacugcauuuguaccaua

SEQ ID NO: 77658 - RNA, 21 nt, Artificial Sequence
  Oligomer
guaccauauagauuucagaag

SEQ ID NO: 77659 - RNA, 21 nt, Artificial Sequence
  Oligomer
agagagagacugucuuggguu

SEQ ID NO: 77660 - RNA, 21 nt, Artificial Sequence
  Oligomer
cuuagcaauucagugguugug

SEQ ID NO: 77661 - RNA, 21 nt, Artificial Sequence
  Oligomer
accugugucuggauguugggu

SEQ ID NO: 77662 - RNA, 21 nt, Artificial Sequence
  Oligomer
gauguugggucguuaguaagg

SEQ ID NO: 77663 - RNA, 21 nt, Artificial Sequence
  Oligomer
ccaguguugaacccaaaauaa

SEQ ID NO: 77664 - RNA, 21 nt, Artificial Sequence
  Oligomer
aagcuaaggaaguaugguaua

SEQ ID NO: 77665 - RNA, 21 nt, Artificial Sequence
  Oligomer
acuugaccuccaaagucuaga

SEQ ID NO: 77666 - RNA, 21 nt, Artificial Sequence
  Oligomer
guccucgagagagcuuuaggu

SEQ ID NO: 77667 - RNA, 21 nt, Artificial Sequence
  Oligomer
caaucugcuugaacucauugu

SEQ ID NO: 77668 - RNA, 21 nt, Artificial Sequence
  Oligomer
gccuguaaucacgucaguauu

SEQ ID NO: 77669 - RNA, 21 nt, Artificial Sequence
  Oligomer
uuucaucccagccgguaagaa

SEQ ID NO: 77670 - RNA, 21 nt, Artificial Sequence
  Oligomer
auccguguuuccagggagagu

SEQ ID NO: 77671 - RNA, 21 nt, Artificial Sequence
  Oligomer
acacacacacuggguagugaa

SEQ ID NO: 77672 - RNA, 21 nt, Artificial Sequence
  Oligomer
gaaaucgccagaaccuaauua

SEQ ID NO: 77673 - RNA, 21 nt, Artificial Sequence
  Oligomer
ggccuaaaauccauuuccaag

SEQ ID NO: 77674 - RNA, 21 nt, Artificial Sequence
  Oligomer
guuuggccucgaacaauccga

SEQ ID NO: 77675 - RNA, 21 nt, Artificial Sequence
  Oligomer
cugcuauuguccuuagcaauu

SEQ ID NO: 77676 - RNA, 21 nt, Artificial Sequence
  Oligomer
cagcaaaccacucaaaagcuc

SEQ ID NO: 77677 - RNA, 21 nt, Artificial Sequence
  Oligomer
cugcauuuguaccauauagau

SEQ ID NO: 77678 - RNA, 21 nt, Artificial Sequence
  Oligomer
gcacgcugaaaaagucuuccu

SEQ ID NO: 77679 - RNA, 21 nt, Artificial Sequence
  Oligomer
cauuuuaaagccacgcuuuuu

SEQ ID NO: 77680 - RNA, 21 nt, Artificial Sequence
  Oligomer
ccuugguaaugacaacuucuu

SEQ ID NO: 77681 - RNA, 21 nt, Artificial Sequence
  Oligomer
cacugucugccauucugcaua

SEQ ID NO: 77682 - RNA, 21 nt, Artificial Sequence
  Oligomer
gugauguugugcagagagaga

SEQ ID NO: 77683 - RNA, 21 nt, Artificial Sequence
  Oligomer
uggccaggcugagaaagaaga

SEQ ID NO: 77684 - RNA, 21 nt, Artificial Sequence
  Oligomer
gcauuaacagcuaucccauag

SEQ ID NO: 77685 - RNA, 21 nt, Artificial Sequence
  Oligomer
gaauacaaguggcacaucuuu

SEQ ID NO: 77686 - RNA, 21 nt, Artificial Sequence
  Oligomer
guccacagaagaacacgccaa

SEQ ID NO: 77687 - RNA, 21 nt, Artificial Sequence
  Oligomer
ugauaacucagaaagugaguu

SEQ ID NO: 77688 - RNA, 21 nt, Artificial Sequence
  Oligomer
accacucaaaagcucuugcau

SEQ ID NO: 77689 - RNA, 21 nt, Artificial Sequence
  Oligomer
aaauacaucugucagggcagu

SEQ ID NO: 77690 - RNA, 21 nt, Artificial Sequence
  Oligomer
cgccauuuuaaagccacgcuu

SEQ ID NO: 77691 - RNA, 21 nt, Artificial Sequence
  Oligomer
cacaugcauacaagaccacag

SEQ ID NO: 77692 - RNA, 21 nt, Artificial Sequence
  Oligomer
ggugauguugugcagagagag

SEQ ID NO: 77693 - RNA, 21 nt, Artificial Sequence
  Oligomer
guguguaccagaacaacucau

SEQ ID NO: 77694 - RNA, 21 nt, Artificial Sequence
  Oligomer
cuaucccauaggcgaccaguu

SEQ ID NO: 77695 - RNA, 21 nt, Artificial Sequence
  Oligomer
aagccaguguugaacccaaaa

SEQ ID NO: 77696 - RNA, 21 nt, Artificial Sequence
  Oligomer
agccaguguugaacccaaaau

SEQ ID NO: 77697 - RNA, 21 nt, Artificial Sequence
  Oligomer
cauaccaguagaacgugucaa

SEQ ID NO: 77698 - RNA, 21 nt, Artificial Sequence
  Oligomer
cacaggaauuccugguggagu

SEQ ID NO: 77699 - RNA, 21 nt, Artificial Sequence
  Oligomer
augccuggacuugaccuccaa

SEQ ID NO: 77700 - RNA, 21 nt, Artificial Sequence
  Oligomer
cggcaaauccaguagaaauac

SEQ ID NO: 77701 - RNA, 21 nt, Artificial Sequence
  Oligomer
ccacagggccuaaaauccauu

SEQ ID NO: 77702 - RNA, 21 nt, Artificial Sequence
  Oligomer
ggugauuguaggcaaucugcu

SEQ ID NO: 77703 - RNA, 21 nt, Artificial Sequence
  Oligomer
gugauuguaggcaaucugcuu

SEQ ID NO: 77704 - RNA, 21 nt, Artificial Sequence
  Oligomer
ccauagaaggucuucugcuuu

SEQ ID NO: 77705 - RNA, 21 nt, Artificial Sequence
  Oligomer
guggagagacccucauucaaa

SEQ ID NO: 77706 - RNA, 21 nt, Artificial Sequence
  Oligomer
cugugccucacugcauuugua

SEQ ID NO: 77707 - RNA, 21 nt, Artificial Sequence
  Oligomer
cacuggguagugaaauacauc

SEQ ID NO: 77708 - RNA, 21 nt, Artificial Sequence
  Oligomer
caucugucagggcaguuccaa

SEQ ID NO: 77709 - RNA, 21 nt, Artificial Sequence
  Oligomer
aguaagggcuucccuaguaaa

SEQ ID NO: 77710 - RNA, 21 nt, Artificial Sequence
  Oligomer
ugucuuggguuuggccucgaa

SEQ ID NO: 77711 - RNA, 21 nt, Artificial Sequence
  Oligomer
agaaagaagacgaugaaaaca

SEQ ID NO: 77712 - RNA, 21 nt, Artificial Sequence
  Oligomer
augguguguguaccagaacaa

SEQ ID NO: 77713 - RNA, 21 nt, Artificial Sequence
  Oligomer
gguguguguaccagaacaacu

SEQ ID NO: 77714 - RNA, 21 nt, Artificial Sequence
  Oligomer
gguugagguagcucucguuag

SEQ ID NO: 77715 - RNA, 21 nt, Artificial Sequence
  Oligomer
gguagcguuccagguugaaga

SEQ ID NO: 77716 - RNA, 21 nt, Artificial Sequence
  Oligomer
cgacugacagguauuagaauu

SEQ ID NO: 77717 - RNA, 21 nt, Artificial Sequence
  Oligomer
ccuggacuugaccuccaaagu

SEQ ID NO: 77718 - RNA, 21 nt, Artificial Sequence
  Oligomer
ccagccaugagaguacuaaua

SEQ ID NO: 77719 - RNA, 21 nt, Artificial Sequence
  Oligomer
ccacgcuuuuucaugugaagu

SEQ ID NO: 77720 - RNA, 21 nt, Artificial Sequence
  Oligomer
ccugcuauuguccuuagcaau

SEQ ID NO: 77721 - RNA, 21 nt, Artificial Sequence
  Oligomer
gcagcaaauacuuguuccucu

SEQ ID NO: 77722 - RNA, 21 nt, Artificial Sequence
  Oligomer
guguacuguucacaauaguua

SEQ ID NO: 77723 - RNA, 21 nt, Artificial Sequence
  Oligomer
guggaguucuuuggaaucaau

SEQ ID NO: 77724 - RNA, 21 nt, Artificial Sequence
  Oligomer
cuagaagcucuccuuguugua

SEQ ID NO: 77725 - RNA, 21 nt, Artificial Sequence
  Oligomer
gcucuccuuguuguaauagaa

SEQ ID NO: 77726 - RNA, 21 nt, Artificial Sequence
  Oligomer
cgagagagcuuuagguccaca

SEQ ID NO: 77727 - RNA, 21 nt, Artificial Sequence
  Oligomer
cgucaguauuuucgucccagu

SEQ ID NO: 77728 - RNA, 21 nt, Artificial Sequence
  Oligomer
ucacugcauuuguaccauaua

SEQ ID NO: 77729 - RNA, 21 nt, Artificial Sequence
  Oligomer
gccauuuuaaagccacgcuuu

SEQ ID NO: 77730 - RNA, 21 nt, Artificial Sequence
  Oligomer
cagaaggugauguugugcaga

SEQ ID NO: 77731 - RNA, 21 nt, Artificial Sequence
  Oligomer
gaaaucugagguuuuugucua

SEQ ID NO: 77732 - RNA, 21 nt, Artificial Sequence
  Oligomer
ucacaggaauuccugguggag

SEQ ID NO: 77733 - RNA, 21 nt, Artificial Sequence
  Oligomer
acaaguggcacaucuuuugaa

SEQ ID NO: 77734 - RNA, 21 nt, Artificial Sequence
  Oligomer
ccacagaagaacacgccaaua

SEQ ID NO: 77735 - RNA, 21 nt, Artificial Sequence
  Oligomer
cccaguguaaagcuaugugaa

SEQ ID NO: 77736 - RNA, 21 nt, Artificial Sequence
  Oligomer
guaaagcuaugugaagagccu

SEQ ID NO: 77737 - RNA, 21 nt, Artificial Sequence
  Oligomer
ccagggagaguaagagaucag

SEQ ID NO: 77738 - RNA, 21 nt, Artificial Sequence
  Oligomer
agagaucagcaaaccacucaa

SEQ ID NO: 77739 - RNA, 21 nt, Artificial Sequence
  Oligomer
gugccacuccagcgaagauau

SEQ ID NO: 77740 - RNA, 21 nt, Artificial Sequence
  Oligomer
ggcacugcaccaagauguacu

SEQ ID NO: 77741 - RNA, 21 nt, Artificial Sequence
  Oligomer
cucuucggcugucaggaaauu

SEQ ID NO: 77742 - RNA, 21 nt, Artificial Sequence
  Oligomer
cuccuccucuucauaccagua

SEQ ID NO: 77743 - RNA, 21 nt, Artificial Sequence
  Oligomer
cugguggaguucuuuggaauc

SEQ ID NO: 77744 - RNA, 21 nt, Artificial Sequence
  Oligomer
gcugaugaauacaaguggcac

SEQ ID NO: 77745 - RNA, 21 nt, Artificial Sequence
  Oligomer
gaugaauacaaguggcacauc

SEQ ID NO: 77746 - RNA, 21 nt, Artificial Sequence
  Oligomer
gaagaacacgccaauacugcu

SEQ ID NO: 77747 - RNA, 21 nt, Artificial Sequence
  Oligomer
caucccagccgguaagaaaua

SEQ ID NO: 77748 - RNA, 21 nt, Artificial Sequence
  Oligomer
gcaaauccaguagaaauacac

SEQ ID NO: 77749 - RNA, 21 nt, Artificial Sequence
  Oligomer
acacuggguagugaaauacau

SEQ ID NO: 77750 - RNA, 21 nt, Artificial Sequence
  Oligomer
aggguuccuugccagaaaauu

SEQ ID NO: 77751 - RNA, 21 nt, Artificial Sequence
  Oligomer
ccauucugcauagcggucucu

SEQ ID NO: 77752 - RNA, 21 nt, Artificial Sequence
  Oligomer
cucaguugacgaggucaugau

SEQ ID NO: 77753 - RNA, 21 nt, Artificial Sequence
  Oligomer
gcuauuguccuuagcaauuca

SEQ ID NO: 77754 - RNA, 21 nt, Artificial Sequence
  Oligomer
agcaauucagugguuguguuu

SEQ ID NO: 77755 - RNA, 21 nt, Artificial Sequence
  Oligomer
acgauguggaugguugcauua

SEQ ID NO: 77756 - RNA, 21 nt, Artificial Sequence
  Oligomer
gauguggaugguugcauuaac

SEQ ID NO: 77757 - RNA, 21 nt, Artificial Sequence
  Oligomer
gacagguauuagaauuagcau

SEQ ID NO: 77758 - RNA, 21 nt, Artificial Sequence
  Oligomer
agggcuucccuaguaaauuau

SEQ ID NO: 77759 - RNA, 21 nt, Artificial Sequence
  Oligomer
gaaagacuccuccucuucaua

SEQ ID NO: 77760 - RNA, 21 nt, Artificial Sequence
  Oligomer
gaguucuuuggaaucaauaac

SEQ ID NO: 77761 - RNA, 21 nt, Artificial Sequence
  Oligomer
aaagcucuugcaucccggcaa

SEQ ID NO: 77762 - RNA, 21 nt, Artificial Sequence
  Oligomer
ugggcacugcaccaagaugua

SEQ ID NO: 77763 - RNA, 21 nt, Artificial Sequence
  Oligomer
ccaccuugguaaugacaacuu

SEQ ID NO: 77764 - RNA, 21 nt, Artificial Sequence
  Oligomer
guaagggcuucccuaguaaau

SEQ ID NO: 77765 - RNA, 21 nt, Artificial Sequence
  Oligomer
guugugcagagagagacuguc

SEQ ID NO: 77766 - RNA, 21 nt, Artificial Sequence
  Oligomer
gagagacugucuuggguuugg

SEQ ID NO: 77767 - RNA, 21 nt, Artificial Sequence
  Oligomer
gaucaagacuaaagccagaga

SEQ ID NO: 77768 - RNA, 21 nt, Artificial Sequence
  Oligomer
cagcaaauacuuguuccucuu

SEQ ID NO: 77769 - RNA, 21 nt, Artificial Sequence
  Oligomer
gaaaacacaaugccuggacuu

SEQ ID NO: 77770 - RNA, 21 nt, Artificial Sequence
  Oligomer
cccauagaaggucuucugcuu

SEQ ID NO: 77771 - RNA, 21 nt, Artificial Sequence
  Oligomer
gucuucugcuuuaagccugua

SEQ ID NO: 77772 - RNA, 21 nt, Artificial Sequence
  Oligomer
agccuguaaucacgucaguau

SEQ ID NO: 77773 - RNA, 21 nt, Artificial Sequence
  Oligomer
caguguaaagcuaugugaaga

SEQ ID NO: 77774 - RNA, 21 nt, Artificial Sequence
  Oligomer
cguguuuccagggagaguaag

SEQ ID NO: 77775 - RNA, 21 nt, Artificial Sequence
  Oligomer
ggucugugccucacugcauuu

SEQ ID NO: 77776 - RNA, 21 nt, Artificial Sequence
  Oligomer
agauuucagaagagcagcgaa

SEQ ID NO: 77777 - RNA, 21 nt, Artificial Sequence
  Oligomer
cgcugaaaaagucuuccuggg

SEQ ID NO: 77778 - RNA, 21 nt, Artificial Sequence
  Oligomer
cuggcgccauuuuaaagccac

SEQ ID NO: 77779 - RNA, 21 nt, Artificial Sequence
  Oligomer
agccacgcuuuuucaugugaa

SEQ ID NO: 77780 - RNA, 21 nt, Artificial Sequence
  Oligomer
cugagaaagaagacgaugaaa

SEQ ID NO: 77781 - RNA, 23 nt, Artificial Sequence
  Oligomer
gcaugugaaagaauaauuagguu

SEQ ID NO: 77782 - RNA, 23 nt, Artificial Sequence
  Oligomer
ccuuauuucauucauaagaggaa

SEQ ID NO: 77783 - RNA, 23 nt, Artificial Sequence
  Oligomer
uucuaugggaggcccaacuggaa

SEQ ID NO: 77784 - RNA, 23 nt, Artificial Sequence
  Oligomer
guguucauuucuauuacaacaag

SEQ ID NO: 77785 - RNA, 23 nt, Artificial Sequence
  Oligomer
guuuauugacacguucuacuggu

SEQ ID NO: 77786 - RNA, 23 nt, Artificial Sequence
  Oligomer
gaaagaauaauuagguucuggcg

SEQ ID NO: 77787 - RNA, 23 nt, Artificial Sequence
  Oligomer
uaaaauggcgccagggcaguaca

SEQ ID NO: 77788 - RNA, 23 nt, Artificial Sequence
  Oligomer
ugcaugugaaagaauaauuaggu

SEQ ID NO: 77789 - RNA, 23 nt, Artificial Sequence
  Oligomer
gaguuaucauauauuucuuaccg

SEQ ID NO: 77790 - RNA, 23 nt, Artificial Sequence
  Oligomer
guuauugauuccaaagaacucca

SEQ ID NO: 77791 - RNA, 23 nt, Artificial Sequence
  Oligomer
aaagaauaauuagguucuggcga

SEQ ID NO: 77792 - RNA, 23 nt, Artificial Sequence
  Oligomer
aauuccugugacggccuguugau

SEQ ID NO: 77793 - RNA, 23 nt, Artificial Sequence
  Oligomer
gaauuccugugacggccuguuga

SEQ ID NO: 77794 - RNA, 23 nt, Artificial Sequence
  Oligomer
gacaaaauaauuuacuagggaag

SEQ ID NO: 77795 - RNA, 23 nt, Artificial Sequence
  Oligomer
uaugggaggcccaacuggaacaa

SEQ ID NO: 77796 - RNA, 23 nt, Artificial Sequence
  Oligomer
uguuuucaucgucuucuuucuca

SEQ ID NO: 77797 - RNA, 23 nt, Artificial Sequence
  Oligomer
cuauuacaacaaggagagcuucu

SEQ ID NO: 77798 - RNA, 23 nt, Artificial Sequence
  Oligomer
aagaccuucuaugggaggcccaa

SEQ ID NO: 77799 - RNA, 23 nt, Artificial Sequence
  Oligomer
aaaauggcgccagggcaguacau

SEQ ID NO: 77800 - RNA, 23 nt, Artificial Sequence
  Oligomer
gcugggaauaaauuuuuaucugu

SEQ ID NO: 77801 - RNA, 23 nt, Artificial Sequence
  Oligomer
gaaguugucauuaccaagguggu

SEQ ID NO: 77802 - RNA, 23 nt, Artificial Sequence
  Oligomer
gauuuugaaugagggucucucca

SEQ ID NO: 77803 - RNA, 23 nt, Artificial Sequence
  Oligomer
cuuacucucccuggaaacacgga

SEQ ID NO: 77804 - RNA, 23 nt, Artificial Sequence
  Oligomer
cuuuaaaauggcgccagggcagu

SEQ ID NO: 77805 - RNA, 23 nt, Artificial Sequence
  Oligomer
ugaaagaauaauuagguucuggc

SEQ ID NO: 77806 - RNA, 23 nt, Artificial Sequence
  Oligomer
uauuaguacucucauggcuggga

SEQ ID NO: 77807 - RNA, 23 nt, Artificial Sequence
  Oligomer
auaauuuacuagggaagcccuua

SEQ ID NO: 77808 - RNA, 23 nt, Artificial Sequence
  Oligomer
cauauuaguacucucauggcugg

SEQ ID NO: 77809 - RNA, 23 nt, Artificial Sequence
  Oligomer
ugugaaagaauaauuagguucug

SEQ ID NO: 77810 - RNA, 23 nt, Artificial Sequence
  Oligomer
augcaugugaaagaauaauuagg

SEQ ID NO: 77811 - RNA, 23 nt, Artificial Sequence
  Oligomer
aacugaguucaucagacaggccu

SEQ ID NO: 77812 - RNA, 23 nt, Artificial Sequence
  Oligomer
auugauuccaaagaacuccacca

SEQ ID NO: 77813 - RNA, 23 nt, Artificial Sequence
  Oligomer
uuugaaugagggucucuccacca

SEQ ID NO: 77814 - RNA, 23 nt, Artificial Sequence
  Oligomer
gauuuuaggcccuguggucuugu

SEQ ID NO: 77815 - RNA, 23 nt, Artificial Sequence
  Oligomer
aggaauuccugugacggccuguu

SEQ ID NO: 77816 - RNA, 23 nt, Artificial Sequence
  Oligomer
accuuauuucauucauaagagga

SEQ ID NO: 77817 - RNA, 23 nt, Artificial Sequence
  Oligomer
aguuaucauauauuucuuaccgg

SEQ ID NO: 77818 - RNA, 23 nt, Artificial Sequence
  Oligomer
agaauggcagacaguggcccaau

SEQ ID NO: 77819 - RNA, 23 nt, Artificial Sequence
  Oligomer
cuucaaccuggaacgcuaccacu

SEQ ID NO: 77820 - RNA, 23 nt, Artificial Sequence
  Oligomer
caugugaaagaauaauuagguuc

SEQ ID NO: 77821 - RNA, 23 nt, Artificial Sequence
  Oligomer
uauuuuggguucaacacuggcuu

SEQ ID NO: 77822 - RNA, 23 nt, Artificial Sequence
  Oligomer
uuauuuuggguucaacacuggcu

SEQ ID NO: 77823 - RNA, 23 nt, Artificial Sequence
  Oligomer
uuuaaaauggcgccagggcagua

SEQ ID NO: 77824 - RNA, 23 nt, Artificial Sequence
  Oligomer
caacagaacaaaaacauuuacug

SEQ ID NO: 77825 - RNA, 23 nt, Artificial Sequence
  Oligomer
gugaaagaauaauuagguucugg

SEQ ID NO: 77826 - RNA, 23 nt, Artificial Sequence
  Oligomer
aaauaauuuacuagggaagcccu

SEQ ID NO: 77827 - RNA, 23 nt, Artificial Sequence
  Oligomer
uauuugcugcagaggaccgugga

SEQ ID NO: 77828 - RNA, 23 nt, Artificial Sequence
  Oligomer
uaauuuacuagggaagcccuuac

SEQ ID NO: 77829 - RNA, 23 nt, Artificial Sequence
  Oligomer
guuugcugaucucuuacucuccc

SEQ ID NO: 77830 - RNA, 23 nt, Artificial Sequence
  Oligomer
uugaaugagggucucuccaccau

SEQ ID NO: 77831 - RNA, 23 nt, Artificial Sequence
  Oligomer
aauuuacuagggaagcccuuacu

SEQ ID NO: 77832 - RNA, 23 nt, Artificial Sequence
  Oligomer
uugauaugagcucccaguuggga

SEQ ID NO: 77833 - RNA, 23 nt, Artificial Sequence
  Oligomer
aaagaacuccaccaggaauuccu

SEQ ID NO: 77834 - RNA, 23 nt, Artificial Sequence
  Oligomer
auuugccgggaugcaagagcuuu

SEQ ID NO: 77835 - RNA, 23 nt, Artificial Sequence
  Oligomer
ugaaaucuauaugguacaaaugc

SEQ ID NO: 77836 - RNA, 23 nt, Artificial Sequence
  Oligomer
auuucacuacccagugugugugu

SEQ ID NO: 77837 - RNA, 23 nt, Artificial Sequence
  Oligomer
aauaauuuacuagggaagcccuu

SEQ ID NO: 77838 - RNA, 23 nt, Artificial Sequence
  Oligomer
gucuucuuucucagccuggccau

SEQ ID NO: 77839 - RNA, 23 nt, Artificial Sequence
  Oligomer
aaguugucauuaccaagguggua

SEQ ID NO: 77840 - RNA, 23 nt, Artificial Sequence
  Oligomer
guuauuuuggguucaacacuggc

SEQ ID NO: 77841 - RNA, 23 nt, Artificial Sequence
  Oligomer
acaaaauaauuuacuagggaagc

SEQ ID NO: 77842 - RNA, 23 nt, Artificial Sequence
  Oligomer
ccuuagcuuauaaauaacauguc

SEQ ID NO: 77843 - RNA, 23 nt, Artificial Sequence
  Oligomer
uaacgagagcuaccucaacccug

SEQ ID NO: 77844 - RNA, 23 nt, Artificial Sequence
  Oligomer
aaccauccacaucguggcgcauu

SEQ ID NO: 77845 - RNA, 23 nt, Artificial Sequence
  Oligomer
aaguuauugauuccaaagaacuc

SEQ ID NO: 77846 - RNA, 23 nt, Artificial Sequence
  Oligomer
uuaaaauggcgccagggcaguac

SEQ ID NO: 77847 - RNA, 23 nt, Artificial Sequence
  Oligomer
uauuucuacuggauuugccggga

SEQ ID NO: 77848 - RNA, 23 nt, Artificial Sequence
  Oligomer
uuuccugacagccgaagagcaac

SEQ ID NO: 77849 - RNA, 23 nt, Artificial Sequence
  Oligomer
cuuauuucauucauaagaggaac

SEQ ID NO: 77850 - RNA, 23 nt, Artificial Sequence
  Oligomer
ucuucuguggaccuaaagcucuc

SEQ ID NO: 77851 - RNA, 23 nt, Artificial Sequence
  Oligomer
uuacucucccuggaaacacggau

SEQ ID NO: 77852 - RNA, 23 nt, Artificial Sequence
  Oligomer
ucuuucucagccuggccauccau

SEQ ID NO: 77853 - RNA, 23 nt, Artificial Sequence
  Oligomer
cagauuucacaaacuggucgccu

SEQ ID NO: 77854 - RNA, 23 nt, Artificial Sequence
  Oligomer
uaaugcaaccauccacaucgugg

SEQ ID NO: 77855 - RNA, 23 nt, Artificial Sequence
  Oligomer
aacauccagacacaggugaggga

SEQ ID NO: 77856 - RNA, 23 nt, Artificial Sequence
  Oligomer
gaacuccaccaggaauuccugug

SEQ ID NO: 77857 - RNA, 23 nt, Artificial Sequence
  Oligomer
uauugauuccaaagaacuccacc

SEQ ID NO: 77858 - RNA, 23 nt, Artificial Sequence
  Oligomer
guauuucuacuggauuugccggg

SEQ ID NO: 77859 - RNA, 23 nt, Artificial Sequence
  Oligomer
cauuaccaaggugguaagccacc

SEQ ID NO: 77860 - RNA, 23 nt, Artificial Sequence
  Oligomer
uguauuucuacuggauuugccgg

SEQ ID NO: 77861 - RNA, 23 nt, Artificial Sequence
  Oligomer
aaccuaauuauucuuucacaugc

SEQ ID NO: 77862 - RNA, 23 nt, Artificial Sequence
  Oligomer
uuccucuuaugaaugaaauaagg

SEQ ID NO: 77863 - RNA, 23 nt, Artificial Sequence
  Oligomer
uuccaguugggccucccauagaa

SEQ ID NO: 77864 - RNA, 23 nt, Artificial Sequence
  Oligomer
cuuguuguaauagaaaugaacac

SEQ ID NO: 77865 - RNA, 23 nt, Artificial Sequence
  Oligomer
accaguagaacgugucaauaaac

SEQ ID NO: 77866 - RNA, 23 nt, Artificial Sequence
  Oligomer
cgccagaaccuaauuauucuuuc

SEQ ID NO: 77867 - RNA, 23 nt, Artificial Sequence
  Oligomer
uguacugcccuggcgccauuuua

SEQ ID NO: 77868 - RNA, 23 nt, Artificial Sequence
  Oligomer
accuaauuauucuuucacaugca

SEQ ID NO: 77869 - RNA, 23 nt, Artificial Sequence
  Oligomer
cgguaagaaauauaugauaacuc

SEQ ID NO: 77870 - RNA, 23 nt, Artificial Sequence
  Oligomer
uggaguucuuuggaaucaauaac

SEQ ID NO: 77871 - RNA, 23 nt, Artificial Sequence
  Oligomer
ucgccagaaccuaauuauucuuu

SEQ ID NO: 77872 - RNA, 23 nt, Artificial Sequence
  Oligomer
aucaacaggccgucacaggaauu

SEQ ID NO: 77873 - RNA, 23 nt, Artificial Sequence
  Oligomer
ucaacaggccgucacaggaauuc

SEQ ID NO: 77874 - RNA, 23 nt, Artificial Sequence
  Oligomer
cuucccuaguaaauuauuuuguc

SEQ ID NO: 77875 - RNA, 23 nt, Artificial Sequence
  Oligomer
uuguuccaguugggccucccaua

SEQ ID NO: 77876 - RNA, 23 nt, Artificial Sequence
  Oligomer
ugagaaagaagacgaugaaaaca

SEQ ID NO: 77877 - RNA, 23 nt, Artificial Sequence
  Oligomer
agaagcucuccuuguuguaauag

SEQ ID NO: 77878 - RNA, 23 nt, Artificial Sequence
  Oligomer
uugggccucccauagaaggucuu

SEQ ID NO: 77879 - RNA, 23 nt, Artificial Sequence
  Oligomer
auguacugcccuggcgccauuuu

SEQ ID NO: 77880 - RNA, 23 nt, Artificial Sequence
  Oligomer
acagauaaaaauuuauucccagc

SEQ ID NO: 77881 - RNA, 23 nt, Artificial Sequence
  Oligomer
accaccuugguaaugacaacuuc

SEQ ID NO: 77882 - RNA, 23 nt, Artificial Sequence
  Oligomer
uggagagacccucauucaaaauc

SEQ ID NO: 77883 - RNA, 23 nt, Artificial Sequence
  Oligomer
uccguguuuccagggagaguaag

SEQ ID NO: 77884 - RNA, 23 nt, Artificial Sequence
  Oligomer
acugcccuggcgccauuuuaaag

SEQ ID NO: 77885 - RNA, 23 nt, Artificial Sequence
  Oligomer
gccagaaccuaauuauucuuuca

SEQ ID NO: 77886 - RNA, 23 nt, Artificial Sequence
  Oligomer
ucccagccaugagaguacuaaua

SEQ ID NO: 77887 - RNA, 23 nt, Artificial Sequence
  Oligomer
uaagggcuucccuaguaaauuau

SEQ ID NO: 77888 - RNA, 23 nt, Artificial Sequence
  Oligomer
ccagccaugagaguacuaauaug

SEQ ID NO: 77889 - RNA, 23 nt, Artificial Sequence
  Oligomer
cagaaccuaauuauucuuucaca

SEQ ID NO: 77890 - RNA, 23 nt, Artificial Sequence
  Oligomer
ccuaauuauucuuucacaugcau

SEQ ID NO: 77891 - RNA, 23 nt, Artificial Sequence
  Oligomer
aggccugucugaugaacucaguu

SEQ ID NO: 77892 - RNA, 23 nt, Artificial Sequence
  Oligomer
ugguggaguucuuuggaaucaau

SEQ ID NO: 77893 - RNA, 23 nt, Artificial Sequence
  Oligomer
ugguggagagacccucauucaaa

SEQ ID NO: 77894 - RNA, 23 nt, Artificial Sequence
  Oligomer
acaagaccacagggccuaaaauc

SEQ ID NO: 77895 - RNA, 23 nt, Artificial Sequence
  Oligomer
aacaggccgucacaggaauuccu

SEQ ID NO: 77896 - RNA, 23 nt, Artificial Sequence
  Oligomer
uccucuuaugaaugaaauaaggu

SEQ ID NO: 77897 - RNA, 23 nt, Artificial Sequence
  Oligomer
ccgguaagaaauauaugauaacu

SEQ ID NO: 77898 - RNA, 23 nt, Artificial Sequence
  Oligomer
auugggccacugucugccauucu

SEQ ID NO: 77899 - RNA, 23 nt, Artificial Sequence
  Oligomer
agugguagcguuccagguugaag

SEQ ID NO: 77900 - RNA, 23 nt, Artificial Sequence
  Oligomer
gaaccuaauuauucuuucacaug

SEQ ID NO: 77901 - RNA, 23 nt, Artificial Sequence
  Oligomer
aagccaguguugaacccaaaaua

SEQ ID NO: 77902 - RNA, 23 nt, Artificial Sequence
  Oligomer
agccaguguugaacccaaaauaa

SEQ ID NO: 77903 - RNA, 23 nt, Artificial Sequence
  Oligomer
uacugcccuggcgccauuuuaaa

SEQ ID NO: 77904 - RNA, 23 nt, Artificial Sequence
  Oligomer
caguaaauguuuuuguucuguug

SEQ ID NO: 77905 - RNA, 23 nt, Artificial Sequence
  Oligomer
ccagaaccuaauuauucuuucac

SEQ ID NO: 77906 - RNA, 23 nt, Artificial Sequence
  Oligomer
agggcuucccuaguaaauuauuu

SEQ ID NO: 77907 - RNA, 23 nt, Artificial Sequence
  Oligomer
uccacgguccucugcagcaaaua

SEQ ID NO: 77908 - RNA, 23 nt, Artificial Sequence
  Oligomer
guaagggcuucccuaguaaauua

SEQ ID NO: 77909 - RNA, 23 nt, Artificial Sequence
  Oligomer
gggagaguaagagaucagcaaac

SEQ ID NO: 77910 - RNA, 23 nt, Artificial Sequence
  Oligomer
augguggagagacccucauucaa

SEQ ID NO: 77911 - RNA, 23 nt, Artificial Sequence
  Oligomer
aguaagggcuucccuaguaaauu

SEQ ID NO: 77912 - RNA, 23 nt, Artificial Sequence
  Oligomer
ucccaacugggagcucauaucaa

SEQ ID NO: 77913 - RNA, 23 nt, Artificial Sequence
  Oligomer
aggaauuccugguggaguucuuu

SEQ ID NO: 77914 - RNA, 23 nt, Artificial Sequence
  Oligomer
aaagcucuugcaucccggcaaau

SEQ ID NO: 77915 - RNA, 23 nt, Artificial Sequence
  Oligomer
gcauuuguaccauauagauuuca

SEQ ID NO: 77916 - RNA, 23 nt, Artificial Sequence
  Oligomer
acacacacacuggguagugaaau

SEQ ID NO: 77917 - RNA, 23 nt, Artificial Sequence
  Oligomer
aagggcuucccuaguaaauuauu

SEQ ID NO: 77918 - RNA, 23 nt, Artificial Sequence
  Oligomer
auggccaggcugagaaagaagac

SEQ ID NO: 77919 - RNA, 23 nt, Artificial Sequence
  Oligomer
uaccaccuugguaaugacaacuu

SEQ ID NO: 77920 - RNA, 23 nt, Artificial Sequence
  Oligomer
gccaguguugaacccaaaauaac

SEQ ID NO: 77921 - RNA, 23 nt, Artificial Sequence
  Oligomer
gcuucccuaguaaauuauuuugu

SEQ ID NO: 77922 - RNA, 23 nt, Artificial Sequence
  Oligomer
gacauguuauuuauaagcuaagg

SEQ ID NO: 77923 - RNA, 23 nt, Artificial Sequence
  Oligomer
caggguugagguagcucucguua

SEQ ID NO: 77924 - RNA, 23 nt, Artificial Sequence
  Oligomer
aaugcgccacgauguggaugguu

SEQ ID NO: 77925 - RNA, 23 nt, Artificial Sequence
  Oligomer
gaguucuuuggaaucaauaacuu

SEQ ID NO: 77926 - RNA, 23 nt, Artificial Sequence
  Oligomer
guacugcccuggcgccauuuuaa

SEQ ID NO: 77927 - RNA, 23 nt, Artificial Sequence
  Oligomer
ucccggcaaauccaguagaaaua

SEQ ID NO: 77928 - RNA, 23 nt, Artificial Sequence
  Oligomer
guugcucuucggcugucaggaaa

SEQ ID NO: 77929 - RNA, 23 nt, Artificial Sequence
  Oligomer
guuccucuuaugaaugaaauaag

SEQ ID NO: 77930 - RNA, 23 nt, Artificial Sequence
  Oligomer
gagagcuuuagguccacagaaga

SEQ ID NO: 77931 - RNA, 23 nt, Artificial Sequence
  Oligomer
auccguguuuccagggagaguaa

SEQ ID NO: 77932 - RNA, 23 nt, Artificial Sequence
  Oligomer
auggauggccaggcugagaaaga

SEQ ID NO: 77933 - RNA, 23 nt, Artificial Sequence
  Oligomer
aggcgaccaguuugugaaaucug

SEQ ID NO: 77934 - RNA, 23 nt, Artificial Sequence
  Oligomer
ccacgauguggaugguugcauua

SEQ ID NO: 77935 - RNA, 23 nt, Artificial Sequence
  Oligomer
ucccucaccugugucuggauguu

SEQ ID NO: 77936 - RNA, 23 nt, Artificial Sequence
  Oligomer
cacaggaauuccugguggaguuc

SEQ ID NO: 77937 - RNA, 23 nt, Artificial Sequence
  Oligomer
gguggaguucuuuggaaucaaua

SEQ ID NO: 77938 - RNA, 23 nt, Artificial Sequence
  Oligomer
cccggcaaauccaguagaaauac

SEQ ID NO: 77939 - RNA, 23 nt, Artificial Sequence
  Oligomer
gguggcuuaccaccuugguaaug

SEQ ID NO: 77940 - RNA, 23 nt, Artificial Sequence
  Oligomer
ccggcaaauccaguagaaauaca

SEQ ID NO: 77941 - RNA, 23 nt, Artificial Sequence
  Oligomer
gaaaaucaggcucuucacauagc

SEQ ID NO: 77942 - RNA, 23 nt, Artificial Sequence
  Oligomer
ugaaaaucaggcucuucacauag

SEQ ID NO: 77943 - RNA, 23 nt, Artificial Sequence
  Oligomer
augaaaaucaggcucuucacaua

SEQ ID NO: 77944 - RNA, 23 nt, Artificial Sequence
  Oligomer
cguggaggaggcaauuagacaaa

SEQ ID NO: 77945 - RNA, 23 nt, Artificial Sequence
  Oligomer
ccguggaggaggcaauuagacaa

SEQ ID NO: 77946 - RNA, 23 nt, Artificial Sequence
  Oligomer
gggaacuggugaauaauaauuaa

SEQ ID NO: 77947 - RNA, 23 nt, Artificial Sequence
  Oligomer
ugggaacuggugaauaauaauua

SEQ ID NO: 77948 - RNA, 23 nt, Artificial Sequence
  Oligomer
uugggaacuggugaauaauaauu

SEQ ID NO: 77949 - RNA, 23 nt, Artificial Sequence
  Oligomer
guugggaacuggugaauaauaau

SEQ ID NO: 77950 - RNA, 23 nt, Artificial Sequence
  Oligomer
aguugggaacuggugaauaauaa

SEQ ID NO: 77951 - RNA, 23 nt, Artificial Sequence
  Oligomer
gaugaaaaucaggcucuucacau

SEQ ID NO: 77952 - RNA, 23 nt, Artificial Sequence
  Oligomer
ggaacuggugaauaauaauuaac

SEQ ID NO: 77953 - RNA, 23 nt, Artificial Sequence
  Oligomer
gcuuuacacugggacgaaaauac

SEQ ID NO: 77954 - RNA, 23 nt, Artificial Sequence
  Oligomer
cgaaaauacugacgugauuacag

SEQ ID NO: 77955 - RNA, 23 nt, Artificial Sequence
  Oligomer
guucuucuguggaccuaaagcuc

SEQ ID NO: 77956 - RNA, 23 nt, Artificial Sequence
  Oligomer
uguucuucuguggaccuaaagcu

SEQ ID NO: 77957 - RNA, 23 nt, Artificial Sequence
  Oligomer
guaugcaugugaaagaauaauua

SEQ ID NO: 77958 - RNA, 23 nt, Artificial Sequence
  Oligomer
uguaugcaugugaaagaauaauu

SEQ ID NO: 77959 - RNA, 23 nt, Artificial Sequence
  Oligomer
acgacccaacauccagacacagg

SEQ ID NO: 77960 - RNA, 23 nt, Artificial Sequence
  Oligomer
aacgacccaacauccagacacag

SEQ ID NO: 77961 - RNA, 23 nt, Artificial Sequence
  Oligomer
uaacgacccaacauccagacaca

SEQ ID NO: 77962 - RNA, 23 nt, Artificial Sequence
  Oligomer
auuagguucuggcgauuucaaca

SEQ ID NO: 77963 - RNA, 23 nt, Artificial Sequence
  Oligomer
caaagaacuccaccaggaauucc

SEQ ID NO: 77964 - RNA, 23 nt, Artificial Sequence
  Oligomer
ccaaagaacuccaccaggaauuc

SEQ ID NO: 77965 - RNA, 23 nt, Artificial Sequence
  Oligomer
uccaaagaacuccaccaggaauu

SEQ ID NO: 77966 - RNA, 23 nt, Artificial Sequence
  Oligomer
uuccaaagaacuccaccaggaau

SEQ ID NO: 77967 - RNA, 23 nt, Artificial Sequence
  Oligomer
auuccaaagaacuccaccaggaa

SEQ ID NO: 77968 - RNA, 23 nt, Artificial Sequence
  Oligomer
gguguucauuucuauuacaacaa

SEQ ID NO: 77969 - RNA, 23 nt, Artificial Sequence
  Oligomer
gcuuuagucuugaucaugaccuc

SEQ ID NO: 77970 - RNA, 23 nt, Artificial Sequence
  Oligomer
cuuuacacugggacgaaaauacu

SEQ ID NO: 77971 - RNA, 23 nt, Artificial Sequence
  Oligomer
aagaaguugucauuaccaaggug

SEQ ID NO: 77972 - RNA, 23 nt, Artificial Sequence
  Oligomer
gugaacaguacacuauaccauac

SEQ ID NO: 77973 - RNA, 23 nt, Artificial Sequence
  Oligomer
cauacuuccuuagcuuauaaaua

SEQ ID NO: 77974 - RNA, 23 nt, Artificial Sequence
  Oligomer
aggugagggagaagaaauuuccu

SEQ ID NO: 77975 - RNA, 23 nt, Artificial Sequence
  Oligomer
ccuuacuaacgacccaacaucca

SEQ ID NO: 77976 - RNA, 23 nt, Artificial Sequence
  Oligomer
gauuugccgggaugcaagagcuu

SEQ ID NO: 77977 - RNA, 23 nt, Artificial Sequence
  Oligomer
ggauuugccgggaugcaagagcu

SEQ ID NO: 77978 - RNA, 23 nt, Artificial Sequence
  Oligomer
uggauuugccgggaugcaagagc

SEQ ID NO: 77979 - RNA, 23 nt, Artificial Sequence
  Oligomer
cuggauuugccgggaugcaagag

SEQ ID NO: 77980 - RNA, 23 nt, Artificial Sequence
  Oligomer
acuggauuugccgggaugcaaga

SEQ ID NO: 77981 - RNA, 23 nt, Artificial Sequence
  Oligomer
aguuauuuuggguucaacacugg

SEQ ID NO: 77982 - RNA, 23 nt, Artificial Sequence
  Oligomer
uguucgaggccaaacccaagaca

SEQ ID NO: 77983 - RNA, 23 nt, Artificial Sequence
  Oligomer
uuguucgaggccaaacccaagac

SEQ ID NO: 77984 - RNA, 23 nt, Artificial Sequence
  Oligomer
auuguucgaggccaaacccaaga

SEQ ID NO: 77985 - RNA, 23 nt, Artificial Sequence
  Oligomer
gauuguucgaggccaaacccaag

SEQ ID NO: 77986 - RNA, 23 nt, Artificial Sequence
  Oligomer
ccuaugaguuguucugguacaca

SEQ ID NO: 77987 - RNA, 23 nt, Artificial Sequence
  Oligomer
uccagacacaggugagggagaag

SEQ ID NO: 77988 - RNA, 23 nt, Artificial Sequence
  Oligomer
auccagacacaggugagggagaa

SEQ ID NO: 77989 - RNA, 23 nt, Artificial Sequence
  Oligomer
aaaaagcguggcuuuaaaauggc

SEQ ID NO: 77990 - RNA, 23 nt, Artificial Sequence
  Oligomer
ucuguagagaccgcuaugcagaa

SEQ ID NO: 77991 - RNA, 23 nt, Artificial Sequence
  Oligomer
aguuguucugguacacacaccau

SEQ ID NO: 77992 - RNA, 23 nt, Artificial Sequence
  Oligomer
cuuuggaacugcccugacagaug

SEQ ID NO: 77993 - RNA, 23 nt, Artificial Sequence
  Oligomer
ccuuuggaacugcccugacagau

SEQ ID NO: 77994 - RNA, 23 nt, Artificial Sequence
  Oligomer
cccuuuggaacugcccugacaga

SEQ ID NO: 77995 - RNA, 23 nt, Artificial Sequence
  Oligomer
gcccuuuggaacugcccugacag

SEQ ID NO: 77996 - RNA, 23 nt, Artificial Sequence
  Oligomer
ggcccuuuggaacugcccugaca

SEQ ID NO: 77997 - RNA, 23 nt, Artificial Sequence
  Oligomer
aaauuuccugacagccgaagagc

SEQ ID NO: 77998 - RNA, 23 nt, Artificial Sequence
  Oligomer
acuggucgccuaugggauagcug

SEQ ID NO: 77999 - RNA, 23 nt, Artificial Sequence
  Oligomer
aacuggucgccuaugggauagcu

SEQ ID NO: 78000 - RNA, 23 nt, Artificial Sequence
  Oligomer
aaacuggucgccuaugggauagc

SEQ ID NO: 78001 - RNA, 23 nt, Artificial Sequence
  Oligomer
caaacuggucgccuaugggauag

SEQ ID NO: 78002 - RNA, 23 nt, Artificial Sequence
  Oligomer
acaaacuggucgccuaugggaua

SEQ ID NO: 78003 - RNA, 23 nt, Artificial Sequence
  Oligomer
ccugugacggccuguugauauga

SEQ ID NO: 78004 - RNA, 23 nt, Artificial Sequence
  Oligomer
uccugugacggccuguugauaug

SEQ ID NO: 78005 - RNA, 23 nt, Artificial Sequence
  Oligomer
uuccugugacggccuguugauau

SEQ ID NO: 78006 - RNA, 23 nt, Artificial Sequence
  Oligomer
auuccugugacggccuguugaua

SEQ ID NO: 78007 - RNA, 23 nt, Artificial Sequence
  Oligomer
aauuagguucuggcgauuucaac

SEQ ID NO: 78008 - RNA, 23 nt, Artificial Sequence
  Oligomer
uaauuagguucuggcgauuucaa

SEQ ID NO: 78009 - RNA, 23 nt, Artificial Sequence
  Oligomer
caaacacaaccacugaauugcua

SEQ ID NO: 78010 - RNA, 23 nt, Artificial Sequence
  Oligomer
ccauuacacacgaguuauuuugg

SEQ ID NO: 78011 - RNA, 23 nt, Artificial Sequence
  Oligomer
caaggagagcuucuagacuuugg

SEQ ID NO: 78012 - RNA, 23 nt, Artificial Sequence
  Oligomer
acaaggagagcuucuagacuuug

SEQ ID NO: 78013 - RNA, 23 nt, Artificial Sequence
  Oligomer
aacaaggagagcuucuagacuuu

SEQ ID NO: 78014 - RNA, 23 nt, Artificial Sequence
  Oligomer
gcacaacaucaccuucuguagag

SEQ ID NO: 78015 - RNA, 23 nt, Artificial Sequence
  Oligomer
uuuuaacugcaugcuaauucuaa

SEQ ID NO: 78016 - RNA, 23 nt, Artificial Sequence
  Oligomer
gauuccaaagaacuccaccagga

SEQ ID NO: 78017 - RNA, 23 nt, Artificial Sequence
  Oligomer
uucuauuacaacaaggagagcuu

SEQ ID NO: 78018 - RNA, 23 nt, Artificial Sequence
  Oligomer
uuucuauuacaacaaggagagcu

SEQ ID NO: 78019 - RNA, 23 nt, Artificial Sequence
  Oligomer
auuucuauuacaacaaggagagc

SEQ ID NO: 78020 - RNA, 23 nt, Artificial Sequence
  Oligomer
cauuucuauuacaacaaggagag

SEQ ID NO: 78021 - RNA, 23 nt, Artificial Sequence
  Oligomer
ucauuucuauuacaacaaggaga

SEQ ID NO: 78022 - RNA, 23 nt, Artificial Sequence
  Oligomer
uucuguagagaccgcuaugcaga

SEQ ID NO: 78023 - RNA, 23 nt, Artificial Sequence
  Oligomer
gaaaucuauaugguacaaaugca

SEQ ID NO: 78024 - RNA, 23 nt, Artificial Sequence
  Oligomer
caaaaaccucagauuucacaaac

SEQ ID NO: 78025 - RNA, 23 nt, Artificial Sequence
  Oligomer
gaaaauacugacgugauuacagg

SEQ ID NO: 78026 - RNA, 23 nt, Artificial Sequence
  Oligomer
caauuuucuggcaaggaacccuc

SEQ ID NO: 78027 - RNA, 23 nt, Artificial Sequence
  Oligomer
gaucaugaccucgucaacugagu

SEQ ID NO: 78028 - RNA, 23 nt, Artificial Sequence
  Oligomer
ugaucaugaccucgucaacugag

SEQ ID NO: 78029 - RNA, 23 nt, Artificial Sequence
  Oligomer
uucauuucuauuacaacaaggag

SEQ ID NO: 78030 - RNA, 23 nt, Artificial Sequence
  Oligomer
guucauuucuauuacaacaagga

SEQ ID NO: 78031 - RNA, 23 nt, Artificial Sequence
  Oligomer
uguucauuucuauuacaacaagg

SEQ ID NO: 78032 - RNA, 23 nt, Artificial Sequence
  Oligomer
ccauauuaguacucucauggcug

SEQ ID NO: 78033 - RNA, 23 nt, Artificial Sequence
  Oligomer
ucuuaccggcugggaugaaaauc

SEQ ID NO: 78034 - RNA, 23 nt, Artificial Sequence
  Oligomer
uucuuaccggcugggaugaaaau

SEQ ID NO: 78035 - RNA, 23 nt, Artificial Sequence
  Oligomer
uuucuuaccggcugggaugaaaa

SEQ ID NO: 78036 - RNA, 23 nt, Artificial Sequence
  Oligomer
auuucuuaccggcugggaugaaa

SEQ ID NO: 78037 - RNA, 23 nt, Artificial Sequence
  Oligomer
ucucucucugcacaacaucaccu

SEQ ID NO: 78038 - RNA, 23 nt, Artificial Sequence
  Oligomer
gaguucaagcagauugccuacaa

SEQ ID NO: 78039 - RNA, 23 nt, Artificial Sequence
  Oligomer
ugaguucaagcagauugccuaca

SEQ ID NO: 78040 - RNA, 23 nt, Artificial Sequence
  Oligomer
augaguucaagcagauugccuac

SEQ ID NO: 78041 - RNA, 23 nt, Artificial Sequence
  Oligomer
aaugaguucaagcagauugccua

SEQ ID NO: 78042 - RNA, 23 nt, Artificial Sequence
  Oligomer
cagugcccagccauaucuucgcu

SEQ ID NO: 78043 - RNA, 23 nt, Artificial Sequence
  Oligomer
gcagugcccagccauaucuucgc

SEQ ID NO: 78044 - RNA, 23 nt, Artificial Sequence
  Oligomer
ugcagugcccagccauaucuucg

SEQ ID NO: 78045 - RNA, 23 nt, Artificial Sequence
  Oligomer
gugcagugcccagccauaucuuc

SEQ ID NO: 78046 - RNA, 23 nt, Artificial Sequence
  Oligomer
ggugcagugcccagccauaucuu

SEQ ID NO: 78047 - RNA, 23 nt, Artificial Sequence
  Oligomer
agaaguugucauuaccaaggugg

SEQ ID NO: 78048 - RNA, 23 nt, Artificial Sequence
  Oligomer
caacaaggagagcuucuagacuu

SEQ ID NO: 78049 - RNA, 23 nt, Artificial Sequence
  Oligomer
cauauauuucuuaccggcuggga

SEQ ID NO: 78050 - RNA, 23 nt, Artificial Sequence
  Oligomer
ucauauauuucuuaccggcuggg

SEQ ID NO: 78051 - RNA, 23 nt, Artificial Sequence
  Oligomer
aucauauauuucuuaccggcugg

SEQ ID NO: 78052 - RNA, 23 nt, Artificial Sequence
  Oligomer
uaucauauauuucuuaccggcug

SEQ ID NO: 78053 - RNA, 23 nt, Artificial Sequence
  Oligomer
uuaucauauauuucuuaccggcu

SEQ ID NO: 78054 - RNA, 23 nt, Artificial Sequence
  Oligomer
acacugggacgaaaauacugacg

SEQ ID NO: 78055 - RNA, 23 nt, Artificial Sequence
  Oligomer
uacacugggacgaaaauacugac

SEQ ID NO: 78056 - RNA, 23 nt, Artificial Sequence
  Oligomer
uuacacugggacgaaaauacuga

SEQ ID NO: 78057 - RNA, 23 nt, Artificial Sequence
  Oligomer
uacuggauuugccgggaugcaag

SEQ ID NO: 78058 - RNA, 23 nt, Artificial Sequence
  Oligomer
ggugagggagaagaaauuuccug

SEQ ID NO: 78059 - RNA, 23 nt, Artificial Sequence
  Oligomer
guuaaugcaaccauccacaucgu

SEQ ID NO: 78060 - RNA, 23 nt, Artificial Sequence
  Oligomer
uguuaaugcaaccauccacaucg

SEQ ID NO: 78061 - RNA, 23 nt, Artificial Sequence
  Oligomer
cuguuaaugcaaccauccacauc

SEQ ID NO: 78062 - RNA, 23 nt, Artificial Sequence
  Oligomer
gcuguuaaugcaaccauccacau

SEQ ID NO: 78063 - RNA, 23 nt, Artificial Sequence
  Oligomer
cuuacuaacgacccaacauccag

SEQ ID NO: 78064 - RNA, 23 nt, Artificial Sequence
  Oligomer
cagcagcaguauuggcguguucu

SEQ ID NO: 78065 - RNA, 23 nt, Artificial Sequence
  Oligomer
ccagcagcaguauuggcguguuc

SEQ ID NO: 78066 - RNA, 23 nt, Artificial Sequence
  Oligomer
cccagcagcaguauuggcguguu

SEQ ID NO: 78067 - RNA, 23 nt, Artificial Sequence
  Oligomer
auuuacuagggaagcccuuacua

SEQ ID NO: 78068 - RNA, 23 nt, Artificial Sequence
  Oligomer
uggaggucaaguccaggcauugu

SEQ ID NO: 78069 - RNA, 23 nt, Artificial Sequence
  Oligomer
uuggaggucaaguccaggcauug

SEQ ID NO: 78070 - RNA, 23 nt, Artificial Sequence
  Oligomer
uuuggaggucaaguccaggcauu

SEQ ID NO: 78071 - RNA, 23 nt, Artificial Sequence
  Oligomer
ugcccagccauaucuucgcugga

SEQ ID NO: 78072 - RNA, 23 nt, Artificial Sequence
  Oligomer
caucagacaggccuccuaugagu

SEQ ID NO: 78073 - RNA, 23 nt, Artificial Sequence
  Oligomer
aaguauuugcugcagaggaccgu

SEQ ID NO: 78074 - RNA, 23 nt, Artificial Sequence
  Oligomer
caaguauuugcugcagaggaccg

SEQ ID NO: 78075 - RNA, 23 nt, Artificial Sequence
  Oligomer
uuuacacugggacgaaaauacug

SEQ ID NO: 78076 - RNA, 23 nt, Artificial Sequence
  Oligomer
uggaaacacggaugagugagcag

SEQ ID NO: 78077 - RNA, 23 nt, Artificial Sequence
  Oligomer
cuggaaacacggaugagugagca

SEQ ID NO: 78078 - RNA, 23 nt, Artificial Sequence
  Oligomer
guguauuucuacuggauuugccg

SEQ ID NO: 78079 - RNA, 23 nt, Artificial Sequence
  Oligomer
aagcucucucgaggacacuucaa

SEQ ID NO: 78080 - RNA, 23 nt, Artificial Sequence
  Oligomer
aaagcucucucgaggacacuuca

SEQ ID NO: 78081 - RNA, 23 nt, Artificial Sequence
  Oligomer
uuggcguguucuucuguggaccu

SEQ ID NO: 78082 - RNA, 23 nt, Artificial Sequence
  Oligomer
auuggcguguucuucuguggacc

SEQ ID NO: 78083 - RNA, 23 nt, Artificial Sequence
  Oligomer
uauuggcguguucuucuguggac

SEQ ID NO: 78084 - RNA, 23 nt, Artificial Sequence
  Oligomer
uggaacugcccugacagauguau

SEQ ID NO: 78085 - RNA, 23 nt, Artificial Sequence
  Oligomer
uuggaacugcccugacagaugua

SEQ ID NO: 78086 - RNA, 23 nt, Artificial Sequence
  Oligomer
uuuggaacugcccugacagaugu

SEQ ID NO: 78087 - RNA, 23 nt, Artificial Sequence
  Oligomer
gagcuucuagacuuuggagguca

SEQ ID NO: 78088 - RNA, 23 nt, Artificial Sequence
  Oligomer
cacaaacuggucgccuaugggau

SEQ ID NO: 78089 - RNA, 23 nt, Artificial Sequence
  Oligomer
ucgaggccaaacccaagacaguc

SEQ ID NO: 78090 - RNA, 23 nt, Artificial Sequence
  Oligomer
uucgaggccaaacccaagacagu

SEQ ID NO: 78091 - RNA, 23 nt, Artificial Sequence
  Oligomer
guugauaugagcucccaguuggg

SEQ ID NO: 78092 - RNA, 23 nt, Artificial Sequence
  Oligomer
uguugauaugagcucccaguugg

SEQ ID NO: 78093 - RNA, 23 nt, Artificial Sequence
  Oligomer
ccaccaggaauuccugugacggc

SEQ ID NO: 78094 - RNA, 23 nt, Artificial Sequence
  Oligomer
uccaccaggaauuccugugacgg

SEQ ID NO: 78095 - RNA, 23 nt, Artificial Sequence
  Oligomer
acuccaccaggaauuccugugac

SEQ ID NO: 78096 - RNA, 23 nt, Artificial Sequence
  Oligomer
aacuccaccaggaauuccuguga

SEQ ID NO: 78097 - RNA, 23 nt, Artificial Sequence
  Oligomer
aaauacugacgugauuacaggcu

SEQ ID NO: 78098 - RNA, 23 nt, Artificial Sequence
  Oligomer
aaaauacugacgugauuacaggc

SEQ ID NO: 78099 - RNA, 23 nt, Artificial Sequence
  Oligomer
ucuauuacaacaaggagagcuuc

SEQ ID NO: 78100 - RNA, 23 nt, Artificial Sequence
  Oligomer
ugguacaaaugcagugaggcaca

SEQ ID NO: 78101 - RNA, 23 nt, Artificial Sequence
  Oligomer
augguacaaaugcagugaggcac

SEQ ID NO: 78102 - RNA, 23 nt, Artificial Sequence
  Oligomer
uaugguacaaaugcagugaggca

SEQ ID NO: 78103 - RNA, 23 nt, Artificial Sequence
  Oligomer
aguauuugcugcagaggaccgug

SEQ ID NO: 78104 - RNA, 23 nt, Artificial Sequence
  Oligomer
auuuuaacugcaugcuaauucua

SEQ ID NO: 78105 - RNA, 23 nt, Artificial Sequence
  Oligomer
acuuuuucagcgugcacauccgg

SEQ ID NO: 78106 - RNA, 23 nt, Artificial Sequence
  Oligomer
cagacaggccuccuaugaguugu

SEQ ID NO: 78107 - RNA, 23 nt, Artificial Sequence
  Oligomer
ucagacaggccuccuaugaguug

SEQ ID NO: 78108 - RNA, 23 nt, Artificial Sequence
  Oligomer
aucagacaggccuccuaugaguu

SEQ ID NO: 78109 - RNA, 23 nt, Artificial Sequence
  Oligomer
uaaggacaauagcaggcgucacc

SEQ ID NO: 78110 - RNA, 23 nt, Artificial Sequence
  Oligomer
cuaaggacaauagcaggcgucac

SEQ ID NO: 78111 - RNA, 23 nt, Artificial Sequence
  Oligomer
gcuaaggacaauagcaggcguca

SEQ ID NO: 78112 - RNA, 23 nt, Artificial Sequence
  Oligomer
ugcuaaggacaauagcaggcguc

SEQ ID NO: 78113 - RNA, 23 nt, Artificial Sequence
  Oligomer
uugcuaaggacaauagcaggcgu

SEQ ID NO: 78114 - RNA, 23 nt, Artificial Sequence
  Oligomer
uauuucuuaccggcugggaugaa

SEQ ID NO: 78115 - RNA, 23 nt, Artificial Sequence
  Oligomer
cuaacgacccaacauccagacac

SEQ ID NO: 78116 - RNA, 23 nt, Artificial Sequence
  Oligomer
acuaacgacccaacauccagaca

SEQ ID NO: 78117 - RNA, 23 nt, Artificial Sequence
  Oligomer
uacuaacgacccaacauccagac

SEQ ID NO: 78118 - RNA, 23 nt, Artificial Sequence
  Oligomer
uuacuaacgacccaacauccaga

SEQ ID NO: 78119 - RNA, 23 nt, Artificial Sequence
  Oligomer
cauuacacacgaguuauuuuggg

SEQ ID NO: 78120 - RNA, 23 nt, Artificial Sequence
  Oligomer
cuuuggaggucaaguccaggcau

SEQ ID NO: 78121 - RNA, 23 nt, Artificial Sequence
  Oligomer
acuuuggaggucaaguccaggca

SEQ ID NO: 78122 - RNA, 23 nt, Artificial Sequence
  Oligomer
gacuuuggaggucaaguccaggc

SEQ ID NO: 78123 - RNA, 23 nt, Artificial Sequence
  Oligomer
auauuucuuaccggcugggauga

SEQ ID NO: 78124 - RNA, 23 nt, Artificial Sequence
  Oligomer
uauauuucuuaccggcugggaug

SEQ ID NO: 78125 - RNA, 23 nt, Artificial Sequence
  Oligomer
auauauuucuuaccggcugggau

SEQ ID NO: 78126 - RNA, 23 nt, Artificial Sequence
  Oligomer
guuaucauauauuucuuaccggc

SEQ ID NO: 78127 - RNA, 23 nt, Artificial Sequence
  Oligomer
auuuccugacagccgaagagcaa

SEQ ID NO: 78128 - RNA, 23 nt, Artificial Sequence
  Oligomer
aauuuccugacagccgaagagca

SEQ ID NO: 78129 - RNA, 23 nt, Artificial Sequence
  Oligomer
cuggucgccuaugggauagcugu

SEQ ID NO: 78130 - RNA, 23 nt, Artificial Sequence
  Oligomer
aaaugcagugaggcacagacccc

SEQ ID NO: 78131 - RNA, 23 nt, Artificial Sequence
  Oligomer
aguacaucuuggugcagugccca

SEQ ID NO: 78132 - RNA, 23 nt, Artificial Sequence
  Oligomer
uuguucugguacacacaccaugu

SEQ ID NO: 78133 - RNA, 23 nt, Artificial Sequence
  Oligomer
guuguucugguacacacaccaug

SEQ ID NO: 78134 - RNA, 23 nt, Artificial Sequence
  Oligomer
uaauucuaauaccugucagucga

SEQ ID NO: 78135 - RNA, 23 nt, Artificial Sequence
  Oligomer
auuaacuauugugaacaguacac

SEQ ID NO: 78136 - RNA, 23 nt, Artificial Sequence
  Oligomer
aauuaacuauugugaacaguaca

SEQ ID NO: 78137 - RNA, 23 nt, Artificial Sequence
  Oligomer
uaugcagaauggcagacaguggc

SEQ ID NO: 78138 - RNA, 23 nt, Artificial Sequence
  Oligomer
augagcucccaguugggaacugg

SEQ ID NO: 78139 - RNA, 23 nt, Artificial Sequence
  Oligomer
uaugagcucccaguugggaacug

SEQ ID NO: 78140 - RNA, 23 nt, Artificial Sequence
  Oligomer
auaugagcucccaguugggaacu

SEQ ID NO: 78141 - RNA, 23 nt, Artificial Sequence
  Oligomer
gauaugagcucccaguugggaac

SEQ ID NO: 78142 - RNA, 23 nt, Artificial Sequence
  Oligomer
ugauaugagcucccaguugggaa

SEQ ID NO: 78143 - RNA, 23 nt, Artificial Sequence
  Oligomer
gcuaugugaagagccugauuuuc

SEQ ID NO: 78144 - RNA, 23 nt, Artificial Sequence
  Oligomer
cuaugugaagagccugauuuuca

SEQ ID NO: 78145 - RNA, 23 nt, Artificial Sequence
  Oligomer
uaugugaagagccugauuuucau

SEQ ID NO: 78146 - RNA, 23 nt, Artificial Sequence
  Oligomer
uuugucuaauugccuccuccacg

SEQ ID NO: 78147 - RNA, 23 nt, Artificial Sequence
  Oligomer
uugucuaauugccuccuccacgg

SEQ ID NO: 78148 - RNA, 23 nt, Artificial Sequence
  Oligomer
uuaauuauuauucaccaguuccc

SEQ ID NO: 78149 - RNA, 23 nt, Artificial Sequence
  Oligomer
uaauuauuauucaccaguuccca

SEQ ID NO: 78150 - RNA, 23 nt, Artificial Sequence
  Oligomer
aauuauuauucaccaguucccaa

SEQ ID NO: 78151 - RNA, 23 nt, Artificial Sequence
  Oligomer
auuauuauucaccaguucccaac

SEQ ID NO: 78152 - RNA, 23 nt, Artificial Sequence
  Oligomer
uuauuauucaccaguucccaacu

SEQ ID NO: 78153 - RNA, 23 nt, Artificial Sequence
  Oligomer
augugaagagccugauuuucauc

SEQ ID NO: 78154 - RNA, 23 nt, Artificial Sequence
  Oligomer
guuaauuauuauucaccaguucc

SEQ ID NO: 78155 - RNA, 23 nt, Artificial Sequence
  Oligomer
guauuuucgucccaguguaaagc

SEQ ID NO: 78156 - RNA, 23 nt, Artificial Sequence
  Oligomer
cuguaaucacgucaguauuuucg

SEQ ID NO: 78157 - RNA, 23 nt, Artificial Sequence
  Oligomer
gagcuuuagguccacagaagaac

SEQ ID NO: 78158 - RNA, 23 nt, Artificial Sequence
  Oligomer
agcuuuagguccacagaagaaca

SEQ ID NO: 78159 - RNA, 23 nt, Artificial Sequence
  Oligomer
uaauuauucuuucacaugcauac

SEQ ID NO: 78160 - RNA, 23 nt, Artificial Sequence
  Oligomer
aauuauucuuucacaugcauaca

SEQ ID NO: 78161 - RNA, 23 nt, Artificial Sequence
  Oligomer
ccugugucuggauguugggucgu

SEQ ID NO: 78162 - RNA, 23 nt, Artificial Sequence
  Oligomer
cugugucuggauguugggucguu

SEQ ID NO: 78163 - RNA, 23 nt, Artificial Sequence
  Oligomer
ugugucuggauguugggucguua

SEQ ID NO: 78164 - RNA, 23 nt, Artificial Sequence
  Oligomer
uguugaaaucgccagaaccuaau

SEQ ID NO: 78165 - RNA, 23 nt, Artificial Sequence
  Oligomer
ggaauuccugguggaguucuuug

SEQ ID NO: 78166 - RNA, 23 nt, Artificial Sequence
  Oligomer
gaauuccugguggaguucuuugg

SEQ ID NO: 78167 - RNA, 23 nt, Artificial Sequence
  Oligomer
aauuccugguggaguucuuugga

SEQ ID NO: 78168 - RNA, 23 nt, Artificial Sequence
  Oligomer
auuccugguggaguucuuuggaa

SEQ ID NO: 78169 - RNA, 23 nt, Artificial Sequence
  Oligomer
uuccugguggaguucuuuggaau

SEQ ID NO: 78170 - RNA, 23 nt, Artificial Sequence
  Oligomer
uuguuguaauagaaaugaacacc

SEQ ID NO: 78171 - RNA, 23 nt, Artificial Sequence
  Oligomer
gaggucaugaucaagacuaaagc

SEQ ID NO: 78172 - RNA, 23 nt, Artificial Sequence
  Oligomer
aguauuuucgucccaguguaaag

SEQ ID NO: 78173 - RNA, 23 nt, Artificial Sequence
  Oligomer
caccuugguaaugacaacuucuu

SEQ ID NO: 78174 - RNA, 23 nt, Artificial Sequence
  Oligomer
guaugguauaguguacuguucac

SEQ ID NO: 78175 - RNA, 23 nt, Artificial Sequence
  Oligomer
uauuuauaagcuaaggaaguaug

SEQ ID NO: 78176 - RNA, 23 nt, Artificial Sequence
  Oligomer
aggaaauuucuucucccucaccu

SEQ ID NO: 78177 - RNA, 23 nt, Artificial Sequence
  Oligomer
uggauguugggucguuaguaagg

SEQ ID NO: 78178 - RNA, 23 nt, Artificial Sequence
  Oligomer
aagcucuugcaucccggcaaauc

SEQ ID NO: 78179 - RNA, 23 nt, Artificial Sequence
  Oligomer
agcucuugcaucccggcaaaucc

SEQ ID NO: 78180 - RNA, 23 nt, Artificial Sequence
  Oligomer
gcucuugcaucccggcaaaucca

SEQ ID NO: 78181 - RNA, 23 nt, Artificial Sequence
  Oligomer
cucuugcaucccggcaaauccag

SEQ ID NO: 78182 - RNA, 23 nt, Artificial Sequence
  Oligomer
ucuugcaucccggcaaauccagu

SEQ ID NO: 78183 - RNA, 23 nt, Artificial Sequence
  Oligomer
ccaguguugaacccaaaauaacu

SEQ ID NO: 78184 - RNA, 23 nt, Artificial Sequence
  Oligomer
ugucuuggguuuggccucgaaca

SEQ ID NO: 78185 - RNA, 23 nt, Artificial Sequence
  Oligomer
gucuuggguuuggccucgaacaa

SEQ ID NO: 78186 - RNA, 23 nt, Artificial Sequence
  Oligomer
ucuuggguuuggccucgaacaau

SEQ ID NO: 78187 - RNA, 23 nt, Artificial Sequence
  Oligomer
cuuggguuuggccucgaacaauc

SEQ ID NO: 78188 - RNA, 23 nt, Artificial Sequence
  Oligomer
uguguaccagaacaacucauagg

SEQ ID NO: 78189 - RNA, 23 nt, Artificial Sequence
  Oligomer
cuucucccucaccugugucugga

SEQ ID NO: 78190 - RNA, 23 nt, Artificial Sequence
  Oligomer
uucucccucaccugugucuggau

SEQ ID NO: 78191 - RNA, 23 nt, Artificial Sequence
  Oligomer
gccauuuuaaagccacgcuuuuu

SEQ ID NO: 78192 - RNA, 23 nt, Artificial Sequence
  Oligomer
uucugcauagcggucucuacaga

SEQ ID NO: 78193 - RNA, 23 nt, Artificial Sequence
  Oligomer
augguguguguaccagaacaacu

SEQ ID NO: 78194 - RNA, 23 nt, Artificial Sequence
  Oligomer
caucugucagggcaguuccaaag

SEQ ID NO: 78195 - RNA, 23 nt, Artificial Sequence
  Oligomer
aucugucagggcaguuccaaagg

SEQ ID NO: 78196 - RNA, 23 nt, Artificial Sequence
  Oligomer
ucugucagggcaguuccaaaggg

SEQ ID NO: 78197 - RNA, 23 nt, Artificial Sequence
  Oligomer
cugucagggcaguuccaaagggc

SEQ ID NO: 78198 - RNA, 23 nt, Artificial Sequence
  Oligomer
ugucagggcaguuccaaagggcc

SEQ ID NO: 78199 - RNA, 23 nt, Artificial Sequence
  Oligomer
gcucuucggcugucaggaaauuu

SEQ ID NO: 78200 - RNA, 23 nt, Artificial Sequence
  Oligomer
cagcuaucccauaggcgaccagu

SEQ ID NO: 78201 - RNA, 23 nt, Artificial Sequence
  Oligomer
agcuaucccauaggcgaccaguu

SEQ ID NO: 78202 - RNA, 23 nt, Artificial Sequence
  Oligomer
gcuaucccauaggcgaccaguuu

SEQ ID NO: 78203 - RNA, 23 nt, Artificial Sequence
  Oligomer
cuaucccauaggcgaccaguuug

SEQ ID NO: 78204 - RNA, 23 nt, Artificial Sequence
  Oligomer
uaucccauaggcgaccaguuugu

SEQ ID NO: 78205 - RNA, 23 nt, Artificial Sequence
  Oligomer
ucauaucaacaggccgucacagg

SEQ ID NO: 78206 - RNA, 23 nt, Artificial Sequence
  Oligomer
cauaucaacaggccgucacagga

SEQ ID NO: 78207 - RNA, 23 nt, Artificial Sequence
  Oligomer
auaucaacaggccgucacaggaa

SEQ ID NO: 78208 - RNA, 23 nt, Artificial Sequence
  Oligomer
uaucaacaggccgucacaggaau

SEQ ID NO: 78209 - RNA, 23 nt, Artificial Sequence
  Oligomer
guugaaaucgccagaaccuaauu

SEQ ID NO: 78210 - RNA, 23 nt, Artificial Sequence
  Oligomer
uugaaaucgccagaaccuaauua

SEQ ID NO: 78211 - RNA, 23 nt, Artificial Sequence
  Oligomer
uagcaauucagugguuguguuug

SEQ ID NO: 78212 - RNA, 23 nt, Artificial Sequence
  Oligomer
ccaaaauaacucguguguaaugg

SEQ ID NO: 78213 - RNA, 23 nt, Artificial Sequence
  Oligomer
ccaaagucuagaagcucuccuug

SEQ ID NO: 78214 - RNA, 23 nt, Artificial Sequence
  Oligomer
caaagucuagaagcucuccuugu

SEQ ID NO: 78215 - RNA, 23 nt, Artificial Sequence
  Oligomer
aaagucuagaagcucuccuuguu

SEQ ID NO: 78216 - RNA, 23 nt, Artificial Sequence
  Oligomer
cucuacagaaggugauguugugc

SEQ ID NO: 78217 - RNA, 23 nt, Artificial Sequence
  Oligomer
uuagaauuagcaugcaguuaaaa

SEQ ID NO: 78218 - RNA, 23 nt, Artificial Sequence
  Oligomer
uccugguggaguucuuuggaauc

SEQ ID NO: 78219 - RNA, 23 nt, Artificial Sequence
  Oligomer
aagcucuccuuguuguaauagaa

SEQ ID NO: 78220 - RNA, 23 nt, Artificial Sequence
  Oligomer
agcucuccuuguuguaauagaaa

SEQ ID NO: 78221 - RNA, 23 nt, Artificial Sequence
  Oligomer
gcucuccuuguuguaauagaaau

SEQ ID NO: 78222 - RNA, 23 nt, Artificial Sequence
  Oligomer
cucuccuuguuguaauagaaaug

SEQ ID NO: 78223 - RNA, 23 nt, Artificial Sequence
  Oligomer
ucuccuuguuguaauagaaauga

SEQ ID NO: 78224 - RNA, 23 nt, Artificial Sequence
  Oligomer
ucugcauagcggucucuacagaa

SEQ ID NO: 78225 - RNA, 23 nt, Artificial Sequence
  Oligomer
ugcauuuguaccauauagauuuc

SEQ ID NO: 78226 - RNA, 23 nt, Artificial Sequence
  Oligomer
guuugugaaaucugagguuuuug

SEQ ID NO: 78227 - RNA, 23 nt, Artificial Sequence
  Oligomer
ccuguaaucacgucaguauuuuc

SEQ ID NO: 78228 - RNA, 23 nt, Artificial Sequence
  Oligomer
gaggguuccuugccagaaaauug

SEQ ID NO: 78229 - RNA, 23 nt, Artificial Sequence
  Oligomer
acucaguugacgaggucaugauc

SEQ ID NO: 78230 - RNA, 23 nt, Artificial Sequence
  Oligomer
cucaguugacgaggucaugauca

SEQ ID NO: 78231 - RNA, 23 nt, Artificial Sequence
  Oligomer
cuccuuguuguaauagaaaugaa

SEQ ID NO: 78232 - RNA, 23 nt, Artificial Sequence
  Oligomer
uccuuguuguaauagaaaugaac

SEQ ID NO: 78233 - RNA, 23 nt, Artificial Sequence
  Oligomer
ccuuguuguaauagaaaugaaca

SEQ ID NO: 78234 - RNA, 23 nt, Artificial Sequence
  Oligomer
cagccaugagaguacuaauaugg

SEQ ID NO: 78235 - RNA, 23 nt, Artificial Sequence
  Oligomer
gauuuucaucccagccgguaaga

SEQ ID NO: 78236 - RNA, 23 nt, Artificial Sequence
  Oligomer
auuuucaucccagccgguaagaa

SEQ ID NO: 78237 - RNA, 23 nt, Artificial Sequence
  Oligomer
uuuucaucccagccgguaagaaa

SEQ ID NO: 78238 - RNA, 23 nt, Artificial Sequence
  Oligomer
uuucaucccagccgguaagaaau

SEQ ID NO: 78239 - RNA, 23 nt, Artificial Sequence
  Oligomer
aggugauguugugcagagagaga

SEQ ID NO: 78240 - RNA, 23 nt, Artificial Sequence
  Oligomer
uuguaggcaaucugcuugaacuc

SEQ ID NO: 78241 - RNA, 23 nt, Artificial Sequence
  Oligomer
uguaggcaaucugcuugaacuca

SEQ ID NO: 78242 - RNA, 23 nt, Artificial Sequence
  Oligomer
guaggcaaucugcuugaacucau

SEQ ID NO: 78243 - RNA, 23 nt, Artificial Sequence
  Oligomer
uaggcaaucugcuugaacucauu

SEQ ID NO: 78244 - RNA, 23 nt, Artificial Sequence
  Oligomer
agcgaagauauggcugggcacug

SEQ ID NO: 78245 - RNA, 23 nt, Artificial Sequence
  Oligomer
gcgaagauauggcugggcacugc

SEQ ID NO: 78246 - RNA, 23 nt, Artificial Sequence
  Oligomer
cgaagauauggcugggcacugca

SEQ ID NO: 78247 - RNA, 23 nt, Artificial Sequence
  Oligomer
gaagauauggcugggcacugcac

SEQ ID NO: 78248 - RNA, 23 nt, Artificial Sequence
  Oligomer
aagauauggcugggcacugcacc

SEQ ID NO: 78249 - RNA, 23 nt, Artificial Sequence
  Oligomer
ccaccuugguaaugacaacuucu

SEQ ID NO: 78250 - RNA, 23 nt, Artificial Sequence
  Oligomer
aagucuagaagcucuccuuguug

SEQ ID NO: 78251 - RNA, 23 nt, Artificial Sequence
  Oligomer
ucccagccgguaagaaauauaug

SEQ ID NO: 78252 - RNA, 23 nt, Artificial Sequence
  Oligomer
cccagccgguaagaaauauauga

SEQ ID NO: 78253 - RNA, 23 nt, Artificial Sequence
  Oligomer
ccagccgguaagaaauauaugau

SEQ ID NO: 78254 - RNA, 23 nt, Artificial Sequence
  Oligomer
cagccgguaagaaauauaugaua

SEQ ID NO: 78255 - RNA, 23 nt, Artificial Sequence
  Oligomer
agccgguaagaaauauaugauaa

SEQ ID NO: 78256 - RNA, 23 nt, Artificial Sequence
  Oligomer
cgucaguauuuucgucccagugu

SEQ ID NO: 78257 - RNA, 23 nt, Artificial Sequence
  Oligomer
gucaguauuuucgucccagugua

SEQ ID NO: 78258 - RNA, 23 nt, Artificial Sequence
  Oligomer
ucaguauuuucgucccaguguaa

SEQ ID NO: 78259 - RNA, 23 nt, Artificial Sequence
  Oligomer
cuugcaucccggcaaauccagua

SEQ ID NO: 78260 - RNA, 23 nt, Artificial Sequence
  Oligomer
caggaaauuucuucucccucacc

SEQ ID NO: 78261 - RNA, 23 nt, Artificial Sequence
  Oligomer
acgauguggaugguugcauuaac

SEQ ID NO: 78262 - RNA, 23 nt, Artificial Sequence
  Oligomer
cgauguggaugguugcauuaaca

SEQ ID NO: 78263 - RNA, 23 nt, Artificial Sequence
  Oligomer
gauguggaugguugcauuaacag

SEQ ID NO: 78264 - RNA, 23 nt, Artificial Sequence
  Oligomer
auguggaugguugcauuaacagc

SEQ ID NO: 78265 - RNA, 23 nt, Artificial Sequence
  Oligomer
cuggauguugggucguuaguaag

SEQ ID NO: 78266 - RNA, 23 nt, Artificial Sequence
  Oligomer
agaacacgccaauacugcugcug

SEQ ID NO: 78267 - RNA, 23 nt, Artificial Sequence
  Oligomer
gaacacgccaauacugcugcugg

SEQ ID NO: 78268 - RNA, 23 nt, Artificial Sequence
  Oligomer
aacacgccaauacugcugcuggg

SEQ ID NO: 78269 - RNA, 23 nt, Artificial Sequence
  Oligomer
uaguaagggcuucccuaguaaau

SEQ ID NO: 78270 - RNA, 23 nt, Artificial Sequence
  Oligomer
acaaugccuggacuugaccucca

SEQ ID NO: 78271 - RNA, 23 nt, Artificial Sequence
  Oligomer
caaugccuggacuugaccuccaa

SEQ ID NO: 78272 - RNA, 23 nt, Artificial Sequence
  Oligomer
aaugccuggacuugaccuccaaa

SEQ ID NO: 78273 - RNA, 23 nt, Artificial Sequence
  Oligomer
uccagcgaagauauggcugggca

SEQ ID NO: 78274 - RNA, 23 nt, Artificial Sequence
  Oligomer
acucauaggaggccugucugaug

SEQ ID NO: 78275 - RNA, 23 nt, Artificial Sequence
  Oligomer
acgguccucugcagcaaauacuu

SEQ ID NO: 78276 - RNA, 23 nt, Artificial Sequence
  Oligomer
cgguccucugcagcaaauacuug

SEQ ID NO: 78277 - RNA, 23 nt, Artificial Sequence
  Oligomer
caguauuuucgucccaguguaaa

SEQ ID NO: 78278 - RNA, 23 nt, Artificial Sequence
  Oligomer
cugcucacucauccguguuucca

SEQ ID NO: 78279 - RNA, 23 nt, Artificial Sequence
  Oligomer
ugcucacucauccguguuuccag

SEQ ID NO: 78280 - RNA, 23 nt, Artificial Sequence
  Oligomer
cggcaaauccaguagaaauacac

SEQ ID NO: 78281 - RNA, 23 nt, Artificial Sequence
  Oligomer
uugaaguguccucgagagagcuu

SEQ ID NO: 78282 - RNA, 23 nt, Artificial Sequence
  Oligomer
ugaaguguccucgagagagcuuu

SEQ ID NO: 78283 - RNA, 23 nt, Artificial Sequence
  Oligomer
agguccacagaagaacacgccaa

SEQ ID NO: 78284 - RNA, 23 nt, Artificial Sequence
  Oligomer
gguccacagaagaacacgccaau

SEQ ID NO: 78285 - RNA, 23 nt, Artificial Sequence
  Oligomer
guccacagaagaacacgccaaua

SEQ ID NO: 78286 - RNA, 23 nt, Artificial Sequence
  Oligomer
auacaucugucagggcaguucca

SEQ ID NO: 78287 - RNA, 23 nt, Artificial Sequence
  Oligomer
uacaucugucagggcaguuccaa

SEQ ID NO: 78288 - RNA, 23 nt, Artificial Sequence
  Oligomer
acaucugucagggcaguuccaaa

SEQ ID NO: 78289 - RNA, 23 nt, Artificial Sequence
  Oligomer
ugaccuccaaagucuagaagcuc

SEQ ID NO: 78290 - RNA, 23 nt, Artificial Sequence
  Oligomer
aucccauaggcgaccaguuugug

SEQ ID NO: 78291 - RNA, 23 nt, Artificial Sequence
  Oligomer
gacugucuuggguuuggccucga

SEQ ID NO: 78292 - RNA, 23 nt, Artificial Sequence
  Oligomer
acugucuuggguuuggccucgaa

SEQ ID NO: 78293 - RNA, 23 nt, Artificial Sequence
  Oligomer
cccaacugggagcucauaucaac

SEQ ID NO: 78294 - RNA, 23 nt, Artificial Sequence
  Oligomer
ccaacugggagcucauaucaaca

SEQ ID NO: 78295 - RNA, 23 nt, Artificial Sequence
  Oligomer
gccgucacaggaauuccuggugg

SEQ ID NO: 78296 - RNA, 23 nt, Artificial Sequence
  Oligomer
ccgucacaggaauuccuggugga

SEQ ID NO: 78297 - RNA, 23 nt, Artificial Sequence
  Oligomer
gucacaggaauuccugguggagu

SEQ ID NO: 78298 - RNA, 23 nt, Artificial Sequence
  Oligomer
ucacaggaauuccugguggaguu

SEQ ID NO: 78299 - RNA, 23 nt, Artificial Sequence
  Oligomer
agccuguaaucacgucaguauuu

SEQ ID NO: 78300 - RNA, 23 nt, Artificial Sequence
  Oligomer
gccuguaaucacgucaguauuuu

SEQ ID NO: 78301 - RNA, 23 nt, Artificial Sequence
  Oligomer
gaagcucuccuuguuguaauaga

SEQ ID NO: 78302 - RNA, 23 nt, Artificial Sequence
  Oligomer
ugugccucacugcauuuguacca

SEQ ID NO: 78303 - RNA, 23 nt, Artificial Sequence
  Oligomer
gugccucacugcauuuguaccau

SEQ ID NO: 78304 - RNA, 23 nt, Artificial Sequence
  Oligomer
ugccucacugcauuuguaccaua

SEQ ID NO: 78305 - RNA, 23 nt, Artificial Sequence
  Oligomer
cacgguccucugcagcaaauacu

SEQ ID NO: 78306 - RNA, 23 nt, Artificial Sequence
  Oligomer
uagaauuagcaugcaguuaaaau

SEQ ID NO: 78307 - RNA, 23 nt, Artificial Sequence
  Oligomer
ccggaugugcacgcugaaaaagu

SEQ ID NO: 78308 - RNA, 23 nt, Artificial Sequence
  Oligomer
acaacucauaggaggccugucug

SEQ ID NO: 78309 - RNA, 23 nt, Artificial Sequence
  Oligomer
caacucauaggaggccugucuga

SEQ ID NO: 78310 - RNA, 23 nt, Artificial Sequence
  Oligomer
aacucauaggaggccugucugau

SEQ ID NO: 78311 - RNA, 23 nt, Artificial Sequence
  Oligomer
ggugacgccugcuauuguccuua

SEQ ID NO: 78312 - RNA, 23 nt, Artificial Sequence
  Oligomer
gugacgccugcuauuguccuuag

SEQ ID NO: 78313 - RNA, 23 nt, Artificial Sequence
  Oligomer
ugacgccugcuauuguccuuagc

SEQ ID NO: 78314 - RNA, 23 nt, Artificial Sequence
  Oligomer
gacgccugcuauuguccuuagca

SEQ ID NO: 78315 - RNA, 23 nt, Artificial Sequence
  Oligomer
acgccugcuauuguccuuagcaa

SEQ ID NO: 78316 - RNA, 23 nt, Artificial Sequence
  Oligomer
uucaucccagccgguaagaaaua

SEQ ID NO: 78317 - RNA, 23 nt, Artificial Sequence
  Oligomer
gugucuggauguugggucguuag

SEQ ID NO: 78318 - RNA, 23 nt, Artificial Sequence
  Oligomer
ugucuggauguugggucguuagu

SEQ ID NO: 78319 - RNA, 23 nt, Artificial Sequence
  Oligomer
gucuggauguugggucguuagua

SEQ ID NO: 78320 - RNA, 23 nt, Artificial Sequence
  Oligomer
ucuggauguugggucguuaguaa

SEQ ID NO: 78321 - RNA, 23 nt, Artificial Sequence
  Oligomer
cccaaaauaacucguguguaaug

SEQ ID NO: 78322 - RNA, 23 nt, Artificial Sequence
  Oligomer
augccuggacuugaccuccaaag

SEQ ID NO: 78323 - RNA, 23 nt, Artificial Sequence
  Oligomer
ugccuggacuugaccuccaaagu

SEQ ID NO: 78324 - RNA, 23 nt, Artificial Sequence
  Oligomer
gccuggacuugaccuccaaaguc

SEQ ID NO: 78325 - RNA, 23 nt, Artificial Sequence
  Oligomer
ucaucccagccgguaagaaauau

SEQ ID NO: 78326 - RNA, 23 nt, Artificial Sequence
  Oligomer
caucccagccgguaagaaauaua

SEQ ID NO: 78327 - RNA, 23 nt, Artificial Sequence
  Oligomer
aucccagccgguaagaaauauau

SEQ ID NO: 78328 - RNA, 23 nt, Artificial Sequence
  Oligomer
gccgguaagaaauauaugauaac

SEQ ID NO: 78329 - RNA, 23 nt, Artificial Sequence
  Oligomer
uugcucuucggcugucaggaaau

SEQ ID NO: 78330 - RNA, 23 nt, Artificial Sequence
  Oligomer
ugcucuucggcugucaggaaauu

SEQ ID NO: 78331 - RNA, 23 nt, Artificial Sequence
  Oligomer
acagcuaucccauaggcgaccag

SEQ ID NO: 78332 - RNA, 23 nt, Artificial Sequence
  Oligomer
ggggucugugccucacugcauuu

SEQ ID NO: 78333 - RNA, 23 nt, Artificial Sequence
  Oligomer
ugggcacugcaccaagauguacu

SEQ ID NO: 78334 - RNA, 23 nt, Artificial Sequence
  Oligomer
acaugguguguguaccagaacaa

SEQ ID NO: 78335 - RNA, 23 nt, Artificial Sequence
  Oligomer
caugguguguguaccagaacaac

SEQ ID NO: 78336 - RNA, 23 nt, Artificial Sequence
  Oligomer
ucgacugacagguauuagaauua

SEQ ID NO: 78337 - RNA, 23 nt, Artificial Sequence
  Oligomer
guguacuguucacaauaguuaau

SEQ ID NO: 78338 - RNA, 23 nt, Artificial Sequence
  Oligomer
uguacuguucacaauaguuaauu

SEQ ID NO: 78339 - RNA, 23 nt, Artificial Sequence
  Oligomer
gccacugucugccauucugcaua

SEQ ID NO: 78340 - RNA, 23 nt, Artificial Sequence
  Oligomer
ccaguucccaacugggagcucau

SEQ ID NO: 78341 - RNA, 23 nt, Artificial Sequence
  Oligomer
caguucccaacugggagcucaua

SEQ ID NO: 78342 - RNA, 23 nt, Artificial Sequence
  Oligomer
aguucccaacugggagcucauau

SEQ ID NO: 78343 - RNA, 23 nt, Artificial Sequence
  Oligomer
guucccaacugggagcucauauc

SEQ ID NO: 78344 - RNA, 23 nt, Artificial Sequence
  Oligomer
uucccaacugggagcucauauca

SEQ ID NO: 78345 - RNA, 19 nt, Artificial Sequence
  Oligomer
cgagcaacagguuggugaa

SEQ ID NO: 78346 - RNA, 19 nt, Artificial Sequence
  Oligomer
cgaucguagaaacacagaa

SEQ ID NO: 78347 - RNA, 19 nt, Artificial Sequence
  Oligomer
guagaaacacagaauggga

SEQ ID NO: 78348 - RNA, 19 nt, Artificial Sequence
  Oligomer
gagcaacagguuggugaaa

SEQ ID NO: 78349 - RNA, 19 nt, Artificial Sequence
  Oligomer
cuuuggaaauccagcugca

SEQ ID NO: 78350 - RNA, 19 nt, Artificial Sequence
  Oligomer
gcgaucguagaaacacaga

SEQ ID NO: 78351 - RNA, 19 nt, Artificial Sequence
  Oligomer
guuggcacuucgagaagga

SEQ ID NO: 78352 - RNA, 19 nt, Artificial Sequence
  Oligomer
caggcggaacuuguaggaa

SEQ ID NO: 78353 - RNA, 19 nt, Artificial Sequence
  Oligomer
uggagcgaucguagaaaca

SEQ ID NO: 78354 - RNA, 19 nt, Artificial Sequence
  Oligomer
gagaguaaagacagcgccu

SEQ ID NO: 78355 - RNA, 19 nt, Artificial Sequence
  Oligomer
cgagaaggaaguggagagu

SEQ ID NO: 78356 - RNA, 19 nt, Artificial Sequence
  Oligomer
aggaaguggagaguaaaga

SEQ ID NO: 78357 - RNA, 19 nt, Artificial Sequence
  Oligomer
aacccuguguccuuggaga

SEQ ID NO: 78358 - RNA, 19 nt, Artificial Sequence
  Oligomer
uuggcacuucgagaaggaa

SEQ ID NO: 78359 - RNA, 19 nt, Artificial Sequence
  Oligomer
ggcacuucgagaaggaagu

SEQ ID NO: 78360 - RNA, 19 nt, Artificial Sequence
  Oligomer
agcugguucccguuuucca

SEQ ID NO: 78361 - RNA, 19 nt, Artificial Sequence
  Oligomer
aguggagaguaaagacagc

SEQ ID NO: 78362 - RNA, 19 nt, Artificial Sequence
  Oligomer
cuguguccuuggagaaagc

SEQ ID NO: 78363 - RNA, 19 nt, Artificial Sequence
  Oligomer
aaggaaguggagaguaaag

SEQ ID NO: 78364 - RNA, 19 nt, Artificial Sequence
  Oligomer
aguaaagacagcgccugga

SEQ ID NO: 78365 - RNA, 19 nt, Artificial Sequence
  Oligomer
gagaaagcugguucccguu

SEQ ID NO: 78366 - RNA, 19 nt, Artificial Sequence
  Oligomer
ggugaaaacccuguguccu

SEQ ID NO: 78367 - RNA, 19 nt, Artificial Sequence
  Oligomer
acuucgagaaggaagugga

SEQ ID NO: 78368 - RNA, 19 nt, Artificial Sequence
  Oligomer
aaguggagaguaaagacag

SEQ ID NO: 78369 - RNA, 19 nt, Artificial Sequence
  Oligomer
cuucgagaaggaaguggag

SEQ ID NO: 78370 - RNA, 19 nt, Artificial Sequence
  Oligomer
cugguucccguuuuccaga

SEQ ID NO: 78371 - RNA, 19 nt, Artificial Sequence
  Oligomer
agaaacacagaaugggacu

SEQ ID NO: 78372 - RNA, 19 nt, Artificial Sequence
  Oligomer
cguagaaacacagaauggg

SEQ ID NO: 78373 - RNA, 19 nt, Artificial Sequence
  Oligomer
ucgagaaggaaguggagag

SEQ ID NO: 78374 - RNA, 19 nt, Artificial Sequence
  Oligomer
gugaaaacccuguguccuu

SEQ ID NO: 78375 - RNA, 19 nt, Artificial Sequence
  Oligomer
guccuuggagaaagcuggu

SEQ ID NO: 78376 - RNA, 19 nt, Artificial Sequence
  Oligomer
guuggugaaaacccugugu

SEQ ID NO: 78377 - RNA, 19 nt, Artificial Sequence
  Oligomer
aaagcugguucccguuuuc

SEQ ID NO: 78378 - RNA, 19 nt, Artificial Sequence
  Oligomer
uuggaaauccagcugcaga

SEQ ID NO: 78379 - RNA, 19 nt, Artificial Sequence
  Oligomer
uucgagaaggaaguggaga

SEQ ID NO: 78380 - RNA, 19 nt, Artificial Sequence
  Oligomer
aaaacccuguguccuugga

SEQ ID NO: 78381 - RNA, 19 nt, Artificial Sequence
  Oligomer
auccagcugcagaaacaga

SEQ ID NO: 78382 - RNA, 19 nt, Artificial Sequence
  Oligomer
uagaaacacagaaugggac

SEQ ID NO: 78383 - RNA, 19 nt, Artificial Sequence
  Oligomer
uguccuuggagaaagcugg

SEQ ID NO: 78384 - RNA, 19 nt, Artificial Sequence
  Oligomer
cagcugcagaaacagacac

SEQ ID NO: 78385 - RNA, 19 nt, Artificial Sequence
  Oligomer
ucguagaaacacagaaugg

SEQ ID NO: 78386 - RNA, 19 nt, Artificial Sequence
  Oligomer
uggcacuucgagaaggaag

SEQ ID NO: 78387 - RNA, 19 nt, Artificial Sequence
  Oligomer
agguuggugaaaacccugu

SEQ ID NO: 78388 - RNA, 19 nt, Artificial Sequence
  Oligomer
aagcccuuuggaaauccag

SEQ ID NO: 78389 - RNA, 19 nt, Artificial Sequence
  Oligomer
uggagaguaaagacagcgc

SEQ ID NO: 78390 - RNA, 19 nt, Artificial Sequence
  Oligomer
ugaaaacccuguguccuug

SEQ ID NO: 78391 - RNA, 19 nt, Artificial Sequence
  Oligomer
aacacagaaugggacuggg

SEQ ID NO: 78392 - RNA, 19 nt, Artificial Sequence
  Oligomer
uggugaaaacccugugucc

SEQ ID NO: 78393 - RNA, 19 nt, Artificial Sequence
  Oligomer
guguccuuggagaaagcug

SEQ ID NO: 78394 - RNA, 19 nt, Artificial Sequence
  Oligomer
uuuggaaauccagcugcag

SEQ ID NO: 78395 - RNA, 19 nt, Artificial Sequence
  Oligomer
aaacccuguguccuuggag

SEQ ID NO: 78396 - RNA, 19 nt, Artificial Sequence
  Oligomer
aauccagcugcagaaacag

SEQ ID NO: 78397 - RNA, 19 nt, Artificial Sequence
  Oligomer
agcccuuuggaaauccagc

SEQ ID NO: 78398 - RNA, 19 nt, Artificial Sequence
  Oligomer
aucguagaaacacagaaug

SEQ ID NO: 78399 - RNA, 19 nt, Artificial Sequence
  Oligomer
cuuggagaaagcugguucc

SEQ ID NO: 78400 - RNA, 19 nt, Artificial Sequence
  Oligomer
uguguccuuggagaaagcu

SEQ ID NO: 78401 - RNA, 19 nt, Artificial Sequence
  Oligomer
ccuuuggaaauccagcugc

SEQ ID NO: 78402 - RNA, 19 nt, Artificial Sequence
  Oligomer
gcacuucgagaaggaagug

SEQ ID NO: 78403 - RNA, 19 nt, Artificial Sequence
  Oligomer
uccagcugcagaaacagac

SEQ ID NO: 78404 - RNA, 19 nt, Artificial Sequence
  Oligomer
ugguucccguuuuccagag

SEQ ID NO: 78405 - RNA, 19 nt, Artificial Sequence
  Oligomer
aaugcuauuuacauacagc

SEQ ID NO: 78406 - RNA, 19 nt, Artificial Sequence
  Oligomer
guggagaguaaagacagcg

SEQ ID NO: 78407 - RNA, 19 nt, Artificial Sequence
  Oligomer
gaaaacccuguguccuugg

SEQ ID NO: 78408 - RNA, 19 nt, Artificial Sequence
  Oligomer
caacagguuggugaaaacc

SEQ ID NO: 78409 - RNA, 19 nt, Artificial Sequence
  Oligomer
ugcuauuuacauacagcuc

SEQ ID NO: 78410 - RNA, 19 nt, Artificial Sequence
  Oligomer
agcugcagaaacagacacc

SEQ ID NO: 78411 - RNA, 19 nt, Artificial Sequence
  Oligomer
gaaacacagaaugggacug

SEQ ID NO: 78412 - RNA, 19 nt, Artificial Sequence
  Oligomer
aagcugguucccguuuucc

SEQ ID NO: 78413 - RNA, 19 nt, Artificial Sequence
  Oligomer
aacagguuggugaaaaccc

SEQ ID NO: 78414 - RNA, 19 nt, Artificial Sequence
  Oligomer
uuggugaaaacccuguguc

SEQ ID NO: 78415 - RNA, 19 nt, Artificial Sequence
  Oligomer
cacuucgagaaggaagugg

SEQ ID NO: 78416 - RNA, 19 nt, Artificial Sequence
  Oligomer
aaacacagaaugggacugg

SEQ ID NO: 78417 - RNA, 19 nt, Artificial Sequence
  Oligomer
uuggagaaagcugguuccc

SEQ ID NO: 78418 - RNA, 19 nt, Artificial Sequence
  Oligomer
uucaccaaccuguugcucg

SEQ ID NO: 78419 - RNA, 19 nt, Artificial Sequence
  Oligomer
uucuguguuucuacgaucg

SEQ ID NO: 78420 - RNA, 19 nt, Artificial Sequence
  Oligomer
ucccauucuguguuucuac

SEQ ID NO: 78421 - RNA, 19 nt, Artificial Sequence
  Oligomer
uuucaccaaccuguugcuc

SEQ ID NO: 78422 - RNA, 19 nt, Artificial Sequence
  Oligomer
ugcagcuggauuuccaaag

SEQ ID NO: 78423 - RNA, 19 nt, Artificial Sequence
  Oligomer
ucuguguuucuacgaucgc

SEQ ID NO: 78424 - RNA, 19 nt, Artificial Sequence
  Oligomer
uccuucucgaagugccaac

SEQ ID NO: 78425 - RNA, 19 nt, Artificial Sequence
  Oligomer
uuccuacaaguuccgccug

SEQ ID NO: 78426 - RNA, 19 nt, Artificial Sequence
  Oligomer
uguuucuacgaucgcucca

SEQ ID NO: 78427 - RNA, 19 nt, Artificial Sequence
  Oligomer
aggcgcugucuuuacucuc

SEQ ID NO: 78428 - RNA, 19 nt, Artificial Sequence
  Oligomer
acucuccacuuccuucucg

SEQ ID NO: 78429 - RNA, 19 nt, Artificial Sequence
  Oligomer
ucuuuacucuccacuuccu

SEQ ID NO: 78430 - RNA, 19 nt, Artificial Sequence
  Oligomer
ucuccaaggacacaggguu

SEQ ID NO: 78431 - RNA, 19 nt, Artificial Sequence
  Oligomer
uuccuucucgaagugccaa

SEQ ID NO: 78432 - RNA, 19 nt, Artificial Sequence
  Oligomer
acuuccuucucgaagugcc

SEQ ID NO: 78433 - RNA, 19 nt, Artificial Sequence
  Oligomer
uggaaaacgggaaccagcu

SEQ ID NO: 78434 - RNA, 19 nt, Artificial Sequence
  Oligomer
gcugucuuuacucuccacu

SEQ ID NO: 78435 - RNA, 19 nt, Artificial Sequence
  Oligomer
gcuuucuccaaggacacag

SEQ ID NO: 78436 - RNA, 19 nt, Artificial Sequence
  Oligomer
cuuuacucuccacuuccuu

SEQ ID NO: 78437 - RNA, 19 nt, Artificial Sequence
  Oligomer
uccaggcgcugucuuuacu

SEQ ID NO: 78438 - RNA, 19 nt, Artificial Sequence
  Oligomer
aacgggaaccagcuuucuc

SEQ ID NO: 78439 - RNA, 19 nt, Artificial Sequence
  Oligomer
aggacacaggguuuucacc

SEQ ID NO: 78440 - RNA, 19 nt, Artificial Sequence
  Oligomer
uccacuuccuucucgaagu

SEQ ID NO: 78441 - RNA, 19 nt, Artificial Sequence
  Oligomer
cugucuuuacucuccacuu

SEQ ID NO: 78442 - RNA, 19 nt, Artificial Sequence
  Oligomer
cuccacuuccuucucgaag

SEQ ID NO: 78443 - RNA, 19 nt, Artificial Sequence
  Oligomer
ucuggaaaacgggaaccag

SEQ ID NO: 78444 - RNA, 19 nt, Artificial Sequence
  Oligomer
agucccauucuguguuucu

SEQ ID NO: 78445 - RNA, 19 nt, Artificial Sequence
  Oligomer
cccauucuguguuucuacg

SEQ ID NO: 78446 - RNA, 19 nt, Artificial Sequence
  Oligomer
cucuccacuuccuucucga

SEQ ID NO: 78447 - RNA, 19 nt, Artificial Sequence
  Oligomer
aaggacacaggguuuucac

SEQ ID NO: 78448 - RNA, 19 nt, Artificial Sequence
  Oligomer
accagcuuucuccaaggac

SEQ ID NO: 78449 - RNA, 19 nt, Artificial Sequence
  Oligomer
acacaggguuuucaccaac

SEQ ID NO: 78450 - RNA, 19 nt, Artificial Sequence
  Oligomer
gaaaacgggaaccagcuuu

SEQ ID NO: 78451 - RNA, 19 nt, Artificial Sequence
  Oligomer
ucugcagcuggauuuccaa

SEQ ID NO: 78452 - RNA, 19 nt, Artificial Sequence
  Oligomer
ucuccacuuccuucucgaa

SEQ ID NO: 78453 - RNA, 19 nt, Artificial Sequence
  Oligomer
uccaaggacacaggguuuu

SEQ ID NO: 78454 - RNA, 19 nt, Artificial Sequence
  Oligomer
ucuguuucugcagcuggau

SEQ ID NO: 78455 - RNA, 19 nt, Artificial Sequence
  Oligomer
gucccauucuguguuucua

SEQ ID NO: 78456 - RNA, 19 nt, Artificial Sequence
  Oligomer
ccagcuuucuccaaggaca

SEQ ID NO: 78457 - RNA, 19 nt, Artificial Sequence
  Oligomer
gugucuguuucugcagcug

SEQ ID NO: 78458 - RNA, 19 nt, Artificial Sequence
  Oligomer
ccauucuguguuucuacga

SEQ ID NO: 78459 - RNA, 19 nt, Artificial Sequence
  Oligomer
cuuccuucucgaagugcca

SEQ ID NO: 78460 - RNA, 19 nt, Artificial Sequence
  Oligomer
acaggguuuucaccaaccu

SEQ ID NO: 78461 - RNA, 19 nt, Artificial Sequence
  Oligomer
cuggauuuccaaagggcuu

SEQ ID NO: 78462 - RNA, 19 nt, Artificial Sequence
  Oligomer
gcgcugucuuuacucucca

SEQ ID NO: 78463 - RNA, 19 nt, Artificial Sequence
  Oligomer
caaggacacaggguuuuca

SEQ ID NO: 78464 - RNA, 19 nt, Artificial Sequence
  Oligomer
cccagucccauucuguguu

SEQ ID NO: 78465 - RNA, 19 nt, Artificial Sequence
  Oligomer
ggacacaggguuuucacca

SEQ ID NO: 78466 - RNA, 19 nt, Artificial Sequence
  Oligomer
cagcuuucuccaaggacac

SEQ ID NO: 78467 - RNA, 19 nt, Artificial Sequence
  Oligomer
cugcagcuggauuuccaaa

SEQ ID NO: 78468 - RNA, 19 nt, Artificial Sequence
  Oligomer
cuccaaggacacaggguuu

SEQ ID NO: 78469 - RNA, 19 nt, Artificial Sequence
  Oligomer
cuguuucugcagcuggauu

SEQ ID NO: 78470 - RNA, 19 nt, Artificial Sequence
  Oligomer
gcuggauuuccaaagggcu

SEQ ID NO: 78471 - RNA, 19 nt, Artificial Sequence
  Oligomer
cauucuguguuucuacgau

SEQ ID NO: 78472 - RNA, 19 nt, Artificial Sequence
  Oligomer
ggaaccagcuuucuccaag

SEQ ID NO: 78473 - RNA, 19 nt, Artificial Sequence
  Oligomer
agcuuucuccaaggacaca

SEQ ID NO: 78474 - RNA, 19 nt, Artificial Sequence
  Oligomer
gcagcuggauuuccaaagg

SEQ ID NO: 78475 - RNA, 19 nt, Artificial Sequence
  Oligomer
cacuuccuucucgaagugc

SEQ ID NO: 78476 - RNA, 19 nt, Artificial Sequence
  Oligomer
gucuguuucugcagcugga

SEQ ID NO: 78477 - RNA, 19 nt, Artificial Sequence
  Oligomer
cucuggaaaacgggaacca

SEQ ID NO: 78478 - RNA, 19 nt, Artificial Sequence
  Oligomer
gcuguauguaaauagcauu

SEQ ID NO: 78479 - RNA, 19 nt, Artificial Sequence
  Oligomer
cgcugucuuuacucuccac

SEQ ID NO: 78480 - RNA, 19 nt, Artificial Sequence
  Oligomer
ccaaggacacaggguuuuc

SEQ ID NO: 78481 - RNA, 19 nt, Artificial Sequence
  Oligomer
gguuuucaccaaccuguug

SEQ ID NO: 78482 - RNA, 19 nt, Artificial Sequence
  Oligomer
gagcuguauguaaauagca

SEQ ID NO: 78483 - RNA, 19 nt, Artificial Sequence
  Oligomer
ggugucuguuucugcagcu

SEQ ID NO: 78484 - RNA, 19 nt, Artificial Sequence
  Oligomer
cagucccauucuguguuuc

SEQ ID NO: 78485 - RNA, 19 nt, Artificial Sequence
  Oligomer
ggaaaacgggaaccagcuu

SEQ ID NO: 78486 - RNA, 19 nt, Artificial Sequence
  Oligomer
ggguuuucaccaaccuguu

SEQ ID NO: 78487 - RNA, 19 nt, Artificial Sequence
  Oligomer
gacacaggguuuucaccaa

SEQ ID NO: 78488 - RNA, 19 nt, Artificial Sequence
  Oligomer
ccacuuccuucucgaagug

SEQ ID NO: 78489 - RNA, 19 nt, Artificial Sequence
  Oligomer
ccagucccauucuguguuu

SEQ ID NO: 78490 - RNA, 19 nt, Artificial Sequence
  Oligomer
gggaaccagcuuucuccaa

SEQ ID NO: 78491 - RNA, 21 nt, Artificial Sequence
  Oligomer
cgagaaggaaguggagaguaa

SEQ ID NO: 78492 - RNA, 21 nt, Artificial Sequence
  Oligomer
gagaaggaaguggagaguaaa

SEQ ID NO: 78493 - RNA, 21 nt, Artificial Sequence
  Oligomer
gaaggaaguggagaguaaaga

SEQ ID NO: 78494 - RNA, 21 nt, Artificial Sequence
  Oligomer
gcgagcaacagguuggugaaa

SEQ ID NO: 78495 - RNA, 21 nt, Artificial Sequence
  Oligomer
cuuuggaaauccagcugcaga

SEQ ID NO: 78496 - RNA, 21 nt, Artificial Sequence
  Oligomer
uuuggaaauccagcugcagaa

SEQ ID NO: 78497 - RNA, 21 nt, Artificial Sequence
  Oligomer
aggaaguggagaguaaagaca

SEQ ID NO: 78498 - RNA, 21 nt, Artificial Sequence
  Oligomer
agaaggaaguggagaguaaag

SEQ ID NO: 78499 - RNA, 21 nt, Artificial Sequence
  Oligomer
agcgagcaacagguuggugaa

SEQ ID NO: 78500 - RNA, 21 nt, Artificial Sequence
  Oligomer
cguagaaacacagaaugggac

SEQ ID NO: 78501 - RNA, 21 nt, Artificial Sequence
  Oligomer
ucgagaaggaaguggagagua

SEQ ID NO: 78502 - RNA, 21 nt, Artificial Sequence
  Oligomer
agcugguucccguuuuccaga

SEQ ID NO: 78503 - RNA, 21 nt, Artificial Sequence
  Oligomer
gcgaucguagaaacacagaau

SEQ ID NO: 78504 - RNA, 21 nt, Artificial Sequence
  Oligomer
cgaucguagaaacacagaaug

SEQ ID NO: 78505 - RNA, 21 nt, Artificial Sequence
  Oligomer
gcacuucgagaaggaagugga

SEQ ID NO: 78506 - RNA, 21 nt, Artificial Sequence
  Oligomer
aacccuguguccuuggagaaa

SEQ ID NO: 78507 - RNA, 21 nt, Artificial Sequence
  Oligomer
aaauccagcugcagaaacaga

SEQ ID NO: 78508 - RNA, 21 nt, Artificial Sequence
  Oligomer
agaguaaagacagcgccugga

SEQ ID NO: 78509 - RNA, 21 nt, Artificial Sequence
  Oligomer
aaagcugguucccguuuucca

SEQ ID NO: 78510 - RNA, 21 nt, Artificial Sequence
  Oligomer
uggagcgaucguagaaacaca

SEQ ID NO: 78511 - RNA, 21 nt, Artificial Sequence
  Oligomer
acagguuggugaaaacccugu

SEQ ID NO: 78512 - RNA, 21 nt, Artificial Sequence
  Oligomer
gaucguagaaacacagaaugg

SEQ ID NO: 78513 - RNA, 21 nt, Artificial Sequence
  Oligomer
acuucgagaaggaaguggaga

SEQ ID NO: 78514 - RNA, 21 nt, Artificial Sequence
  Oligomer
aaggaaguggagaguaaagac

SEQ ID NO: 78515 - RNA, 21 nt, Artificial Sequence
  Oligomer
gaaguggagaguaaagacagc

SEQ ID NO: 78516 - RNA, 21 nt, Artificial Sequence
  Oligomer
cuucgagaaggaaguggagag

SEQ ID NO: 78517 - RNA, 21 nt, Artificial Sequence
  Oligomer
guuggcacuucgagaaggaag

SEQ ID NO: 78518 - RNA, 21 nt, Artificial Sequence
  Oligomer
cuguguccuuggagaaagcug

SEQ ID NO: 78519 - RNA, 21 nt, Artificial Sequence
  Oligomer
guguccuuggagaaagcuggu

SEQ ID NO: 78520 - RNA, 21 nt, Artificial Sequence
  Oligomer
aaaacccuguguccuuggaga

SEQ ID NO: 78521 - RNA, 21 nt, Artificial Sequence
  Oligomer
ugaaaacccuguguccuugga

SEQ ID NO: 78522 - RNA, 21 nt, Artificial Sequence
  Oligomer
gugaaaacccuguguccuugg

SEQ ID NO: 78523 - RNA, 21 nt, Artificial Sequence
  Oligomer
caacagguuggugaaaacccu

SEQ ID NO: 78524 - RNA, 21 nt, Artificial Sequence
  Oligomer
uggagaguaaagacagcgccu

SEQ ID NO: 78525 - RNA, 21 nt, Artificial Sequence
  Oligomer
gcaacagguuggugaaaaccc

SEQ ID NO: 78526 - RNA, 21 nt, Artificial Sequence
  Oligomer
ggugaaaacccuguguccuug

SEQ ID NO: 78527 - RNA, 21 nt, Artificial Sequence
  Oligomer
uguccuuggagaaagcugguu

SEQ ID NO: 78528 - RNA, 21 nt, Artificial Sequence
  Oligomer
aguggagaguaaagacagcgc

SEQ ID NO: 78529 - RNA, 21 nt, Artificial Sequence
  Oligomer
gaaagcugguucccguuuucc

SEQ ID NO: 78530 - RNA, 21 nt, Artificial Sequence
  Oligomer
aacagguuggugaaaacccug

SEQ ID NO: 78531 - RNA, 21 nt, Artificial Sequence
  Oligomer
aaguggagaguaaagacagcg

SEQ ID NO: 78532 - RNA, 21 nt, Artificial Sequence
  Oligomer
cacuucgagaaggaaguggag

SEQ ID NO: 78533 - RNA, 21 nt, Artificial Sequence
  Oligomer
uuggagaaagcugguucccgu

SEQ ID NO: 78534 - RNA, 21 nt, Artificial Sequence
  Oligomer
auccagcugcagaaacagaca

SEQ ID NO: 78535 - RNA, 21 nt, Artificial Sequence
  Oligomer
uccagcugcagaaacagacac

SEQ ID NO: 78536 - RNA, 21 nt, Artificial Sequence
  Oligomer
gaagcccuuuggaaauccagc

SEQ ID NO: 78537 - RNA, 21 nt, Artificial Sequence
  Oligomer
cuggagcgaucguagaaacac

SEQ ID NO: 78538 - RNA, 21 nt, Artificial Sequence
  Oligomer
uuggcacuucgagaaggaagu

SEQ ID NO: 78539 - RNA, 21 nt, Artificial Sequence
  Oligomer
guuggugaaaacccugugucc

SEQ ID NO: 78540 - RNA, 21 nt, Artificial Sequence
  Oligomer
gaaacacagaaugggacuggg

SEQ ID NO: 78541 - RNA, 21 nt, Artificial Sequence
  Oligomer
aagcccuuuggaaauccagcu

SEQ ID NO: 78542 - RNA, 21 nt, Artificial Sequence
  Oligomer
aagcugguucccguuuuccag

SEQ ID NO: 78543 - RNA, 21 nt, Artificial Sequence
  Oligomer
acccuguguccuuggagaaag

SEQ ID NO: 78544 - RNA, 21 nt, Artificial Sequence
  Oligomer
aucguagaaacacagaauggg

SEQ ID NO: 78545 - RNA, 21 nt, Artificial Sequence
  Oligomer
aaugcuauuuacauacagcuc

SEQ ID NO: 78546 - RNA, 21 nt, Artificial Sequence
  Oligomer
uucgagaaggaaguggagagu

SEQ ID NO: 78547 - RNA, 21 nt, Artificial Sequence
  Oligomer
uuggugaaaacccuguguccu

SEQ ID NO: 78548 - RNA, 21 nt, Artificial Sequence
  Oligomer
uguguccuuggagaaagcugg

SEQ ID NO: 78549 - RNA, 21 nt, Artificial Sequence
  Oligomer
agcaacagguuggugaaaacc

SEQ ID NO: 78550 - RNA, 21 nt, Artificial Sequence
  Oligomer
uggcacuucgagaaggaagug

SEQ ID NO: 78551 - RNA, 21 nt, Artificial Sequence
  Oligomer
agaaacacagaaugggacugg

SEQ ID NO: 78552 - RNA, 21 nt, Artificial Sequence
  Oligomer
uagaaacacagaaugggacug

SEQ ID NO: 78553 - RNA, 21 nt, Artificial Sequence
  Oligomer
uccuuggagaaagcugguucc

SEQ ID NO: 78554 - RNA, 21 nt, Artificial Sequence
  Oligomer
uuacucuccacuuccuucucg

SEQ ID NO: 78555 - RNA, 21 nt, Artificial Sequence
  Oligomer
uuuacucuccacuuccuucuc

SEQ ID NO: 78556 - RNA, 21 nt, Artificial Sequence
  Oligomer
ucuuuacucuccacuuccuuc

SEQ ID NO: 78557 - RNA, 21 nt, Artificial Sequence
  Oligomer
uuucaccaaccuguugcucgc

SEQ ID NO: 78558 - RNA, 21 nt, Artificial Sequence
  Oligomer
ucugcagcuggauuuccaaag

SEQ ID NO: 78559 - RNA, 21 nt, Artificial Sequence
  Oligomer
uucugcagcuggauuuccaaa

SEQ ID NO: 78560 - RNA, 21 nt, Artificial Sequence
  Oligomer
ugucuuuacucuccacuuccu

SEQ ID NO: 78561 - RNA, 21 nt, Artificial Sequence
  Oligomer
cuuuacucuccacuuccuucu

SEQ ID NO: 78562 - RNA, 21 nt, Artificial Sequence
  Oligomer
uucaccaaccuguugcucgcu

SEQ ID NO: 78563 - RNA, 21 nt, Artificial Sequence
  Oligomer
gucccauucuguguuucuacg

SEQ ID NO: 78564 - RNA, 21 nt, Artificial Sequence
  Oligomer
uacucuccacuuccuucucga

SEQ ID NO: 78565 - RNA, 21 nt, Artificial Sequence
  Oligomer
ucuggaaaacgggaaccagcu

SEQ ID NO: 78566 - RNA, 21 nt, Artificial Sequence
  Oligomer
auucuguguuucuacgaucgc

SEQ ID NO: 78567 - RNA, 21 nt, Artificial Sequence
  Oligomer
cauucuguguuucuacgaucg

SEQ ID NO: 78568 - RNA, 21 nt, Artificial Sequence
  Oligomer
uccacuuccuucucgaagugc

SEQ ID NO: 78569 - RNA, 21 nt, Artificial Sequence
  Oligomer
uuucuccaaggacacaggguu

SEQ ID NO: 78570 - RNA, 21 nt, Artificial Sequence
  Oligomer
ucuguuucugcagcuggauuu

SEQ ID NO: 78571 - RNA, 21 nt, Artificial Sequence
  Oligomer
uccaggcgcugucuuuacucu

SEQ ID NO: 78572 - RNA, 21 nt, Artificial Sequence
  Oligomer
uggaaaacgggaaccagcuuu

SEQ ID NO: 78573 - RNA, 21 nt, Artificial Sequence
  Oligomer
uguguuucuacgaucgcucca

SEQ ID NO: 78574 - RNA, 21 nt, Artificial Sequence
  Oligomer
acaggguuuucaccaaccugu

SEQ ID NO: 78575 - RNA, 21 nt, Artificial Sequence
  Oligomer
ccauucuguguuucuacgauc

SEQ ID NO: 78576 - RNA, 21 nt, Artificial Sequence
  Oligomer
ucuccacuuccuucucgaagu

SEQ ID NO: 78577 - RNA, 21 nt, Artificial Sequence
  Oligomer
gucuuuacucuccacuuccuu

SEQ ID NO: 78578 - RNA, 21 nt, Artificial Sequence
  Oligomer
gcugucuuuacucuccacuuc

SEQ ID NO: 78579 - RNA, 21 nt, Artificial Sequence
  Oligomer
cucuccacuuccuucucgaag

SEQ ID NO: 78580 - RNA, 21 nt, Artificial Sequence
  Oligomer
cuuccuucucgaagugccaac

SEQ ID NO: 78581 - RNA, 21 nt, Artificial Sequence
  Oligomer
cagcuuucuccaaggacacag

SEQ ID NO: 78582 - RNA, 21 nt, Artificial Sequence
  Oligomer
accagcuuucuccaaggacac

SEQ ID NO: 78583 - RNA, 21 nt, Artificial Sequence
  Oligomer
ucuccaaggacacaggguuuu

SEQ ID NO: 78584 - RNA, 21 nt, Artificial Sequence
  Oligomer
uccaaggacacaggguuuuca

SEQ ID NO: 78585 - RNA, 21 nt, Artificial Sequence
  Oligomer
ccaaggacacaggguuuucac

SEQ ID NO: 78586 - RNA, 21 nt, Artificial Sequence
  Oligomer
aggguuuucaccaaccuguug

SEQ ID NO: 78587 - RNA, 21 nt, Artificial Sequence
  Oligomer
aggcgcugucuuuacucucca

SEQ ID NO: 78588 - RNA, 21 nt, Artificial Sequence
  Oligomer
ggguuuucaccaaccuguugc

SEQ ID NO: 78589 - RNA, 21 nt, Artificial Sequence
  Oligomer
caaggacacaggguuuucacc

SEQ ID NO: 78590 - RNA, 21 nt, Artificial Sequence
  Oligomer
aaccagcuuucuccaaggaca

SEQ ID NO: 78591 - RNA, 21 nt, Artificial Sequence
  Oligomer
gcgcugucuuuacucuccacu

SEQ ID NO: 78592 - RNA, 21 nt, Artificial Sequence
  Oligomer
ggaaaacgggaaccagcuuuc

SEQ ID NO: 78593 - RNA, 21 nt, Artificial Sequence
  Oligomer
caggguuuucaccaaccuguu

SEQ ID NO: 78594 - RNA, 21 nt, Artificial Sequence
  Oligomer
cgcugucuuuacucuccacuu

SEQ ID NO: 78595 - RNA, 21 nt, Artificial Sequence
  Oligomer
cuccacuuccuucucgaagug

SEQ ID NO: 78596 - RNA, 21 nt, Artificial Sequence
  Oligomer
acgggaaccagcuuucuccaa

SEQ ID NO: 78597 - RNA, 21 nt, Artificial Sequence
  Oligomer
ugucuguuucugcagcuggau

SEQ ID NO: 78598 - RNA, 21 nt, Artificial Sequence
  Oligomer
gugucuguuucugcagcugga

SEQ ID NO: 78599 - RNA, 21 nt, Artificial Sequence
  Oligomer
gcuggauuuccaaagggcuuc

SEQ ID NO: 78600 - RNA, 21 nt, Artificial Sequence
  Oligomer
guguuucuacgaucgcuccag

SEQ ID NO: 78601 - RNA, 21 nt, Artificial Sequence
  Oligomer
acuuccuucucgaagugccaa

SEQ ID NO: 78602 - RNA, 21 nt, Artificial Sequence
  Oligomer
ggacacaggguuuucaccaac

SEQ ID NO: 78603 - RNA, 21 nt, Artificial Sequence
  Oligomer
cccagucccauucuguguuuc

SEQ ID NO: 78604 - RNA, 21 nt, Artificial Sequence
  Oligomer
agcuggauuuccaaagggcuu

SEQ ID NO: 78605 - RNA, 21 nt, Artificial Sequence
  Oligomer
cuggaaaacgggaaccagcuu

SEQ ID NO: 78606 - RNA, 21 nt, Artificial Sequence
  Oligomer
cuuucuccaaggacacagggu

SEQ ID NO: 78607 - RNA, 21 nt, Artificial Sequence
  Oligomer
cccauucuguguuucuacgau

SEQ ID NO: 78608 - RNA, 21 nt, Artificial Sequence
  Oligomer
gagcuguauguaaauagcauu

SEQ ID NO: 78609 - RNA, 21 nt, Artificial Sequence
  Oligomer
acucuccacuuccuucucgaa

SEQ ID NO: 78610 - RNA, 21 nt, Artificial Sequence
  Oligomer
aggacacaggguuuucaccaa

SEQ ID NO: 78611 - RNA, 21 nt, Artificial Sequence
  Oligomer
ccagcuuucuccaaggacaca

SEQ ID NO: 78612 - RNA, 21 nt, Artificial Sequence
  Oligomer
gguuuucaccaaccuguugcu

SEQ ID NO: 78613 - RNA, 21 nt, Artificial Sequence
  Oligomer
cacuuccuucucgaagugcca

SEQ ID NO: 78614 - RNA, 21 nt, Artificial Sequence
  Oligomer
ccagucccauucuguguuucu

SEQ ID NO: 78615 - RNA, 21 nt, Artificial Sequence
  Oligomer
cagucccauucuguguuucua

SEQ ID NO: 78616 - RNA, 21 nt, Artificial Sequence
  Oligomer
ggaaccagcuuucuccaagga

SEQ ID NO: 78617 - RNA, 23 nt, Artificial Sequence
  Oligomer
gagcgagcaacagguuggugaaa

SEQ ID NO: 78618 - RNA, 23 nt, Artificial Sequence
  Oligomer
ggagcgagcaacagguuggugaa

SEQ ID NO: 78619 - RNA, 23 nt, Artificial Sequence
  Oligomer
gaaggaaguggagaguaaagaca

SEQ ID NO: 78620 - RNA, 23 nt, Artificial Sequence
  Oligomer
agaaggaaguggagaguaaagac

SEQ ID NO: 78621 - RNA, 23 nt, Artificial Sequence
  Oligomer
gagaaggaaguggagaguaaaga

SEQ ID NO: 78622 - RNA, 23 nt, Artificial Sequence
  Oligomer
cgagaaggaaguggagaguaaag

SEQ ID NO: 78623 - RNA, 23 nt, Artificial Sequence
  Oligomer
ucgagaaggaaguggagaguaaa

SEQ ID NO: 78624 - RNA, 23 nt, Artificial Sequence
  Oligomer
uucgagaaggaaguggagaguaa

SEQ ID NO: 78625 - RNA, 23 nt, Artificial Sequence
  Oligomer
cgaucguagaaacacagaauggg

SEQ ID NO: 78626 - RNA, 23 nt, Artificial Sequence
  Oligomer
gcgaucguagaaacacagaaugg

SEQ ID NO: 78627 - RNA, 23 nt, Artificial Sequence
  Oligomer
ggaaauccagcugcagaaacaga

SEQ ID NO: 78628 - RNA, 23 nt, Artificial Sequence
  Oligomer
guagaaacacagaaugggacugg

SEQ ID NO: 78629 - RNA, 23 nt, Artificial Sequence
  Oligomer
cguagaaacacagaaugggacug

SEQ ID NO: 78630 - RNA, 23 nt, Artificial Sequence
  Oligomer
ucguagaaacacagaaugggacu

SEQ ID NO: 78631 - RNA, 23 nt, Artificial Sequence
  Oligomer
aucguagaaacacagaaugggac

SEQ ID NO: 78632 - RNA, 23 nt, Artificial Sequence
  Oligomer
gaucguagaaacacagaauggga

SEQ ID NO: 78633 - RNA, 23 nt, Artificial Sequence
  Oligomer
ggaaguggagaguaaagacagcg

SEQ ID NO: 78634 - RNA, 23 nt, Artificial Sequence
  Oligomer
aggaaguggagaguaaagacagc

SEQ ID NO: 78635 - RNA, 23 nt, Artificial Sequence
  Oligomer
aaggaaguggagaguaaagacag

SEQ ID NO: 78636 - RNA, 23 nt, Artificial Sequence
  Oligomer
guuggcacuucgagaaggaagug

SEQ ID NO: 78637 - RNA, 23 nt, Artificial Sequence
  Oligomer
gguuggcacuucgagaaggaagu

SEQ ID NO: 78638 - RNA, 23 nt, Artificial Sequence
  Oligomer
cgguuggcacuucgagaaggaag

SEQ ID NO: 78639 - RNA, 23 nt, Artificial Sequence
  Oligomer
gcgguuggcacuucgagaaggaa

SEQ ID NO: 78640 - RNA, 23 nt, Artificial Sequence
  Oligomer
cgcgguuggcacuucgagaagga

SEQ ID NO: 78641 - RNA, 23 nt, Artificial Sequence
  Oligomer
gaaguggagaguaaagacagcgc

SEQ ID NO: 78642 - RNA, 23 nt, Artificial Sequence
  Oligomer
ucggcaggcggaacuuguaggaa

SEQ ID NO: 78643 - RNA, 23 nt, Artificial Sequence
  Oligomer
aguggagaguaaagacagcgccu

SEQ ID NO: 78644 - RNA, 23 nt, Artificial Sequence
  Oligomer
cuucgagaaggaaguggagagua

SEQ ID NO: 78645 - RNA, 23 nt, Artificial Sequence
  Oligomer
acuucgagaaggaaguggagagu

SEQ ID NO: 78646 - RNA, 23 nt, Artificial Sequence
  Oligomer
gaaagcugguucccguuuuccag

SEQ ID NO: 78647 - RNA, 23 nt, Artificial Sequence
  Oligomer
agaaagcugguucccguuuucca

SEQ ID NO: 78648 - RNA, 23 nt, Artificial Sequence
  Oligomer
gagaaagcugguucccguuuucc

SEQ ID NO: 78649 - RNA, 23 nt, Artificial Sequence
  Oligomer
ggagaaagcugguucccguuuuc

SEQ ID NO: 78650 - RNA, 23 nt, Artificial Sequence
  Oligomer
uggagaaagcugguucccguuuu

SEQ ID NO: 78651 - RNA, 23 nt, Artificial Sequence
  Oligomer
ugaaaacccuguguccuuggaga

SEQ ID NO: 78652 - RNA, 23 nt, Artificial Sequence
  Oligomer
uuggcacuucgagaaggaagugg

SEQ ID NO: 78653 - RNA, 23 nt, Artificial Sequence
  Oligomer
ggcacuucgagaaggaaguggag

SEQ ID NO: 78654 - RNA, 23 nt, Artificial Sequence
  Oligomer
uggcacuucgagaaggaagugga

SEQ ID NO: 78655 - RNA, 23 nt, Artificial Sequence
  Oligomer
gaaauccagcugcagaaacagac

SEQ ID NO: 78656 - RNA, 23 nt, Artificial Sequence
  Oligomer
agcugguucccguuuuccagagg

SEQ ID NO: 78657 - RNA, 23 nt, Artificial Sequence
  Oligomer
aagcugguucccguuuuccagag

SEQ ID NO: 78658 - RNA, 23 nt, Artificial Sequence
  Oligomer
aaagcugguucccguuuuccaga

SEQ ID NO: 78659 - RNA, 23 nt, Artificial Sequence
  Oligomer
aaguggagaguaaagacagcgcc

SEQ ID NO: 78660 - RNA, 23 nt, Artificial Sequence
  Oligomer
cuguguccuuggagaaagcuggu

SEQ ID NO: 78661 - RNA, 23 nt, Artificial Sequence
  Oligomer
aguaaagacagcgccuggagcga

SEQ ID NO: 78662 - RNA, 23 nt, Artificial Sequence
  Oligomer
gaguaaagacagcgccuggagcg

SEQ ID NO: 78663 - RNA, 23 nt, Artificial Sequence
  Oligomer
uuggagaaagcugguucccguuu

SEQ ID NO: 78664 - RNA, 23 nt, Artificial Sequence
  Oligomer
cuuggagaaagcugguucccguu

SEQ ID NO: 78665 - RNA, 23 nt, Artificial Sequence
  Oligomer
uggugaaaacccuguguccuugg

SEQ ID NO: 78666 - RNA, 23 nt, Artificial Sequence
  Oligomer
uuggugaaaacccuguguccuug

SEQ ID NO: 78667 - RNA, 23 nt, Artificial Sequence
  Oligomer
guuggugaaaacccuguguccuu

SEQ ID NO: 78668 - RNA, 23 nt, Artificial Sequence
  Oligomer
cacuucgagaaggaaguggagag

SEQ ID NO: 78669 - RNA, 23 nt, Artificial Sequence
  Oligomer
gcacuucgagaaggaaguggaga

SEQ ID NO: 78670 - RNA, 23 nt, Artificial Sequence
  Oligomer
cugguucccguuuuccagagggg

SEQ ID NO: 78671 - RNA, 23 nt, Artificial Sequence
  Oligomer
gcugguucccguuuuccagaggg

SEQ ID NO: 78672 - RNA, 23 nt, Artificial Sequence
  Oligomer
agaaacacagaaugggacugggg

SEQ ID NO: 78673 - RNA, 23 nt, Artificial Sequence
  Oligomer
uagaaacacagaaugggacuggg

SEQ ID NO: 78674 - RNA, 23 nt, Artificial Sequence
  Oligomer
gugaaaacccuguguccuuggag

SEQ ID NO: 78675 - RNA, 23 nt, Artificial Sequence
  Oligomer
cagcugcagaaacagacacccca

SEQ ID NO: 78676 - RNA, 23 nt, Artificial Sequence
  Oligomer
aacacagaaugggacuggggaag

SEQ ID NO: 78677 - RNA, 23 nt, Artificial Sequence
  Oligomer
aaacacagaaugggacuggggaa

SEQ ID NO: 78678 - RNA, 23 nt, Artificial Sequence
  Oligomer
acuggggaagcccuuuggaaauc

SEQ ID NO: 78679 - RNA, 23 nt, Artificial Sequence
  Oligomer
ugguucccguuuuccagaggggg

SEQ ID NO: 78680 - RNA, 23 nt, Artificial Sequence
  Oligomer
ugcuauuuacauacagcucuaua

SEQ ID NO: 78681 - RNA, 23 nt, Artificial Sequence
  Oligomer
agcugcagaaacagacaccccaa

SEQ ID NO: 78682 - RNA, 23 nt, Artificial Sequence
  Oligomer
uuucaccaaccuguugcucgcuc

SEQ ID NO: 78683 - RNA, 23 nt, Artificial Sequence
  Oligomer
uucaccaaccuguugcucgcucc

SEQ ID NO: 78684 - RNA, 23 nt, Artificial Sequence
  Oligomer
ugucuuuacucuccacuuccuuc

SEQ ID NO: 78685 - RNA, 23 nt, Artificial Sequence
  Oligomer
gucuuuacucuccacuuccuucu

SEQ ID NO: 78686 - RNA, 23 nt, Artificial Sequence
  Oligomer
ucuuuacucuccacuuccuucuc

SEQ ID NO: 78687 - RNA, 23 nt, Artificial Sequence
  Oligomer
cuuuacucuccacuuccuucucg

SEQ ID NO: 78688 - RNA, 23 nt, Artificial Sequence
  Oligomer
uuuacucuccacuuccuucucga

SEQ ID NO: 78689 - RNA, 23 nt, Artificial Sequence
  Oligomer
uuacucuccacuuccuucucgaa

SEQ ID NO: 78690 - RNA, 23 nt, Artificial Sequence
  Oligomer
cccauucuguguuucuacgaucg

SEQ ID NO: 78691 - RNA, 23 nt, Artificial Sequence
  Oligomer
ccauucuguguuucuacgaucgc

SEQ ID NO: 78692 - RNA, 23 nt, Artificial Sequence
  Oligomer
ucuguuucugcagcuggauuucc

SEQ ID NO: 78693 - RNA, 23 nt, Artificial Sequence
  Oligomer
ccagucccauucuguguuucuac

SEQ ID NO: 78694 - RNA, 23 nt, Artificial Sequence
  Oligomer
cagucccauucuguguuucuacg

SEQ ID NO: 78695 - RNA, 23 nt, Artificial Sequence
  Oligomer
agucccauucuguguuucuacga

SEQ ID NO: 78696 - RNA, 23 nt, Artificial Sequence
  Oligomer
gucccauucuguguuucuacgau

SEQ ID NO: 78697 - RNA, 23 nt, Artificial Sequence
  Oligomer
ucccauucuguguuucuacgauc

SEQ ID NO: 78698 - RNA, 23 nt, Artificial Sequence
  Oligomer
cgcugucuuuacucuccacuucc

SEQ ID NO: 78699 - RNA, 23 nt, Artificial Sequence
  Oligomer
gcugucuuuacucuccacuuccu

SEQ ID NO: 78700 - RNA, 23 nt, Artificial Sequence
  Oligomer
cugucuuuacucuccacuuccuu

SEQ ID NO: 78701 - RNA, 23 nt, Artificial Sequence
  Oligomer
cacuuccuucucgaagugccaac

SEQ ID NO: 78702 - RNA, 23 nt, Artificial Sequence
  Oligomer
acuuccuucucgaagugccaacc

SEQ ID NO: 78703 - RNA, 23 nt, Artificial Sequence
  Oligomer
cuuccuucucgaagugccaaccg

SEQ ID NO: 78704 - RNA, 23 nt, Artificial Sequence
  Oligomer
uuccuucucgaagugccaaccgc

SEQ ID NO: 78705 - RNA, 23 nt, Artificial Sequence
  Oligomer
uccuucucgaagugccaaccgcg

SEQ ID NO: 78706 - RNA, 23 nt, Artificial Sequence
  Oligomer
gcgcugucuuuacucuccacuuc

SEQ ID NO: 78707 - RNA, 23 nt, Artificial Sequence
  Oligomer
uuccuacaaguuccgccugccga

SEQ ID NO: 78708 - RNA, 23 nt, Artificial Sequence
  Oligomer
aggcgcugucuuuacucuccacu

SEQ ID NO: 78709 - RNA, 23 nt, Artificial Sequence
  Oligomer
uacucuccacuuccuucucgaag

SEQ ID NO: 78710 - RNA, 23 nt, Artificial Sequence
  Oligomer
acucuccacuuccuucucgaagu

SEQ ID NO: 78711 - RNA, 23 nt, Artificial Sequence
  Oligomer
cuggaaaacgggaaccagcuuuc

SEQ ID NO: 78712 - RNA, 23 nt, Artificial Sequence
  Oligomer
uggaaaacgggaaccagcuuucu

SEQ ID NO: 78713 - RNA, 23 nt, Artificial Sequence
  Oligomer
ggaaaacgggaaccagcuuucuc

SEQ ID NO: 78714 - RNA, 23 nt, Artificial Sequence
  Oligomer
gaaaacgggaaccagcuuucucc

SEQ ID NO: 78715 - RNA, 23 nt, Artificial Sequence
  Oligomer
aaaacgggaaccagcuuucucca

SEQ ID NO: 78716 - RNA, 23 nt, Artificial Sequence
  Oligomer
ucuccaaggacacaggguuuuca

SEQ ID NO: 78717 - RNA, 23 nt, Artificial Sequence
  Oligomer
ccacuuccuucucgaagugccaa

SEQ ID NO: 78718 - RNA, 23 nt, Artificial Sequence
  Oligomer
cuccacuuccuucucgaagugcc

SEQ ID NO: 78719 - RNA, 23 nt, Artificial Sequence
  Oligomer
uccacuuccuucucgaagugcca

SEQ ID NO: 78720 - RNA, 23 nt, Artificial Sequence
  Oligomer
gucuguuucugcagcuggauuuc

SEQ ID NO: 78721 - RNA, 23 nt, Artificial Sequence
  Oligomer
ccucuggaaaacgggaaccagcu

SEQ ID NO: 78722 - RNA, 23 nt, Artificial Sequence
  Oligomer
cucuggaaaacgggaaccagcuu

SEQ ID NO: 78723 - RNA, 23 nt, Artificial Sequence
  Oligomer
ucuggaaaacgggaaccagcuuu

SEQ ID NO: 78724 - RNA, 23 nt, Artificial Sequence
  Oligomer
ggcgcugucuuuacucuccacuu

SEQ ID NO: 78725 - RNA, 23 nt, Artificial Sequence
  Oligomer
accagcuuucuccaaggacacag

SEQ ID NO: 78726 - RNA, 23 nt, Artificial Sequence
  Oligomer
ucgcuccaggcgcugucuuuacu

SEQ ID NO: 78727 - RNA, 23 nt, Artificial Sequence
  Oligomer
cgcuccaggcgcugucuuuacuc

SEQ ID NO: 78728 - RNA, 23 nt, Artificial Sequence
  Oligomer
aaacgggaaccagcuuucuccaa

SEQ ID NO: 78729 - RNA, 23 nt, Artificial Sequence
  Oligomer
aacgggaaccagcuuucuccaag

SEQ ID NO: 78730 - RNA, 23 nt, Artificial Sequence
  Oligomer
ccaaggacacaggguuuucacca

SEQ ID NO: 78731 - RNA, 23 nt, Artificial Sequence
  Oligomer
caaggacacaggguuuucaccaa

SEQ ID NO: 78732 - RNA, 23 nt, Artificial Sequence
  Oligomer
aaggacacaggguuuucaccaac

SEQ ID NO: 78733 - RNA, 23 nt, Artificial Sequence
  Oligomer
cucuccacuuccuucucgaagug

SEQ ID NO: 78734 - RNA, 23 nt, Artificial Sequence
  Oligomer
ucuccacuuccuucucgaagugc

SEQ ID NO: 78735 - RNA, 23 nt, Artificial Sequence
  Oligomer
ccccucuggaaaacgggaaccag

SEQ ID NO: 78736 - RNA, 23 nt, Artificial Sequence
  Oligomer
cccucuggaaaacgggaaccagc

SEQ ID NO: 78737 - RNA, 23 nt, Artificial Sequence
  Oligomer
ccccagucccauucuguguuucu

SEQ ID NO: 78738 - RNA, 23 nt, Artificial Sequence
  Oligomer
cccagucccauucuguguuucua

SEQ ID NO: 78739 - RNA, 23 nt, Artificial Sequence
  Oligomer
cuccaaggacacaggguuuucac

SEQ ID NO: 78740 - RNA, 23 nt, Artificial Sequence
  Oligomer
uggggugucuguuucugcagcug

SEQ ID NO: 78741 - RNA, 23 nt, Artificial Sequence
  Oligomer
cuuccccagucccauucuguguu

SEQ ID NO: 78742 - RNA, 23 nt, Artificial Sequence
  Oligomer
uuccccagucccauucuguguuu

SEQ ID NO: 78743 - RNA, 23 nt, Artificial Sequence
  Oligomer
gauuuccaaagggcuuccccagu

SEQ ID NO: 78744 - RNA, 23 nt, Artificial Sequence
  Oligomer
cccccucuggaaaacgggaacca

SEQ ID NO: 78745 - RNA, 23 nt, Artificial Sequence
  Oligomer
uauagagcuguauguaaauagca

SEQ ID NO: 78746 - RNA, 23 nt, Artificial Sequence
  Oligomer
uuggggugucuguuucugcagcu

SEQ ID NO: 78747 - RNA, 19 nt, Artificial Sequence
  Oligomer
caauacugacccucuuuac

SEQ ID NO: 78748 - RNA, 19 nt, Artificial Sequence
  Oligomer
acacgaucgagaaacugaa

SEQ ID NO: 78749 - RNA, 19 nt, Artificial Sequence
  Oligomer
ugaagaagaggaagagaaa

SEQ ID NO: 78750 - RNA, 19 nt, Artificial Sequence
  Oligomer
ccauguuacuuuauucaga

SEQ ID NO: 78751 - RNA, 19 nt, Artificial Sequence
  Oligomer
cauccuagugggaacuaaa

SEQ ID NO: 78752 - RNA, 19 nt, Artificial Sequence
  Oligomer
caaugcauuuccuggagaa

SEQ ID NO: 78753 - RNA, 19 nt, Artificial Sequence
  Oligomer
cacggguaaaaacucuaaa

SEQ ID NO: 78754 - RNA, 19 nt, Artificial Sequence
  Oligomer
aaaugacaagccuucuuaa

SEQ ID NO: 78755 - RNA, 19 nt, Artificial Sequence
  Oligomer
caauguuaugguagaugga

SEQ ID NO: 78756 - RNA, 19 nt, Artificial Sequence
  Oligomer
ccuggagaauauaucccua

SEQ ID NO: 78757 - RNA, 19 nt, Artificial Sequence
  Oligomer
uguuaugguagauggaaaa

SEQ ID NO: 78758 - RNA, 19 nt, Artificial Sequence
  Oligomer
gaaagugucacggguaaaa

SEQ ID NO: 78759 - RNA, 19 nt, Artificial Sequence
  Oligomer
cgagcacugaacuuugcaa

SEQ ID NO: 78760 - RNA, 19 nt, Artificial Sequence
  Oligomer
acggguaaaaacucuaaaa

SEQ ID NO: 78761 - RNA, 19 nt, Artificial Sequence
  Oligomer
ccauucuuguucagauuaa

SEQ ID NO: 78762 - RNA, 19 nt, Artificial Sequence
  Oligomer
caaagacaguauuuugaca

SEQ ID NO: 78763 - RNA, 19 nt, Artificial Sequence
  Oligomer
gagaacaccgagcacugaa

SEQ ID NO: 78764 - RNA, 19 nt, Artificial Sequence
  Oligomer
auguuaugguagauggaaa

SEQ ID NO: 78765 - RNA, 19 nt, Artificial Sequence
  Oligomer
cuaugaaccuucuuaacau

SEQ ID NO: 78766 - RNA, 19 nt, Artificial Sequence
  Oligomer
gcuuuugcggagauuuuga

SEQ ID NO: 78767 - RNA, 19 nt, Artificial Sequence
  Oligomer
aguagaugaugaaagaaag

SEQ ID NO: 78768 - RNA, 19 nt, Artificial Sequence
  Oligomer
ugaucaaaggacaaagaca

SEQ ID NO: 78769 - RNA, 19 nt, Artificial Sequence
  Oligomer
ccuucugaacuacacugca

SEQ ID NO: 78770 - RNA, 19 nt, Artificial Sequence
  Oligomer
gauaaagacacgaucgaga

SEQ ID NO: 78771 - RNA, 19 nt, Artificial Sequence
  Oligomer
gcauuuccuggagaauaua

SEQ ID NO: 78772 - RNA, 19 nt, Artificial Sequence
  Oligomer
cauuguugugccgagaaca

SEQ ID NO: 78773 - RNA, 19 nt, Artificial Sequence
  Oligomer
cucagaugcguaaagcaga

SEQ ID NO: 78774 - RNA, 19 nt, Artificial Sequence
  Oligomer
gugcaaagugguauccuga

SEQ ID NO: 78775 - RNA, 19 nt, Artificial Sequence
  Oligomer
cauguguugcagcuuuaua

SEQ ID NO: 78776 - RNA, 19 nt, Artificial Sequence
  Oligomer
aauacgaaguggagauuua

SEQ ID NO: 78777 - RNA, 19 nt, Artificial Sequence
  Oligomer
cuuugugauuucauagcga

SEQ ID NO: 78778 - RNA, 19 nt, Artificial Sequence
  Oligomer
gcuguaaaauaccuggagu

SEQ ID NO: 78779 - RNA, 19 nt, Artificial Sequence
  Oligomer
gguaaaaacucuaaaaggu

SEQ ID NO: 78780 - RNA, 19 nt, Artificial Sequence
  Oligomer
uaaagacacgaucgagaaa

SEQ ID NO: 78781 - RNA, 19 nt, Artificial Sequence
  Oligomer
gcuaauaagugcuuuccuu

SEQ ID NO: 78782 - RNA, 19 nt, Artificial Sequence
  Oligomer
ugcuuuccauguuacuuua

SEQ ID NO: 78783 - RNA, 19 nt, Artificial Sequence
  Oligomer
ccuacugaucaguuacaca

SEQ ID NO: 78784 - RNA, 19 nt, Artificial Sequence
  Oligomer
ucacggguaaaaacucuaa

SEQ ID NO: 78785 - RNA, 19 nt, Artificial Sequence
  Oligomer
gaaugaaagugucacgggu

SEQ ID NO: 78786 - RNA, 19 nt, Artificial Sequence
  Oligomer
aaaugccugcuguuguaaa

SEQ ID NO: 78787 - RNA, 19 nt, Artificial Sequence
  Oligomer
gccucaagacaguguuuga

SEQ ID NO: 78788 - RNA, 19 nt, Artificial Sequence
  Oligomer
cgugcaaagugguauccug

SEQ ID NO: 78789 - RNA, 19 nt, Artificial Sequence
  Oligomer
agcuggacaagaagauuau

SEQ ID NO: 78790 - RNA, 19 nt, Artificial Sequence
  Oligomer
uaguaaaagugcuuuccau

SEQ ID NO: 78791 - RNA, 19 nt, Artificial Sequence
  Oligomer
aaagugucacggguaaaaa

SEQ ID NO: 78792 - RNA, 19 nt, Artificial Sequence
  Oligomer
ugaaagugucacggguaaa

SEQ ID NO: 78793 - RNA, 19 nt, Artificial Sequence
  Oligomer
gaacagccucccgaaugaa

SEQ ID NO: 78794 - RNA, 19 nt, Artificial Sequence
  Oligomer
uguaguucucagaugcgua

SEQ ID NO: 78795 - RNA, 19 nt, Artificial Sequence
  Oligomer
guaagaguucagacucaca

SEQ ID NO: 78796 - RNA, 19 nt, Artificial Sequence
  Oligomer
cgugaagaagaggaagaga

SEQ ID NO: 78797 - RNA, 19 nt, Artificial Sequence
  Oligomer
gaaucugggcuuaugggau

SEQ ID NO: 78798 - RNA, 19 nt, Artificial Sequence
  Oligomer
guuacuuuauucagagcua

SEQ ID NO: 78799 - RNA, 19 nt, Artificial Sequence
  Oligomer
aaaagugcuuuccauguua

SEQ ID NO: 78800 - RNA, 19 nt, Artificial Sequence
  Oligomer
gacaaagacaguauuuuga

SEQ ID NO: 78801 - RNA, 19 nt, Artificial Sequence
  Oligomer
caaaggacaaagacaguau

SEQ ID NO: 78802 - RNA, 19 nt, Artificial Sequence
  Oligomer
ccaacuuuuuguuacagau

SEQ ID NO: 78803 - RNA, 19 nt, Artificial Sequence
  Oligomer
cacucaaugccaacuuuuu

SEQ ID NO: 78804 - RNA, 19 nt, Artificial Sequence
  Oligomer
gacacgaucgagaaacuga

SEQ ID NO: 78805 - RNA, 19 nt, Artificial Sequence
  Oligomer
uagugggaacuaaacuuga

SEQ ID NO: 78806 - RNA, 19 nt, Artificial Sequence
  Oligomer
cuuaguaagugcuuuucuu

SEQ ID NO: 78807 - RNA, 19 nt, Artificial Sequence
  Oligomer
aguggagauuuacacuaca

SEQ ID NO: 78808 - RNA, 19 nt, Artificial Sequence
  Oligomer
acguguucccgacauaaca

SEQ ID NO: 78809 - RNA, 19 nt, Artificial Sequence
  Oligomer
aaugacaagccuucuuaaa

SEQ ID NO: 78810 - RNA, 19 nt, Artificial Sequence
  Oligomer
gugaagaagaggaagagaa

SEQ ID NO: 78811 - RNA, 19 nt, Artificial Sequence
  Oligomer
auaaagacacgaucgagaa

SEQ ID NO: 78812 - RNA, 19 nt, Artificial Sequence
  Oligomer
cggugaaucugggcuuaug

SEQ ID NO: 78813 - RNA, 19 nt, Artificial Sequence
  Oligomer
caguuaggaggugcagaca

SEQ ID NO: 78814 - RNA, 19 nt, Artificial Sequence
  Oligomer
ugucaaaugcaguagauga

SEQ ID NO: 78815 - RNA, 19 nt, Artificial Sequence
  Oligomer
caaaauacgaaguggagau

SEQ ID NO: 78816 - RNA, 19 nt, Artificial Sequence
  Oligomer
ugacaaaauacgaagugga

SEQ ID NO: 78817 - RNA, 19 nt, Artificial Sequence
  Oligomer
ggacaaagacaguauuuug

SEQ ID NO: 78818 - RNA, 19 nt, Artificial Sequence
  Oligomer
gauuggugcuguaaaauac

SEQ ID NO: 78819 - RNA, 19 nt, Artificial Sequence
  Oligomer
caacacucccaucauccua

SEQ ID NO: 78820 - RNA, 19 nt, Artificial Sequence
  Oligomer
cuuaugggauacagcugga

SEQ ID NO: 78821 - RNA, 19 nt, Artificial Sequence
  Oligomer
cugccaauguuaugguaga

SEQ ID NO: 78822 - RNA, 19 nt, Artificial Sequence
  Oligomer
caauuauucugccaauguu

SEQ ID NO: 78823 - RNA, 19 nt, Artificial Sequence
  Oligomer
ugaucaguuacacaaccaa

SEQ ID NO: 78824 - RNA, 19 nt, Artificial Sequence
  Oligomer
aaugcaguagaugaugaaa

SEQ ID NO: 78825 - RNA, 19 nt, Artificial Sequence
  Oligomer
ugugaucaaaggacaaaga

SEQ ID NO: 78826 - RNA, 19 nt, Artificial Sequence
  Oligomer
cauuguacuguaauggagu

SEQ ID NO: 78827 - RNA, 19 nt, Artificial Sequence
  Oligomer
cccgugaagaagaggaaga

SEQ ID NO: 78828 - RNA, 19 nt, Artificial Sequence
  Oligomer
augggauacagcuggacaa

SEQ ID NO: 78829 - RNA, 19 nt, Artificial Sequence
  Oligomer
ugcauuuccuggagaauau

SEQ ID NO: 78830 - RNA, 19 nt, Artificial Sequence
  Oligomer
guugcagcuuuauaguuuu

SEQ ID NO: 78831 - RNA, 19 nt, Artificial Sequence
  Oligomer
uaugccuccuuguauuaua

SEQ ID NO: 78832 - RNA, 19 nt, Artificial Sequence
  Oligomer
aaugaagcguugccauuga

SEQ ID NO: 78833 - RNA, 19 nt, Artificial Sequence
  Oligomer
agaacagccucccgaauga

SEQ ID NO: 78834 - RNA, 19 nt, Artificial Sequence
  Oligomer
gacgguagcuucugcaguu

SEQ ID NO: 78835 - RNA, 19 nt, Artificial Sequence
  Oligomer
agaggaagagaaaaugccu

SEQ ID NO: 78836 - RNA, 19 nt, Artificial Sequence
  Oligomer
cuacugucuuugacaauua

SEQ ID NO: 78837 - RNA, 19 nt, Artificial Sequence
  Oligomer
gucacggguaaaaacucua

SEQ ID NO: 78838 - RNA, 19 nt, Artificial Sequence
  Oligomer
guggagauuuacacuacau

SEQ ID NO: 78839 - RNA, 19 nt, Artificial Sequence
  Oligomer
cuuagggaugauaaagaca

SEQ ID NO: 78840 - RNA, 19 nt, Artificial Sequence
  Oligomer
uugaaaauguccgugcaaa

SEQ ID NO: 78841 - RNA, 19 nt, Artificial Sequence
  Oligomer
gggauacagcuggacaaga

SEQ ID NO: 78842 - RNA, 19 nt, Artificial Sequence
  Oligomer
acaguugcagaauugugga

SEQ ID NO: 78843 - RNA, 19 nt, Artificial Sequence
  Oligomer
agucgcuuugccuauugau

SEQ ID NO: 78844 - RNA, 19 nt, Artificial Sequence
  Oligomer
agaagguuuuuuugucgau

SEQ ID NO: 78845 - RNA, 19 nt, Artificial Sequence
  Oligomer
ucuguuagucgcuaacuua

SEQ ID NO: 78846 - RNA, 19 nt, Artificial Sequence
  Oligomer
ggguaaaaacucuaaaagg

SEQ ID NO: 78847 - RNA, 19 nt, Artificial Sequence
  Oligomer
gaagcguugccauugaacu

SEQ ID NO: 78848 - RNA, 19 nt, Artificial Sequence
  Oligomer
gccaacuuuuuguuacaga

SEQ ID NO: 78849 - RNA, 19 nt, Artificial Sequence
  Oligomer
aaugccugcuguuguaaau

SEQ ID NO: 78850 - RNA, 19 nt, Artificial Sequence
  Oligomer
cucccgugaagaagaggaa

SEQ ID NO: 78851 - RNA, 19 nt, Artificial Sequence
  Oligomer
aaucugggcuuaugggaua

SEQ ID NO: 78852 - RNA, 19 nt, Artificial Sequence
  Oligomer
gguuguucuguuagucgcu

SEQ ID NO: 78853 - RNA, 19 nt, Artificial Sequence
  Oligomer
acaaggaaugaaaguguca

SEQ ID NO: 78854 - RNA, 19 nt, Artificial Sequence
  Oligomer
ugugugugaucaaaggaca

SEQ ID NO: 78855 - RNA, 19 nt, Artificial Sequence
  Oligomer
gucccaacacucccaucau

SEQ ID NO: 78856 - RNA, 19 nt, Artificial Sequence
  Oligomer
ugaaaauguccgugcaaag

SEQ ID NO: 78857 - RNA, 19 nt, Artificial Sequence
  Oligomer
gaucaguuacacaaccaau

SEQ ID NO: 78858 - RNA, 19 nt, Artificial Sequence
  Oligomer
ggagauuuacacuacauug

SEQ ID NO: 78859 - RNA, 19 nt, Artificial Sequence
  Oligomer
aaaggacaaagacaguauu

SEQ ID NO: 78860 - RNA, 19 nt, Artificial Sequence
  Oligomer
agcugacucccaucaccua

SEQ ID NO: 78861 - RNA, 19 nt, Artificial Sequence
  Oligomer
ccaacacucccaucauccu

SEQ ID NO: 78862 - RNA, 19 nt, Artificial Sequence
  Oligomer
cggguaaaaacucuaaaag

SEQ ID NO: 78863 - RNA, 19 nt, Artificial Sequence
  Oligomer
ggugugugugaucaaagga

SEQ ID NO: 78864 - RNA, 19 nt, Artificial Sequence
  Oligomer
gugaguuagcagcacgugu

SEQ ID NO: 78865 - RNA, 19 nt, Artificial Sequence
  Oligomer
cuaaauguaagaguucaga

SEQ ID NO: 78866 - RNA, 19 nt, Artificial Sequence
  Oligomer
gaaggagaagaagcugacu

SEQ ID NO: 78867 - RNA, 19 nt, Artificial Sequence
  Oligomer
auuugaaaauguccgugca

SEQ ID NO: 78868 - RNA, 19 nt, Artificial Sequence
  Oligomer
accggugaaucugggcuua

SEQ ID NO: 78869 - RNA, 19 nt, Artificial Sequence
  Oligomer
guuagucgcuaacuuagua

SEQ ID NO: 78870 - RNA, 19 nt, Artificial Sequence
  Oligomer
agaaagguugguauuauca

SEQ ID NO: 78871 - RNA, 19 nt, Artificial Sequence
  Oligomer
uggagauuuacacuacauu

SEQ ID NO: 78872 - RNA, 19 nt, Artificial Sequence
  Oligomer
uacgaaguggagauuuaca

SEQ ID NO: 78873 - RNA, 19 nt, Artificial Sequence
  Oligomer
gacaaaauacgaaguggag

SEQ ID NO: 78874 - RNA, 19 nt, Artificial Sequence
  Oligomer
agcucagcucuuuggauca

SEQ ID NO: 78875 - RNA, 19 nt, Artificial Sequence
  Oligomer
ggugcuguaaaauaccugg

SEQ ID NO: 78876 - RNA, 19 nt, Artificial Sequence
  Oligomer
ccggugaaucugggcuuau

SEQ ID NO: 78877 - RNA, 19 nt, Artificial Sequence
  Oligomer
guuuugcauguaugacuua

SEQ ID NO: 78878 - RNA, 19 nt, Artificial Sequence
  Oligomer
aauugacaguugcagaauu

SEQ ID NO: 78879 - RNA, 19 nt, Artificial Sequence
  Oligomer
uagucgcuuugccuauuga

SEQ ID NO: 78880 - RNA, 19 nt, Artificial Sequence
  Oligomer
gucacuugaccaauacuga

SEQ ID NO: 78881 - RNA, 19 nt, Artificial Sequence
  Oligomer
gaagguuuuuuugucgauu

SEQ ID NO: 78882 - RNA, 19 nt, Artificial Sequence
  Oligomer
uuguucuguuagucgcuaa

SEQ ID NO: 78883 - RNA, 19 nt, Artificial Sequence
  Oligomer
gaaagguugguauuaucag

SEQ ID NO: 78884 - RNA, 19 nt, Artificial Sequence
  Oligomer
augaaagugucacggguaa

SEQ ID NO: 78885 - RNA, 19 nt, Artificial Sequence
  Oligomer
cgaaguggagauuuacacu

SEQ ID NO: 78886 - RNA, 19 nt, Artificial Sequence
  Oligomer
acaaaauacgaaguggaga

SEQ ID NO: 78887 - RNA, 19 nt, Artificial Sequence
  Oligomer
gaucaaaggacaaagacag

SEQ ID NO: 78888 - RNA, 19 nt, Artificial Sequence
  Oligomer
guagcuucugcaguuagga

SEQ ID NO: 78889 - RNA, 19 nt, Artificial Sequence
  Oligomer
ggccauuuccuguuucucu

SEQ ID NO: 78890 - RNA, 19 nt, Artificial Sequence
  Oligomer
gaagauuaugacagauuac

SEQ ID NO: 78891 - RNA, 19 nt, Artificial Sequence
  Oligomer
gauacagcuggacaagaag

SEQ ID NO: 78892 - RNA, 19 nt, Artificial Sequence
  Oligomer
uuaaauugacaguugcaga

SEQ ID NO: 78893 - RNA, 19 nt, Artificial Sequence
  Oligomer
cuuaaacuaugaaccuucu

SEQ ID NO: 78894 - RNA, 19 nt, Artificial Sequence
  Oligomer
gguuaauuucugucaaaug

SEQ ID NO: 78895 - RNA, 19 nt, Artificial Sequence
  Oligomer
gauuuacacuacauuguac

SEQ ID NO: 78896 - RNA, 19 nt, Artificial Sequence
  Oligomer
ccugcuguuguaaaugucu

SEQ ID NO: 78897 - RNA, 19 nt, Artificial Sequence
  Oligomer
aagacacgaucgagaaacu

SEQ ID NO: 78898 - RNA, 19 nt, Artificial Sequence
  Oligomer
uuugaaaauguccgugcaa

SEQ ID NO: 78899 - RNA, 19 nt, Artificial Sequence
  Oligomer
gaucuuuugcuaaugcaau

SEQ ID NO: 78900 - RNA, 19 nt, Artificial Sequence
  Oligomer
guuacacaaccaaugcauu

SEQ ID NO: 78901 - RNA, 19 nt, Artificial Sequence
  Oligomer
aagugucacggguaaaaac

SEQ ID NO: 78902 - RNA, 19 nt, Artificial Sequence
  Oligomer
uuuggaucagucuuuguga

SEQ ID NO: 78903 - RNA, 19 nt, Artificial Sequence
  Oligomer
uaauggagugagcguagca

SEQ ID NO: 78904 - RNA, 19 nt, Artificial Sequence
  Oligomer
gcuucugcaguuaggaggu

SEQ ID NO: 78905 - RNA, 19 nt, Artificial Sequence
  Oligomer
gguagcuucugcaguuagg

SEQ ID NO: 78906 - RNA, 19 nt, Artificial Sequence
  Oligomer
acgguagcuucugcaguua

SEQ ID NO: 78907 - RNA, 19 nt, Artificial Sequence
  Oligomer
caccgagcacugaacuuug

SEQ ID NO: 78908 - RNA, 19 nt, Artificial Sequence
  Oligomer
cacgaucgagaaacugaag

SEQ ID NO: 78909 - RNA, 19 nt, Artificial Sequence
  Oligomer
ggugaaucugggcuuaugg

SEQ ID NO: 78910 - RNA, 19 nt, Artificial Sequence
  Oligomer
gcugacgauguucuguaca

SEQ ID NO: 78911 - RNA, 19 nt, Artificial Sequence
  Oligomer
cuaauaagugcuuuccuua

SEQ ID NO: 78912 - RNA, 19 nt, Artificial Sequence
  Oligomer
cauguuacuuuauucagag

SEQ ID NO: 78913 - RNA, 19 nt, Artificial Sequence
  Oligomer
gguuuuuuugucgauuagu

SEQ ID NO: 78914 - RNA, 19 nt, Artificial Sequence
  Oligomer
gcauuagaagguuuuuuug

SEQ ID NO: 78915 - RNA, 19 nt, Artificial Sequence
  Oligomer
aaaacuugccuacugauca

SEQ ID NO: 78916 - RNA, 19 nt, Artificial Sequence
  Oligomer
agaugcguaaagcagaaca

SEQ ID NO: 78917 - RNA, 19 nt, Artificial Sequence
  Oligomer
cgguagcuucugcaguuag

SEQ ID NO: 78918 - RNA, 19 nt, Artificial Sequence
  Oligomer
aagaguucagacucacauu

SEQ ID NO: 78919 - RNA, 19 nt, Artificial Sequence
  Oligomer
aaggagauuggugcuguaa

SEQ ID NO: 78920 - RNA, 19 nt, Artificial Sequence
  Oligomer
ggaugauaaagacacgauc

SEQ ID NO: 78921 - RNA, 19 nt, Artificial Sequence
  Oligomer
uugaucuuagggaugauaa

SEQ ID NO: 78922 - RNA, 19 nt, Artificial Sequence
  Oligomer
cuggacaagaagauuauga

SEQ ID NO: 78923 - RNA, 19 nt, Artificial Sequence
  Oligomer
gggcuuaugggauacagcu

SEQ ID NO: 78924 - RNA, 19 nt, Artificial Sequence
  Oligomer
aauguuaugguagauggaa

SEQ ID NO: 78925 - RNA, 19 nt, Artificial Sequence
  Oligomer
gugugaucaaaggacaaag

SEQ ID NO: 78926 - RNA, 19 nt, Artificial Sequence
  Oligomer
agaaaaugccugcuguugu

SEQ ID NO: 78927 - RNA, 19 nt, Artificial Sequence
  Oligomer
cauggcuaaggagauuggu

SEQ ID NO: 78928 - RNA, 19 nt, Artificial Sequence
  Oligomer
agggaugauaaagacacga

SEQ ID NO: 78929 - RNA, 19 nt, Artificial Sequence
  Oligomer
ugaaucugggcuuauggga

SEQ ID NO: 78930 - RNA, 19 nt, Artificial Sequence
  Oligomer
auuguggaguguuuuuaca

SEQ ID NO: 78931 - RNA, 19 nt, Artificial Sequence
  Oligomer
cauuuccuggagaauauau

SEQ ID NO: 78932 - RNA, 19 nt, Artificial Sequence
  Oligomer
uguuccuuugggucuguga

SEQ ID NO: 78933 - RNA, 19 nt, Artificial Sequence
  Oligomer
ugaccaauacugacccucu

SEQ ID NO: 78934 - RNA, 19 nt, Artificial Sequence
  Oligomer
aagcuuuuccuuucucuua

SEQ ID NO: 78935 - RNA, 19 nt, Artificial Sequence
  Oligomer
ccgagcacugaacuuugca

SEQ ID NO: 78936 - RNA, 19 nt, Artificial Sequence
  Oligomer
gcggccauuuccuguuucu

SEQ ID NO: 78937 - RNA, 19 nt, Artificial Sequence
  Oligomer
ggaaaaccggugaaucugg

SEQ ID NO: 78938 - RNA, 19 nt, Artificial Sequence
  Oligomer
cuugaccaauacugacccu

SEQ ID NO: 78939 - RNA, 19 nt, Artificial Sequence
  Oligomer
cagauuaccgacacuguca

SEQ ID NO: 78940 - RNA, 19 nt, Artificial Sequence
  Oligomer
agguuuuuuugucgauuag

SEQ ID NO: 78941 - RNA, 19 nt, Artificial Sequence
  Oligomer
gauaaugcauuagaagguu

SEQ ID NO: 78942 - RNA, 19 nt, Artificial Sequence
  Oligomer
gagcaauaugccuccuugu

SEQ ID NO: 78943 - RNA, 19 nt, Artificial Sequence
  Oligomer
aacugguuguucuguuagu

SEQ ID NO: 78944 - RNA, 19 nt, Artificial Sequence
  Oligomer
uaaacugguuguucuguua

SEQ ID NO: 78945 - RNA, 19 nt, Artificial Sequence
  Oligomer
cuauuuccucuaaugaaga

SEQ ID NO: 78946 - RNA, 19 nt, Artificial Sequence
  Oligomer
aacauuguacuguaaugga

SEQ ID NO: 78947 - RNA, 19 nt, Artificial Sequence
  Oligomer
aaauaccuucugaacuaca

SEQ ID NO: 78948 - RNA, 19 nt, Artificial Sequence
  Oligomer
cauucuuguucagauuaag

SEQ ID NO: 78949 - RNA, 19 nt, Artificial Sequence
  Oligomer
caaugccaacuuuuuguua

SEQ ID NO: 78950 - RNA, 19 nt, Artificial Sequence
  Oligomer
gaggccucaagacaguguu

SEQ ID NO: 78951 - RNA, 19 nt, Artificial Sequence
  Oligomer
uaccgacacugucacuuga

SEQ ID NO: 78952 - RNA, 19 nt, Artificial Sequence
  Oligomer
gcuuuccauguuacuuuau

SEQ ID NO: 78953 - RNA, 19 nt, Artificial Sequence
  Oligomer
cuaacuuaguaagugcuuu

SEQ ID NO: 78954 - RNA, 19 nt, Artificial Sequence
  Oligomer
guuaggaggugcagacacu

SEQ ID NO: 78955 - RNA, 19 nt, Artificial Sequence
  Oligomer
cccauucuuguucagauua

SEQ ID NO: 78956 - RNA, 19 nt, Artificial Sequence
  Oligomer
ccgugaagaagaggaagag

SEQ ID NO: 78957 - RNA, 19 nt, Artificial Sequence
  Oligomer
gaaaauguccgugcaaagu

SEQ ID NO: 78958 - RNA, 19 nt, Artificial Sequence
  Oligomer
gcuggacaagaagauuaug

SEQ ID NO: 78959 - RNA, 19 nt, Artificial Sequence
  Oligomer
gguagauggaaaaccggug

SEQ ID NO: 78960 - RNA, 19 nt, Artificial Sequence
  Oligomer
ccaaugcauuuccuggaga

SEQ ID NO: 78961 - RNA, 19 nt, Artificial Sequence
  Oligomer
uguguugcagcuuuauagu

SEQ ID NO: 78962 - RNA, 19 nt, Artificial Sequence
  Oligomer
guuguucuguuagucgcua

SEQ ID NO: 78963 - RNA, 19 nt, Artificial Sequence
  Oligomer
aagaaagguugguauuauc

SEQ ID NO: 78964 - RNA, 19 nt, Artificial Sequence
  Oligomer
gagauuuacacuacauugu

SEQ ID NO: 78965 - RNA, 19 nt, Artificial Sequence
  Oligomer
agcuguagguaaaacuugc

SEQ ID NO: 78966 - RNA, 19 nt, Artificial Sequence
  Oligomer
uuuugaacagaacugcuau

SEQ ID NO: 78967 - RNA, 19 nt, Artificial Sequence
  Oligomer
uaguucucagaugcguaaa

SEQ ID NO: 78968 - RNA, 19 nt, Artificial Sequence
  Oligomer
gaagacgguagcuucugca

SEQ ID NO: 78969 - RNA, 19 nt, Artificial Sequence
  Oligomer
aggccucaagacaguguuu

SEQ ID NO: 78970 - RNA, 19 nt, Artificial Sequence
  Oligomer
gagaagaagcugacuccca

SEQ ID NO: 78971 - RNA, 19 nt, Artificial Sequence
  Oligomer
cugaaggagaagaagcuga

SEQ ID NO: 78972 - RNA, 19 nt, Artificial Sequence
  Oligomer
caaagugguauccugaggu

SEQ ID NO: 78973 - RNA, 19 nt, Artificial Sequence
  Oligomer
auguccgugcaaaguggua

SEQ ID NO: 78974 - RNA, 19 nt, Artificial Sequence
  Oligomer
uugugaguccugcaucauu

SEQ ID NO: 78975 - RNA, 19 nt, Artificial Sequence
  Oligomer
auuugcuuuucccuuguga

SEQ ID NO: 78976 - RNA, 19 nt, Artificial Sequence
  Oligomer
guaagugcuuuucuuauag

SEQ ID NO: 78977 - RNA, 19 nt, Artificial Sequence
  Oligomer
cuguuagucgcuaacuuag

SEQ ID NO: 78978 - RNA, 19 nt, Artificial Sequence
  Oligomer
cuuucucuuacaccugcca

SEQ ID NO: 78979 - RNA, 19 nt, Artificial Sequence
  Oligomer
gagcggccauuuccuguuu

SEQ ID NO: 78980 - RNA, 19 nt, Artificial Sequence
  Oligomer
gaaguggagauuuacacua

SEQ ID NO: 78981 - RNA, 19 nt, Artificial Sequence
  Oligomer
gcguaaagcagaacagccu

SEQ ID NO: 78982 - RNA, 19 nt, Artificial Sequence
  Oligomer
gaugcguaaagcagaacag

SEQ ID NO: 78983 - RNA, 19 nt, Artificial Sequence
  Oligomer
gaacaccgagcacugaacu

SEQ ID NO: 78984 - RNA, 19 nt, Artificial Sequence
  Oligomer
agaacaccgagcacugaac

SEQ ID NO: 78985 - RNA, 19 nt, Artificial Sequence
  Oligomer
gccauuuccuguuucucug

SEQ ID NO: 78986 - RNA, 19 nt, Artificial Sequence
  Oligomer
aagagaaaaugccugcugu

SEQ ID NO: 78987 - RNA, 19 nt, Artificial Sequence
  Oligomer
ucuuagggaugauaaagac

SEQ ID NO: 78988 - RNA, 19 nt, Artificial Sequence
  Oligomer
aucuuagggaugauaaaga

SEQ ID NO: 78989 - RNA, 19 nt, Artificial Sequence
  Oligomer
gcaguuuuccucagcuuug

SEQ ID NO: 78990 - RNA, 19 nt, Artificial Sequence
  Oligomer
uggacaagaagauuaugac

SEQ ID NO: 78991 - RNA, 19 nt, Artificial Sequence
  Oligomer
cccuacugucuuugacaau

SEQ ID NO: 78992 - RNA, 19 nt, Artificial Sequence
  Oligomer
ucccuacugucuuugacaa

SEQ ID NO: 78993 - RNA, 19 nt, Artificial Sequence
  Oligomer
ugagguucuguaaacugug

SEQ ID NO: 78994 - RNA, 19 nt, Artificial Sequence
  Oligomer
cacugucuugccagauuac

SEQ ID NO: 78995 - RNA, 19 nt, Artificial Sequence
  Oligomer
caguuacacaaccaaugca

SEQ ID NO: 78996 - RNA, 19 nt, Artificial Sequence
  Oligomer
aagugcuuuccauguuacu

SEQ ID NO: 78997 - RNA, 19 nt, Artificial Sequence
  Oligomer
gcuaacuuaguaagugcuu

SEQ ID NO: 78998 - RNA, 19 nt, Artificial Sequence
  Oligomer
cauugaacucaccagugag

SEQ ID NO: 78999 - RNA, 19 nt, Artificial Sequence
  Oligomer
cuugcucuccuauguaguu

SEQ ID NO: 79000 - RNA, 19 nt, Artificial Sequence
  Oligomer
aagaguugccaaaauaccu

SEQ ID NO: 79001 - RNA, 19 nt, Artificial Sequence
  Oligomer
aaauguaagaguucagacu

SEQ ID NO: 79002 - RNA, 19 nt, Artificial Sequence
  Oligomer
guuugacgaagcgauccga

SEQ ID NO: 79003 - RNA, 19 nt, Artificial Sequence
  Oligomer
augauaaagacacgaucga

SEQ ID NO: 79004 - RNA, 19 nt, Artificial Sequence
  Oligomer
cuucagccacuacaacaga

SEQ ID NO: 79005 - RNA, 19 nt, Artificial Sequence
  Oligomer
cuuaacucacuggcgagaa

SEQ ID NO: 79006 - RNA, 19 nt, Artificial Sequence
  Oligomer
uacugacccucuuuaccuc

SEQ ID NO: 79007 - RNA, 19 nt, Artificial Sequence
  Oligomer
cugucacuugaccaauacu

SEQ ID NO: 79008 - RNA, 19 nt, Artificial Sequence
  Oligomer
cagagcuaauaagugcuuu

SEQ ID NO: 79009 - RNA, 19 nt, Artificial Sequence
  Oligomer
aaagguugguauuaucagg

SEQ ID NO: 79010 - RNA, 19 nt, Artificial Sequence
  Oligomer
gaugaugaaagaaagguug

SEQ ID NO: 79011 - RNA, 19 nt, Artificial Sequence
  Oligomer
aggacaaagacaguauuuu

SEQ ID NO: 79012 - RNA, 19 nt, Artificial Sequence
  Oligomer
gucccuuggaaccuuugua

SEQ ID NO: 79013 - RNA, 19 nt, Artificial Sequence
  Oligomer
cuguaaaauaccuggagug

SEQ ID NO: 79014 - RNA, 19 nt, Artificial Sequence
  Oligomer
uagggaugauaaagacacg

SEQ ID NO: 79015 - RNA, 19 nt, Artificial Sequence
  Oligomer
aaauguccgugcaaagugg

SEQ ID NO: 79016 - RNA, 19 nt, Artificial Sequence
  Oligomer
ccugcaucauuugaaaaug

SEQ ID NO: 79017 - RNA, 19 nt, Artificial Sequence
  Oligomer
cugggcuuaugggauacag

SEQ ID NO: 79018 - RNA, 19 nt, Artificial Sequence
  Oligomer
uccuguagucgcuuugccu

SEQ ID NO: 79019 - RNA, 19 nt, Artificial Sequence
  Oligomer
uguugcagcuuuauaguuu

SEQ ID NO: 79020 - RNA, 19 nt, Artificial Sequence
  Oligomer
guaaaagugcuuuccaugu

SEQ ID NO: 79021 - RNA, 19 nt, Artificial Sequence
  Oligomer
aauaugccuccuuguauua

SEQ ID NO: 79022 - RNA, 19 nt, Artificial Sequence
  Oligomer
agucgcuaacuuaguaagu

SEQ ID NO: 79023 - RNA, 19 nt, Artificial Sequence
  Oligomer
aaacuugccuacugaucag

SEQ ID NO: 79024 - RNA, 19 nt, Artificial Sequence
  Oligomer
auuucugucaaaugcagua

SEQ ID NO: 79025 - RNA, 19 nt, Artificial Sequence
  Oligomer
ugucacggguaaaaacucu

SEQ ID NO: 79026 - RNA, 19 nt, Artificial Sequence
  Oligomer
cagcucuuuggaucagucu

SEQ ID NO: 79027 - RNA, 19 nt, Artificial Sequence
  Oligomer
gaguuagcagcacguguuc

SEQ ID NO: 79028 - RNA, 19 nt, Artificial Sequence
  Oligomer
ucuccuauguaguucucag

SEQ ID NO: 79029 - RNA, 19 nt, Artificial Sequence
  Oligomer
acuugcucuccuauguagu

SEQ ID NO: 79030 - RNA, 19 nt, Artificial Sequence
  Oligomer
cuaaaaugacaagccuucu

SEQ ID NO: 79031 - RNA, 19 nt, Artificial Sequence
  Oligomer
gcacucaaugccaacuuuu

SEQ ID NO: 79032 - RNA, 19 nt, Artificial Sequence
  Oligomer
aaaaugccugcuguuguaa

SEQ ID NO: 79033 - RNA, 19 nt, Artificial Sequence
  Oligomer
gaagaagcugacucccauc

SEQ ID NO: 79034 - RNA, 19 nt, Artificial Sequence
  Oligomer
ugaguccugcaucauuuga

SEQ ID NO: 79035 - RNA, 19 nt, Artificial Sequence
  Oligomer
gacaguugcagaauugugg

SEQ ID NO: 79036 - RNA, 19 nt, Artificial Sequence
  Oligomer
ugucuugccagauuaccga

SEQ ID NO: 79037 - RNA, 19 nt, Artificial Sequence
  Oligomer
aaucauguguugcagcuuu

SEQ ID NO: 79038 - RNA, 19 nt, Artificial Sequence
  Oligomer
gugcuuuccauguuacuuu

SEQ ID NO: 79039 - RNA, 19 nt, Artificial Sequence
  Oligomer
uagaagguuuuuuugucga

SEQ ID NO: 79040 - RNA, 19 nt, Artificial Sequence
  Oligomer
ucugauaaugcauuagaag

SEQ ID NO: 79041 - RNA, 19 nt, Artificial Sequence
  Oligomer
uaagcuuuuccuuucucuu

SEQ ID NO: 79042 - RNA, 19 nt, Artificial Sequence
  Oligomer
aagguugguauuaucagga

SEQ ID NO: 79043 - RNA, 19 nt, Artificial Sequence
  Oligomer
uguagguaaaacuugccua

SEQ ID NO: 79044 - RNA, 19 nt, Artificial Sequence
  Oligomer
uguaauggagugagcguag

SEQ ID NO: 79045 - RNA, 19 nt, Artificial Sequence
  Oligomer
caccagugaguuagcagca

SEQ ID NO: 79046 - RNA, 19 nt, Artificial Sequence
  Oligomer
agacgguagcuucugcagu

SEQ ID NO: 79047 - RNA, 19 nt, Artificial Sequence
  Oligomer
acugcauuguugugccgag

SEQ ID NO: 79048 - RNA, 19 nt, Artificial Sequence
  Oligomer
guucagacucacauucuau

SEQ ID NO: 79049 - RNA, 19 nt, Artificial Sequence
  Oligomer
auguaagaguucagacuca

SEQ ID NO: 79050 - RNA, 19 nt, Artificial Sequence
  Oligomer
gugaguccugcaucauuug

SEQ ID NO: 79051 - RNA, 19 nt, Artificial Sequence
  Oligomer
cuuaauuugcuuuucccuu

SEQ ID NO: 79052 - RNA, 19 nt, Artificial Sequence
  Oligomer
gaaaaccggugaaucuggg

SEQ ID NO: 79053 - RNA, 19 nt, Artificial Sequence
  Oligomer
ugccaauguuaugguagau

SEQ ID NO: 79054 - RNA, 19 nt, Artificial Sequence
  Oligomer
guuucucugcaguuuuccu

SEQ ID NO: 79055 - RNA, 19 nt, Artificial Sequence
  Oligomer
aauuguggaguguuuuuac

SEQ ID NO: 79056 - RNA, 19 nt, Artificial Sequence
  Oligomer
uucuguacaacuuaacuca

SEQ ID NO: 79057 - RNA, 19 nt, Artificial Sequence
  Oligomer
ccuguuucucugcaguuuu

SEQ ID NO: 79058 - RNA, 19 nt, Artificial Sequence
  Oligomer
auguguugcagcuuuauag

SEQ ID NO: 79059 - RNA, 19 nt, Artificial Sequence
  Oligomer
aagugcuuuccuuaguuuu

SEQ ID NO: 79060 - RNA, 19 nt, Artificial Sequence
  Oligomer
guagaugaugaaagaaagg

SEQ ID NO: 79061 - RNA, 19 nt, Artificial Sequence
  Oligomer
agugucacggguaaaaacu

SEQ ID NO: 79062 - RNA, 19 nt, Artificial Sequence
  Oligomer
gagcuguagguaaaacuug

SEQ ID NO: 79063 - RNA, 19 nt, Artificial Sequence
  Oligomer
ucaaaggacaaagacagua

SEQ ID NO: 79064 - RNA, 19 nt, Artificial Sequence
  Oligomer
aucaaaggacaaagacagu

SEQ ID NO: 79065 - RNA, 19 nt, Artificial Sequence
  Oligomer
gauuuugaacagaacugcu

SEQ ID NO: 79066 - RNA, 19 nt, Artificial Sequence
  Oligomer
uugugauuucauagcgagu

SEQ ID NO: 79067 - RNA, 19 nt, Artificial Sequence
  Oligomer
guugccauugaacucacca

SEQ ID NO: 79068 - RNA, 19 nt, Artificial Sequence
  Oligomer
ugcaguuaggaggugcaga

SEQ ID NO: 79069 - RNA, 19 nt, Artificial Sequence
  Oligomer
cuuugagaagacgguagcu

SEQ ID NO: 79070 - RNA, 19 nt, Artificial Sequence
  Oligomer
augccaacuuuuuguuaca

SEQ ID NO: 79071 - RNA, 19 nt, Artificial Sequence
  Oligomer
gaggaagagaaaaugccug

SEQ ID NO: 79072 - RNA, 19 nt, Artificial Sequence
  Oligomer
gacaguguuugacgaagcg

SEQ ID NO: 79073 - RNA, 19 nt, Artificial Sequence
  Oligomer
ugauaaagacacgaucgag

SEQ ID NO: 79074 - RNA, 19 nt, Artificial Sequence
  Oligomer
gcaaagugguauccugagg

SEQ ID NO: 79075 - RNA, 19 nt, Artificial Sequence
  Oligomer
ccgugcaaagugguauccu

SEQ ID NO: 79076 - RNA, 19 nt, Artificial Sequence
  Oligomer
cuugugaguccugcaucau

SEQ ID NO: 79077 - RNA, 19 nt, Artificial Sequence
  Oligomer
uucugccaauguuauggua

SEQ ID NO: 79078 - RNA, 19 nt, Artificial Sequence
  Oligomer
uuguggaguguuuuuacau

SEQ ID NO: 79079 - RNA, 19 nt, Artificial Sequence
  Oligomer
guugcagaauuguggagug

SEQ ID NO: 79080 - RNA, 19 nt, Artificial Sequence
  Oligomer
uucuguaaacugugcuagu

SEQ ID NO: 79081 - RNA, 19 nt, Artificial Sequence
  Oligomer
auacugacccucuuuaccu

SEQ ID NO: 79082 - RNA, 19 nt, Artificial Sequence
  Oligomer
acuaugaaccuucuuaaca

SEQ ID NO: 79083 - RNA, 19 nt, Artificial Sequence
  Oligomer
cuuuccuuaguuuucuagu

SEQ ID NO: 79084 - RNA, 19 nt, Artificial Sequence
  Oligomer
uuaguaaaagugcuuucca

SEQ ID NO: 79085 - RNA, 19 nt, Artificial Sequence
  Oligomer
ugauaaugcauuagaaggu

SEQ ID NO: 79086 - RNA, 19 nt, Artificial Sequence
  Oligomer
uuagucgcuaacuuaguaa

SEQ ID NO: 79087 - RNA, 19 nt, Artificial Sequence
  Oligomer
ugguauuaucaggaaaugu

SEQ ID NO: 79088 - RNA, 19 nt, Artificial Sequence
  Oligomer
aaugaaagugucacgggua

SEQ ID NO: 79089 - RNA, 19 nt, Artificial Sequence
  Oligomer
agucuuugugauuucauag

SEQ ID NO: 79090 - RNA, 19 nt, Artificial Sequence
  Oligomer
aggugcagacacuugcucu

SEQ ID NO: 79091 - RNA, 19 nt, Artificial Sequence
  Oligomer
uugccaaaauaccuucuga

SEQ ID NO: 79092 - RNA, 19 nt, Artificial Sequence
  Oligomer
cucaaugccaacuuuuugu

SEQ ID NO: 79093 - RNA, 19 nt, Artificial Sequence
  Oligomer
acaguguuugacgaagcga

SEQ ID NO: 79094 - RNA, 19 nt, Artificial Sequence
  Oligomer
ugcaaagugguauccugag

SEQ ID NO: 79095 - RNA, 19 nt, Artificial Sequence
  Oligomer
uucagccacuacaacagaa

SEQ ID NO: 79096 - RNA, 19 nt, Artificial Sequence
  Oligomer
augcauuuccuggagaaua

SEQ ID NO: 79097 - RNA, 19 nt, Artificial Sequence
  Oligomer
ucgcuuugccuauugaugu

SEQ ID NO: 79098 - RNA, 19 nt, Artificial Sequence
  Oligomer
aguaaaagugcuuuccaug

SEQ ID NO: 79099 - RNA, 19 nt, Artificial Sequence
  Oligomer
aaggacaaagacaguauuu

SEQ ID NO: 79100 - RNA, 19 nt, Artificial Sequence
  Oligomer
acuguaauggagugagcgu

SEQ ID NO: 79101 - RNA, 19 nt, Artificial Sequence
  Oligomer
ugaagcguugccauugaac

SEQ ID NO: 79102 - RNA, 19 nt, Artificial Sequence
  Oligomer
aguucucagaugcguaaag

SEQ ID NO: 79103 - RNA, 19 nt, Artificial Sequence
  Oligomer
cuauguaguucucagaugc

SEQ ID NO: 79104 - RNA, 19 nt, Artificial Sequence
  Oligomer
ugagaagacgguagcuucu

SEQ ID NO: 79105 - RNA, 19 nt, Artificial Sequence
  Oligomer
gaagaggaagagaaaaugc

SEQ ID NO: 79106 - RNA, 19 nt, Artificial Sequence
  Oligomer
ccaucaagugugugguggu

SEQ ID NO: 79107 - RNA, 19 nt, Artificial Sequence
  Oligomer
ugcaggccaucaagugugu

SEQ ID NO: 79108 - RNA, 19 nt, Artificial Sequence
  Oligomer
uguccgugcaaagugguau

SEQ ID NO: 79109 - RNA, 19 nt, Artificial Sequence
  Oligomer
acagcuggacaagaagauu

SEQ ID NO: 79110 - RNA, 19 nt, Artificial Sequence
  Oligomer
uaugggauacagcuggaca

SEQ ID NO: 79111 - RNA, 19 nt, Artificial Sequence
  Oligomer
uucucugcaguuuuccuca

SEQ ID NO: 79112 - RNA, 19 nt, Artificial Sequence
  Oligomer
auaucccuacugucuuuga

SEQ ID NO: 79113 - RNA, 19 nt, Artificial Sequence
  Oligomer
aauauaucccuacugucuu

SEQ ID NO: 79114 - RNA, 19 nt, Artificial Sequence
  Oligomer
agaauauaucccuacuguc

SEQ ID NO: 79115 - RNA, 19 nt, Artificial Sequence
  Oligomer
uggagaauauaucccuacu

SEQ ID NO: 79116 - RNA, 19 nt, Artificial Sequence
  Oligomer
gugcuagugcugacgaugu

SEQ ID NO: 79117 - RNA, 19 nt, Artificial Sequence
  Oligomer
gauguuccuuugggucugu

SEQ ID NO: 79118 - RNA, 19 nt, Artificial Sequence
  Oligomer
ucacuugaccaauacugac

SEQ ID NO: 79119 - RNA, 19 nt, Artificial Sequence
  Oligomer
guguugcagcuuuauaguu

SEQ ID NO: 79120 - RNA, 19 nt, Artificial Sequence
  Oligomer
uucuguuagucgcuaacuu

SEQ ID NO: 79121 - RNA, 19 nt, Artificial Sequence
  Oligomer
uucugucaaaugcaguaga

SEQ ID NO: 79122 - RNA, 19 nt, Artificial Sequence
  Oligomer
gugucacggguaaaaacuc

SEQ ID NO: 79123 - RNA, 19 nt, Artificial Sequence
  Oligomer
aucagucuuugugauuuca

SEQ ID NO: 79124 - RNA, 19 nt, Artificial Sequence
  Oligomer
cucuccuauguaguucuca

SEQ ID NO: 79125 - RNA, 19 nt, Artificial Sequence
  Oligomer
cuuggaaccuuuguacgcu

SEQ ID NO: 79126 - RNA, 19 nt, Artificial Sequence
  Oligomer
ccuacugucuuugacaauu

SEQ ID NO: 79127 - RNA, 19 nt, Artificial Sequence
  Oligomer
uaacucacuggcgagaaua

SEQ ID NO: 79128 - RNA, 19 nt, Artificial Sequence
  Oligomer
gacgauguucuguacaacu

SEQ ID NO: 79129 - RNA, 19 nt, Artificial Sequence
  Oligomer
acugugcuagugcugacga

SEQ ID NO: 79130 - RNA, 19 nt, Artificial Sequence
  Oligomer
uauugauguuccuuugggu

SEQ ID NO: 79131 - RNA, 19 nt, Artificial Sequence
  Oligomer
uucuaguaacuagguguaa

SEQ ID NO: 79132 - RNA, 19 nt, Artificial Sequence
  Oligomer
agugcuuuucuuauagaac

SEQ ID NO: 79133 - RNA, 19 nt, Artificial Sequence
  Oligomer
auuguacaaggaaugaaag

SEQ ID NO: 79134 - RNA, 19 nt, Artificial Sequence
  Oligomer
auacgaaguggagauuuac

SEQ ID NO: 79135 - RNA, 19 nt, Artificial Sequence
  Oligomer
uucauagcgaguuuucuga

SEQ ID NO: 79136 - RNA, 19 nt, Artificial Sequence
  Oligomer
ucugcaguuaggaggugca

SEQ ID NO: 79137 - RNA, 19 nt, Artificial Sequence
  Oligomer
auaccuucugaacuacacu

SEQ ID NO: 79138 - RNA, 19 nt, Artificial Sequence
  Oligomer
auuuagcccuaaaaugaca

SEQ ID NO: 79139 - RNA, 19 nt, Artificial Sequence
  Oligomer
guaaaauaccuggagugcu

SEQ ID NO: 79140 - RNA, 19 nt, Artificial Sequence
  Oligomer
ugucccaacacucccauca

SEQ ID NO: 79141 - RNA, 19 nt, Artificial Sequence
  Oligomer
uucccuugugaguccugca

SEQ ID NO: 79142 - RNA, 19 nt, Artificial Sequence
  Oligomer
auacagcuggacaagaaga

SEQ ID NO: 79143 - RNA, 19 nt, Artificial Sequence
  Oligomer
auggaaaaccggugaaucu

SEQ ID NO: 79144 - RNA, 19 nt, Artificial Sequence
  Oligomer
acucacuggcgagaauaca

SEQ ID NO: 79145 - RNA, 19 nt, Artificial Sequence
  Oligomer
uguacaacuuaacucacug

SEQ ID NO: 79146 - RNA, 19 nt, Artificial Sequence
  Oligomer
uagugcugacgauguucug

SEQ ID NO: 79147 - RNA, 19 nt, Artificial Sequence
  Oligomer
aguuacacaaccaaugcau

SEQ ID NO: 79148 - RNA, 19 nt, Artificial Sequence
  Oligomer
aagaauucuguuuagcugu

SEQ ID NO: 79149 - RNA, 19 nt, Artificial Sequence
  Oligomer
uuaggaggugcagacacuu

SEQ ID NO: 79150 - RNA, 19 nt, Artificial Sequence
  Oligomer
uuaagaguugccaaaauac

SEQ ID NO: 79151 - RNA, 19 nt, Artificial Sequence
  Oligomer
uuuagcccuaaaaugacaa

SEQ ID NO: 79152 - RNA, 19 nt, Artificial Sequence
  Oligomer
aacugaaggagaagaagcu

SEQ ID NO: 79153 - RNA, 19 nt, Artificial Sequence
  Oligomer
aucgagaaacugaaggaga

SEQ ID NO: 79154 - RNA, 19 nt, Artificial Sequence
  Oligomer
cugcaguuuuccucagcuu

SEQ ID NO: 79155 - RNA, 19 nt, Artificial Sequence
  Oligomer
gauggaaaaccggugaauc

SEQ ID NO: 79156 - RNA, 19 nt, Artificial Sequence
  Oligomer
aaauugacaguugcagaau

SEQ ID NO: 79157 - RNA, 19 nt, Artificial Sequence
  Oligomer
uaaacugugcuagugcuga

SEQ ID NO: 79158 - RNA, 19 nt, Artificial Sequence
  Oligomer
guuccuuugggucugugag

SEQ ID NO: 79159 - RNA, 19 nt, Artificial Sequence
  Oligomer
gucgcuuugccuauugaug

SEQ ID NO: 79160 - RNA, 19 nt, Artificial Sequence
  Oligomer
aauacugacccucuuuacc

SEQ ID NO: 79161 - RNA, 19 nt, Artificial Sequence
  Oligomer
cugaucaguuacacaacca

SEQ ID NO: 79162 - RNA, 19 nt, Artificial Sequence
  Oligomer
uaaaagugcuuuccauguu

SEQ ID NO: 79163 - RNA, 19 nt, Artificial Sequence
  Oligomer
uguuagucgcuaacuuagu

SEQ ID NO: 79164 - RNA, 19 nt, Artificial Sequence
  Oligomer
uacauuguacaaggaauga

SEQ ID NO: 79165 - RNA, 19 nt, Artificial Sequence
  Oligomer
uacacuacauuguacaagg

SEQ ID NO: 79166 - RNA, 19 nt, Artificial Sequence
  Oligomer
gugaucaaaggacaaagac

SEQ ID NO: 79167 - RNA, 19 nt, Artificial Sequence
  Oligomer
ucuguuuagcugugggugu

SEQ ID NO: 79168 - RNA, 19 nt, Artificial Sequence
  Oligomer
cauuuccuguuucucugca

SEQ ID NO: 79169 - RNA, 19 nt, Artificial Sequence
  Oligomer
cacugcauuguugugccga

SEQ ID NO: 79170 - RNA, 19 nt, Artificial Sequence
  Oligomer
acucaaugccaacuuuuug

SEQ ID NO: 79171 - RNA, 19 nt, Artificial Sequence
  Oligomer
cuagccauggcuaaggaga

SEQ ID NO: 79172 - RNA, 19 nt, Artificial Sequence
  Oligomer
acugucccaacacucccau

SEQ ID NO: 79173 - RNA, 19 nt, Artificial Sequence
  Oligomer
ucuuaauuugcuuuucccu

SEQ ID NO: 79174 - RNA, 19 nt, Artificial Sequence
  Oligomer
ugacaguugcagaauugug

SEQ ID NO: 79175 - RNA, 19 nt, Artificial Sequence
  Oligomer
caucacugucuugccagau

SEQ ID NO: 79176 - RNA, 19 nt, Artificial Sequence
  Oligomer
agugcuuuccauguuacuu

SEQ ID NO: 79177 - RNA, 19 nt, Artificial Sequence
  Oligomer
cugacugagcaauaugccu

SEQ ID NO: 79178 - RNA, 19 nt, Artificial Sequence
  Oligomer
acuuaguaagugcuuuucu

SEQ ID NO: 79179 - RNA, 19 nt, Artificial Sequence
  Oligomer
cuuuaaacugguuguucug

SEQ ID NO: 79180 - RNA, 19 nt, Artificial Sequence
  Oligomer
acaaagacaguauuuugac

SEQ ID NO: 79181 - RNA, 19 nt, Artificial Sequence
  Oligomer
auuucauagcgaguuuucu

SEQ ID NO: 79182 - RNA, 19 nt, Artificial Sequence
  Oligomer
uucucagaugcguaaagca

SEQ ID NO: 79183 - RNA, 19 nt, Artificial Sequence
  Oligomer
uagccauggcuaaggagau

SEQ ID NO: 79184 - RNA, 19 nt, Artificial Sequence
  Oligomer
gaugauaaagacacgaucg

SEQ ID NO: 79185 - RNA, 19 nt, Artificial Sequence
  Oligomer
aauacagcgugggacccuu

SEQ ID NO: 79186 - RNA, 19 nt, Artificial Sequence
  Oligomer
aaacugugcuagugcugac

SEQ ID NO: 79187 - RNA, 19 nt, Artificial Sequence
  Oligomer
gagguucuguaaacugugc

SEQ ID NO: 79188 - RNA, 19 nt, Artificial Sequence
  Oligomer
uaacaucacugucuugcca

SEQ ID NO: 79189 - RNA, 19 nt, Artificial Sequence
  Oligomer
acuagguguaaaaaucaug

SEQ ID NO: 79190 - RNA, 19 nt, Artificial Sequence
  Oligomer
aguuuucuaguaacuaggu

SEQ ID NO: 79191 - RNA, 19 nt, Artificial Sequence
  Oligomer
gauuaguaaaagugcuuuc

SEQ ID NO: 79192 - RNA, 19 nt, Artificial Sequence
  Oligomer
cgcuaacuuaguaagugcu

SEQ ID NO: 79193 - RNA, 19 nt, Artificial Sequence
  Oligomer
caaauugggcauuuaauuc

SEQ ID NO: 79194 - RNA, 19 nt, Artificial Sequence
  Oligomer
ggaaugaaagugucacggg

SEQ ID NO: 79195 - RNA, 19 nt, Artificial Sequence
  Oligomer
guucccgacauaacauugu

SEQ ID NO: 79196 - RNA, 19 nt, Artificial Sequence
  Oligomer
gaaugaagcguugccauug

SEQ ID NO: 79197 - RNA, 19 nt, Artificial Sequence
  Oligomer
aagaccuucgucuuugaga

SEQ ID NO: 79198 - RNA, 19 nt, Artificial Sequence
  Oligomer
aacuacacugcauuguugu

SEQ ID NO: 79199 - RNA, 19 nt, Artificial Sequence
  Oligomer
aauaccuucugaacuacac

SEQ ID NO: 79200 - RNA, 19 nt, Artificial Sequence
  Oligomer
cccuuggaaccuuuguacg

SEQ ID NO: 79201 - RNA, 19 nt, Artificial Sequence
  Oligomer
uggugcuguaaaauaccug

SEQ ID NO: 79202 - RNA, 19 nt, Artificial Sequence
  Oligomer
guccgugcaaagugguauc

SEQ ID NO: 79203 - RNA, 19 nt, Artificial Sequence
  Oligomer
uacagcuggacaagaagau

SEQ ID NO: 79204 - RNA, 19 nt, Artificial Sequence
  Oligomer
ugguagauggaaaaccggu

SEQ ID NO: 79205 - RNA, 19 nt, Artificial Sequence
  Oligomer
caguugcagaauuguggag

SEQ ID NO: 79206 - RNA, 19 nt, Artificial Sequence
  Oligomer
agugcugacgauguucugu

SEQ ID NO: 79207 - RNA, 19 nt, Artificial Sequence
  Oligomer
uguaaacugugcuagugcu

SEQ ID NO: 79208 - RNA, 19 nt, Artificial Sequence
  Oligomer
uuucuaguaacuaggugua

SEQ ID NO: 79209 - RNA, 19 nt, Artificial Sequence
  Oligomer
aauaagugcuuuccuuagu

SEQ ID NO: 79210 - RNA, 19 nt, Artificial Sequence
  Oligomer
ugucgauuaguaaaagugc

SEQ ID NO: 79211 - RNA, 19 nt, Artificial Sequence
  Oligomer
ucuuuaaacugguuguucu

SEQ ID NO: 79212 - RNA, 19 nt, Artificial Sequence
  Oligomer
uuguacaaggaaugaaagu

SEQ ID NO: 79213 - RNA, 19 nt, Artificial Sequence
  Oligomer
cacguguucccgacauaac

SEQ ID NO: 79214 - RNA, 19 nt, Artificial Sequence
  Oligomer
cguugccauugaacucacc

SEQ ID NO: 79215 - RNA, 19 nt, Artificial Sequence
  Oligomer
agacacuugcucuccuaug

SEQ ID NO: 79216 - RNA, 19 nt, Artificial Sequence
  Oligomer
augacaagccuucuuaaag

SEQ ID NO: 79217 - RNA, 19 nt, Artificial Sequence
  Oligomer
ccuuggaaccuuuguacgc

SEQ ID NO: 79218 - RNA, 19 nt, Artificial Sequence
  Oligomer
ucugggcuuaugggauaca

SEQ ID NO: 79219 - RNA, 19 nt, Artificial Sequence
  Oligomer
gugaaucugggcuuauggg

SEQ ID NO: 79220 - RNA, 19 nt, Artificial Sequence
  Oligomer
ccaauguuaugguagaugg

SEQ ID NO: 79221 - RNA, 19 nt, Artificial Sequence
  Oligomer
acccuucagccacuacaac

SEQ ID NO: 79222 - RNA, 19 nt, Artificial Sequence
  Oligomer
cucacuggcgagaauacag

SEQ ID NO: 79223 - RNA, 19 nt, Artificial Sequence
  Oligomer
uguucuguacaacuuaacu

SEQ ID NO: 79224 - RNA, 19 nt, Artificial Sequence
  Oligomer
gcuagugcugacgauguuc

SEQ ID NO: 79225 - RNA, 19 nt, Artificial Sequence
  Oligomer
cuucugacugagcaauaug

SEQ ID NO: 79226 - RNA, 19 nt, Artificial Sequence
  Oligomer
uuuccuuucucuuacaccu

SEQ ID NO: 79227 - RNA, 19 nt, Artificial Sequence
  Oligomer
uugcggagauuuugaacag

SEQ ID NO: 79228 - RNA, 19 nt, Artificial Sequence
  Oligomer
cguaaagcagaacagccuc

SEQ ID NO: 79229 - RNA, 19 nt, Artificial Sequence
  Oligomer
aacaccgagcacugaacuu

SEQ ID NO: 79230 - RNA, 19 nt, Artificial Sequence
  Oligomer
cuuguucagauuaagaguu

SEQ ID NO: 79231 - RNA, 19 nt, Artificial Sequence
  Oligomer
uguuguaaaugucucagcc

SEQ ID NO: 79232 - RNA, 19 nt, Artificial Sequence
  Oligomer
gaucgagaaacugaaggag

SEQ ID NO: 79233 - RNA, 19 nt, Artificial Sequence
  Oligomer
auguuuugcauguaugacu

SEQ ID NO: 79234 - RNA, 19 nt, Artificial Sequence
  Oligomer
uuugcuaaugcaauuagca

SEQ ID NO: 79235 - RNA, 19 nt, Artificial Sequence
  Oligomer
aaugcauuuccuggagaau

SEQ ID NO: 79236 - RNA, 19 nt, Artificial Sequence
  Oligomer
uuugccuauugauguuccu

SEQ ID NO: 79237 - RNA, 19 nt, Artificial Sequence
  Oligomer
gauuaccgacacugucacu

SEQ ID NO: 79238 - RNA, 19 nt, Artificial Sequence
  Oligomer
aaaucauguguugcagcuu

SEQ ID NO: 79239 - RNA, 19 nt, Artificial Sequence
  Oligomer
uccuguuucucugcaguuu

SEQ ID NO: 79240 - RNA, 19 nt, Artificial Sequence
  Oligomer
cugauaaugcauuagaagg

SEQ ID NO: 79241 - RNA, 19 nt, Artificial Sequence
  Oligomer
gugcuuuucuuauagaacc

SEQ ID NO: 79242 - RNA, 19 nt, Artificial Sequence
  Oligomer
ucuuacaccugccaugccu

SEQ ID NO: 79243 - RNA, 19 nt, Artificial Sequence
  Oligomer
guuuucuuaagcuuuuccu

SEQ ID NO: 79244 - RNA, 19 nt, Artificial Sequence
  Oligomer
guuaauuucugucaaaugc

SEQ ID NO: 79245 - RNA, 19 nt, Artificial Sequence
  Oligomer
gauuucauagcgaguuuuc

SEQ ID NO: 79246 - RNA, 19 nt, Artificial Sequence
  Oligomer
auguaguucucagaugcgu

SEQ ID NO: 79247 - RNA, 19 nt, Artificial Sequence
  Oligomer
guaaagagggucaguauug

SEQ ID NO: 79248 - RNA, 19 nt, Artificial Sequence
  Oligomer
uucaguuucucgaucgugu

SEQ ID NO: 79249 - RNA, 19 nt, Artificial Sequence
  Oligomer
uuucucuuccucuucuuca

SEQ ID NO: 79250 - RNA, 19 nt, Artificial Sequence
  Oligomer
ucugaauaaaguaacaugg

SEQ ID NO: 79251 - RNA, 19 nt, Artificial Sequence
  Oligomer
uuuaguucccacuaggaug

SEQ ID NO: 79252 - RNA, 19 nt, Artificial Sequence
  Oligomer
uucuccaggaaaugcauug

SEQ ID NO: 79253 - RNA, 19 nt, Artificial Sequence
  Oligomer
uuuagaguuuuuacccgug

SEQ ID NO: 79254 - RNA, 19 nt, Artificial Sequence
  Oligomer
uuaagaaggcuugucauuu

SEQ ID NO: 79255 - RNA, 19 nt, Artificial Sequence
  Oligomer
uccaucuaccauaacauug

SEQ ID NO: 79256 - RNA, 19 nt, Artificial Sequence
  Oligomer
uagggauauauucuccagg

SEQ ID NO: 79257 - RNA, 19 nt, Artificial Sequence
  Oligomer
uuuuccaucuaccauaaca

SEQ ID NO: 79258 - RNA, 19 nt, Artificial Sequence
  Oligomer
uuuuacccgugacacuuuc

SEQ ID NO: 79259 - RNA, 19 nt, Artificial Sequence
  Oligomer
uugcaaaguucagugcucg

SEQ ID NO: 79260 - RNA, 19 nt, Artificial Sequence
  Oligomer
uuuuagaguuuuuacccgu

SEQ ID NO: 79261 - RNA, 19 nt, Artificial Sequence
  Oligomer
uuaaucugaacaagaaugg

SEQ ID NO: 79262 - RNA, 19 nt, Artificial Sequence
  Oligomer
ugucaaaauacugucuuug

SEQ ID NO: 79263 - RNA, 19 nt, Artificial Sequence
  Oligomer
uucagugcucgguguucuc

SEQ ID NO: 79264 - RNA, 19 nt, Artificial Sequence
  Oligomer
uuuccaucuaccauaacau

SEQ ID NO: 79265 - RNA, 19 nt, Artificial Sequence
  Oligomer
auguuaagaagguucauag

SEQ ID NO: 79266 - RNA, 19 nt, Artificial Sequence
  Oligomer
ucaaaaucuccgcaaaagc

SEQ ID NO: 79267 - RNA, 19 nt, Artificial Sequence
  Oligomer
cuuucuuucaucaucuacu

SEQ ID NO: 79268 - RNA, 19 nt, Artificial Sequence
  Oligomer
ugucuuuguccuuugauca

SEQ ID NO: 79269 - RNA, 19 nt, Artificial Sequence
  Oligomer
ugcaguguaguucagaagg

SEQ ID NO: 79270 - RNA, 19 nt, Artificial Sequence
  Oligomer
ucucgaucgugucuuuauc

SEQ ID NO: 79271 - RNA, 19 nt, Artificial Sequence
  Oligomer
uauauucuccaggaaaugc

SEQ ID NO: 79272 - RNA, 19 nt, Artificial Sequence
  Oligomer
uguucucggcacaacaaug

SEQ ID NO: 79273 - RNA, 19 nt, Artificial Sequence
  Oligomer
ucugcuuuacgcaucugag

SEQ ID NO: 79274 - RNA, 19 nt, Artificial Sequence
  Oligomer
ucaggauaccacuuugcac

SEQ ID NO: 79275 - RNA, 19 nt, Artificial Sequence
  Oligomer
uauaaagcugcaacacaug

SEQ ID NO: 79276 - RNA, 19 nt, Artificial Sequence
  Oligomer
uaaaucuccacuucguauu

SEQ ID NO: 79277 - RNA, 19 nt, Artificial Sequence
  Oligomer
ucgcuaugaaaucacaaag

SEQ ID NO: 79278 - RNA, 19 nt, Artificial Sequence
  Oligomer
acuccagguauuuuacagc

SEQ ID NO: 79279 - RNA, 19 nt, Artificial Sequence
  Oligomer
accuuuuagaguuuuuacc

SEQ ID NO: 79280 - RNA, 19 nt, Artificial Sequence
  Oligomer
uuucucgaucgugucuuua

SEQ ID NO: 79281 - RNA, 19 nt, Artificial Sequence
  Oligomer
aaggaaagcacuuauuagc

SEQ ID NO: 79282 - RNA, 19 nt, Artificial Sequence
  Oligomer
uaaaguaacauggaaagca

SEQ ID NO: 79283 - RNA, 19 nt, Artificial Sequence
  Oligomer
uguguaacugaucaguagg

SEQ ID NO: 79284 - RNA, 19 nt, Artificial Sequence
  Oligomer
uuagaguuuuuacccguga

SEQ ID NO: 79285 - RNA, 19 nt, Artificial Sequence
  Oligomer
acccgugacacuuucauuc

SEQ ID NO: 79286 - RNA, 19 nt, Artificial Sequence
  Oligomer
uuuacaacagcaggcauuu

SEQ ID NO: 79287 - RNA, 19 nt, Artificial Sequence
  Oligomer
ucaaacacugucuugaggc

SEQ ID NO: 79288 - RNA, 19 nt, Artificial Sequence
  Oligomer
caggauaccacuuugcacg

SEQ ID NO: 79289 - RNA, 19 nt, Artificial Sequence
  Oligomer
auaaucuucuuguccagcu

SEQ ID NO: 79290 - RNA, 19 nt, Artificial Sequence
  Oligomer
auggaaagcacuuuuacua

SEQ ID NO: 79291 - RNA, 19 nt, Artificial Sequence
  Oligomer
uuuuuacccgugacacuuu

SEQ ID NO: 79292 - RNA, 19 nt, Artificial Sequence
  Oligomer
uuuacccgugacacuuuca

SEQ ID NO: 79293 - RNA, 19 nt, Artificial Sequence
  Oligomer
uucauucgggaggcuguuc

SEQ ID NO: 79294 - RNA, 19 nt, Artificial Sequence
  Oligomer
uacgcaucugagaacuaca

SEQ ID NO: 79295 - RNA, 19 nt, Artificial Sequence
  Oligomer
ugugagucugaacucuuac

SEQ ID NO: 79296 - RNA, 19 nt, Artificial Sequence
  Oligomer
ucucuuccucuucuucacg

SEQ ID NO: 79297 - RNA, 19 nt, Artificial Sequence
  Oligomer
aucccauaagcccagauuc

SEQ ID NO: 79298 - RNA, 19 nt, Artificial Sequence
  Oligomer
uagcucugaauaaaguaac

SEQ ID NO: 79299 - RNA, 19 nt, Artificial Sequence
  Oligomer
uaacauggaaagcacuuuu

SEQ ID NO: 79300 - RNA, 19 nt, Artificial Sequence
  Oligomer
ucaaaauacugucuuuguc

SEQ ID NO: 79301 - RNA, 19 nt, Artificial Sequence
  Oligomer
auacugucuuuguccuuug

SEQ ID NO: 79302 - RNA, 19 nt, Artificial Sequence
  Oligomer
aucuguaacaaaaaguugg

SEQ ID NO: 79303 - RNA, 19 nt, Artificial Sequence
  Oligomer
aaaaaguuggcauugagug

SEQ ID NO: 79304 - RNA, 19 nt, Artificial Sequence
  Oligomer
ucaguuucucgaucguguc

SEQ ID NO: 79305 - RNA, 19 nt, Artificial Sequence
  Oligomer
ucaaguuuaguucccacua

SEQ ID NO: 79306 - RNA, 19 nt, Artificial Sequence
  Oligomer
aagaaaagcacuuacuaag

SEQ ID NO: 79307 - RNA, 19 nt, Artificial Sequence
  Oligomer
uguaguguaaaucuccacu

SEQ ID NO: 79308 - RNA, 19 nt, Artificial Sequence
  Oligomer
uguuaugucgggaacacgu

SEQ ID NO: 79309 - RNA, 19 nt, Artificial Sequence
  Oligomer
uuuaagaaggcuugucauu

SEQ ID NO: 79310 - RNA, 19 nt, Artificial Sequence
  Oligomer
uucucuuccucuucuucac

SEQ ID NO: 79311 - RNA, 19 nt, Artificial Sequence
  Oligomer
uucucgaucgugucuuuau

SEQ ID NO: 79312 - RNA, 19 nt, Artificial Sequence
  Oligomer
cauaagcccagauucaccg

SEQ ID NO: 79313 - RNA, 19 nt, Artificial Sequence
  Oligomer
ugucugcaccuccuaacug

SEQ ID NO: 79314 - RNA, 19 nt, Artificial Sequence
  Oligomer
ucaucuacugcauuugaca

SEQ ID NO: 79315 - RNA, 19 nt, Artificial Sequence
  Oligomer
aucuccacuucguauuuug

SEQ ID NO: 79316 - RNA, 19 nt, Artificial Sequence
  Oligomer
uccacuucguauuuuguca

SEQ ID NO: 79317 - RNA, 19 nt, Artificial Sequence
  Oligomer
caaaauacugucuuugucc

SEQ ID NO: 79318 - RNA, 19 nt, Artificial Sequence
  Oligomer
guauuuuacagcaccaauc

SEQ ID NO: 79319 - RNA, 19 nt, Artificial Sequence
  Oligomer
uaggaugaugggaguguug

SEQ ID NO: 79320 - RNA, 19 nt, Artificial Sequence
  Oligomer
uccagcuguaucccauaag

SEQ ID NO: 79321 - RNA, 19 nt, Artificial Sequence
  Oligomer
ucuaccauaacauuggcag

SEQ ID NO: 79322 - RNA, 19 nt, Artificial Sequence
  Oligomer
aacauuggcagaauaauug

SEQ ID NO: 79323 - RNA, 19 nt, Artificial Sequence
  Oligomer
uugguuguguaacugauca

SEQ ID NO: 79324 - RNA, 19 nt, Artificial Sequence
  Oligomer
uuucaucaucuacugcauu

SEQ ID NO: 79325 - RNA, 19 nt, Artificial Sequence
  Oligomer
ucuuuguccuuugaucaca

SEQ ID NO: 79326 - RNA, 19 nt, Artificial Sequence
  Oligomer
acuccauuacaguacaaug

SEQ ID NO: 79327 - RNA, 19 nt, Artificial Sequence
  Oligomer
ucuuccucuucuucacggg

SEQ ID NO: 79328 - RNA, 19 nt, Artificial Sequence
  Oligomer
uuguccagcuguaucccau

SEQ ID NO: 79329 - RNA, 19 nt, Artificial Sequence
  Oligomer
auauucuccaggaaaugca

SEQ ID NO: 79330 - RNA, 19 nt, Artificial Sequence
  Oligomer
aaaacuauaaagcugcaac

SEQ ID NO: 79331 - RNA, 19 nt, Artificial Sequence
  Oligomer
uauaauacaaggaggcaua

SEQ ID NO: 79332 - RNA, 19 nt, Artificial Sequence
  Oligomer
ucaauggcaacgcuucauu

SEQ ID NO: 79333 - RNA, 19 nt, Artificial Sequence
  Oligomer
ucauucgggaggcuguucu

SEQ ID NO: 79334 - RNA, 19 nt, Artificial Sequence
  Oligomer
aacugcagaagcuaccguc

SEQ ID NO: 79335 - RNA, 19 nt, Artificial Sequence
  Oligomer
aggcauuuucucuuccucu

SEQ ID NO: 79336 - RNA, 19 nt, Artificial Sequence
  Oligomer
uaauugucaaagacaguag

SEQ ID NO: 79337 - RNA, 19 nt, Artificial Sequence
  Oligomer
uagaguuuuuacccgugac

SEQ ID NO: 79338 - RNA, 19 nt, Artificial Sequence
  Oligomer
auguaguguaaaucuccac

SEQ ID NO: 79339 - RNA, 19 nt, Artificial Sequence
  Oligomer
ugucuuuaucaucccuaag

SEQ ID NO: 79340 - RNA, 19 nt, Artificial Sequence
  Oligomer
uuugcacggacauuuucaa

SEQ ID NO: 79341 - RNA, 19 nt, Artificial Sequence
  Oligomer
ucuuguccagcuguauccc

SEQ ID NO: 79342 - RNA, 19 nt, Artificial Sequence
  Oligomer
uccacaauucugcaacugu

SEQ ID NO: 79343 - RNA, 19 nt, Artificial Sequence
  Oligomer
aucaauaggcaaagcgacu

SEQ ID NO: 79344 - RNA, 19 nt, Artificial Sequence
  Oligomer
aucgacaaaaaaaccuucu

SEQ ID NO: 79345 - RNA, 19 nt, Artificial Sequence
  Oligomer
uaaguuagcgacuaacaga

SEQ ID NO: 79346 - RNA, 19 nt, Artificial Sequence
  Oligomer
ccuuuuagaguuuuuaccc

SEQ ID NO: 79347 - RNA, 19 nt, Artificial Sequence
  Oligomer
aguucaauggcaacgcuuc

SEQ ID NO: 79348 - RNA, 19 nt, Artificial Sequence
  Oligomer
ucuguaacaaaaaguuggc

SEQ ID NO: 79349 - RNA, 19 nt, Artificial Sequence
  Oligomer
auuuacaacagcaggcauu

SEQ ID NO: 79350 - RNA, 19 nt, Artificial Sequence
  Oligomer
uuccucuucuucacgggag

SEQ ID NO: 79351 - RNA, 19 nt, Artificial Sequence
  Oligomer
uaucccauaagcccagauu

SEQ ID NO: 79352 - RNA, 19 nt, Artificial Sequence
  Oligomer
agcgacuaacagaacaacc

SEQ ID NO: 79353 - RNA, 19 nt, Artificial Sequence
  Oligomer
ugacacuuucauuccuugu

SEQ ID NO: 79354 - RNA, 19 nt, Artificial Sequence
  Oligomer
uguccuuugaucacacaca

SEQ ID NO: 79355 - RNA, 19 nt, Artificial Sequence
  Oligomer
augaugggaguguugggac

SEQ ID NO: 79356 - RNA, 19 nt, Artificial Sequence
  Oligomer
cuuugcacggacauuuuca

SEQ ID NO: 79357 - RNA, 19 nt, Artificial Sequence
  Oligomer
auugguuguguaacugauc

SEQ ID NO: 79358 - RNA, 19 nt, Artificial Sequence
  Oligomer
caauguaguguaaaucucc

SEQ ID NO: 79359 - RNA, 19 nt, Artificial Sequence
  Oligomer
aauacugucuuuguccuuu

SEQ ID NO: 79360 - RNA, 19 nt, Artificial Sequence
  Oligomer
uaggugaugggagucagcu

SEQ ID NO: 79361 - RNA, 19 nt, Artificial Sequence
  Oligomer
aggaugaugggaguguugg

SEQ ID NO: 79362 - RNA, 19 nt, Artificial Sequence
  Oligomer
cuuuuagaguuuuuacccg

SEQ ID NO: 79363 - RNA, 19 nt, Artificial Sequence
  Oligomer
uccuuugaucacacacacc

SEQ ID NO: 79364 - RNA, 19 nt, Artificial Sequence
  Oligomer
acacgugcugcuaacucac

SEQ ID NO: 79365 - RNA, 19 nt, Artificial Sequence
  Oligomer
ucugaacucuuacauuuag

SEQ ID NO: 79366 - RNA, 19 nt, Artificial Sequence
  Oligomer
agucagcuucuucuccuuc

SEQ ID NO: 79367 - RNA, 19 nt, Artificial Sequence
  Oligomer
ugcacggacauuuucaaau

SEQ ID NO: 79368 - RNA, 19 nt, Artificial Sequence
  Oligomer
uaagcccagauucaccggu

SEQ ID NO: 79369 - RNA, 19 nt, Artificial Sequence
  Oligomer
uacuaaguuagcgacuaac

SEQ ID NO: 79370 - RNA, 19 nt, Artificial Sequence
  Oligomer
ugauaauaccaaccuuucu

SEQ ID NO: 79371 - RNA, 19 nt, Artificial Sequence
  Oligomer
aauguaguguaaaucucca

SEQ ID NO: 79372 - RNA, 19 nt, Artificial Sequence
  Oligomer
uguaaaucuccacuucgua

SEQ ID NO: 79373 - RNA, 19 nt, Artificial Sequence
  Oligomer
cuccacuucguauuuuguc

SEQ ID NO: 79374 - RNA, 19 nt, Artificial Sequence
  Oligomer
ugauccaaagagcugagcu

SEQ ID NO: 79375 - RNA, 19 nt, Artificial Sequence
  Oligomer
ccagguauuuuacagcacc

SEQ ID NO: 79376 - RNA, 19 nt, Artificial Sequence
  Oligomer
auaagcccagauucaccgg

SEQ ID NO: 79377 - RNA, 19 nt, Artificial Sequence
  Oligomer
uaagucauacaugcaaaac

SEQ ID NO: 79378 - RNA, 19 nt, Artificial Sequence
  Oligomer
aauucugcaacugucaauu

SEQ ID NO: 79379 - RNA, 19 nt, Artificial Sequence
  Oligomer
ucaauaggcaaagcgacua

SEQ ID NO: 79380 - RNA, 19 nt, Artificial Sequence
  Oligomer
ucaguauuggucaagugac

SEQ ID NO: 79381 - RNA, 19 nt, Artificial Sequence
  Oligomer
aaucgacaaaaaaaccuuc

SEQ ID NO: 79382 - RNA, 19 nt, Artificial Sequence
  Oligomer
uuagcgacuaacagaacaa

SEQ ID NO: 79383 - RNA, 19 nt, Artificial Sequence
  Oligomer
cugauaauaccaaccuuuc

SEQ ID NO: 79384 - RNA, 19 nt, Artificial Sequence
  Oligomer
uuacccgugacacuuucau

SEQ ID NO: 79385 - RNA, 19 nt, Artificial Sequence
  Oligomer
aguguaaaucuccacuucg

SEQ ID NO: 79386 - RNA, 19 nt, Artificial Sequence
  Oligomer
ucuccacuucguauuuugu

SEQ ID NO: 79387 - RNA, 19 nt, Artificial Sequence
  Oligomer
cugucuuuguccuuugauc

SEQ ID NO: 79388 - RNA, 19 nt, Artificial Sequence
  Oligomer
uccuaacugcagaagcuac

SEQ ID NO: 79389 - RNA, 19 nt, Artificial Sequence
  Oligomer
agagaaacaggaaauggcc

SEQ ID NO: 79390 - RNA, 19 nt, Artificial Sequence
  Oligomer
guaaucugucauaaucuuc

SEQ ID NO: 79391 - RNA, 19 nt, Artificial Sequence
  Oligomer
cuucuuguccagcuguauc

SEQ ID NO: 79392 - RNA, 19 nt, Artificial Sequence
  Oligomer
ucugcaacugucaauuuaa

SEQ ID NO: 79393 - RNA, 19 nt, Artificial Sequence
  Oligomer
agaagguucauaguuuaag

SEQ ID NO: 79394 - RNA, 19 nt, Artificial Sequence
  Oligomer
cauuugacagaaauuaacc

SEQ ID NO: 79395 - RNA, 19 nt, Artificial Sequence
  Oligomer
guacaauguaguguaaauc

SEQ ID NO: 79396 - RNA, 19 nt, Artificial Sequence
  Oligomer
agacauuuacaacagcagg

SEQ ID NO: 79397 - RNA, 19 nt, Artificial Sequence
  Oligomer
aguuucucgaucgugucuu

SEQ ID NO: 79398 - RNA, 19 nt, Artificial Sequence
  Oligomer
uugcacggacauuuucaaa

SEQ ID NO: 79399 - RNA, 19 nt, Artificial Sequence
  Oligomer
auugcauuagcaaaagauc

SEQ ID NO: 79400 - RNA, 19 nt, Artificial Sequence
  Oligomer
aaugcauugguuguguaac

SEQ ID NO: 79401 - RNA, 19 nt, Artificial Sequence
  Oligomer
guuuuuacccgugacacuu

SEQ ID NO: 79402 - RNA, 19 nt, Artificial Sequence
  Oligomer
ucacaaagacugauccaaa

SEQ ID NO: 79403 - RNA, 19 nt, Artificial Sequence
  Oligomer
ugcuacgcucacuccauua

SEQ ID NO: 79404 - RNA, 19 nt, Artificial Sequence
  Oligomer
accuccuaacugcagaagc

SEQ ID NO: 79405 - RNA, 19 nt, Artificial Sequence
  Oligomer
ccuaacugcagaagcuacc

SEQ ID NO: 79406 - RNA, 19 nt, Artificial Sequence
  Oligomer
uaacugcagaagcuaccgu

SEQ ID NO: 79407 - RNA, 19 nt, Artificial Sequence
  Oligomer
caaaguucagugcucggug

SEQ ID NO: 79408 - RNA, 19 nt, Artificial Sequence
  Oligomer
cuucaguuucucgaucgug

SEQ ID NO: 79409 - RNA, 19 nt, Artificial Sequence
  Oligomer
ccauaagcccagauucacc

SEQ ID NO: 79410 - RNA, 19 nt, Artificial Sequence
  Oligomer
uguacagaacaucgucagc

SEQ ID NO: 79411 - RNA, 19 nt, Artificial Sequence
  Oligomer
uaaggaaagcacuuauuag

SEQ ID NO: 79412 - RNA, 19 nt, Artificial Sequence
  Oligomer
cucugaauaaaguaacaug

SEQ ID NO: 79413 - RNA, 19 nt, Artificial Sequence
  Oligomer
acuaaucgacaaaaaaacc

SEQ ID NO: 79414 - RNA, 19 nt, Artificial Sequence
  Oligomer
caaaaaaaccuucuaaugc

SEQ ID NO: 79415 - RNA, 19 nt, Artificial Sequence
  Oligomer
ugaucaguaggcaaguuuu

SEQ ID NO: 79416 - RNA, 19 nt, Artificial Sequence
  Oligomer
uguucugcuuuacgcaucu

SEQ ID NO: 79417 - RNA, 19 nt, Artificial Sequence
  Oligomer
cuaacugcagaagcuaccg

SEQ ID NO: 79418 - RNA, 19 nt, Artificial Sequence
  Oligomer
aaugugagucugaacucuu

SEQ ID NO: 79419 - RNA, 19 nt, Artificial Sequence
  Oligomer
uuacagcaccaaucuccuu

SEQ ID NO: 79420 - RNA, 19 nt, Artificial Sequence
  Oligomer
gaucgugucuuuaucaucc

SEQ ID NO: 79421 - RNA, 19 nt, Artificial Sequence
  Oligomer
uuaucaucccuaagaucaa

SEQ ID NO: 79422 - RNA, 19 nt, Artificial Sequence
  Oligomer
ucauaaucuucuuguccag

SEQ ID NO: 79423 - RNA, 19 nt, Artificial Sequence
  Oligomer
agcuguaucccauaagccc

SEQ ID NO: 79424 - RNA, 19 nt, Artificial Sequence
  Oligomer
uuccaucuaccauaacauu

SEQ ID NO: 79425 - RNA, 19 nt, Artificial Sequence
  Oligomer
cuuuguccuuugaucacac

SEQ ID NO: 79426 - RNA, 19 nt, Artificial Sequence
  Oligomer
acaacagcaggcauuuucu

SEQ ID NO: 79427 - RNA, 19 nt, Artificial Sequence
  Oligomer
accaaucuccuuagccaug

SEQ ID NO: 79428 - RNA, 19 nt, Artificial Sequence
  Oligomer
ucgugucuuuaucaucccu

SEQ ID NO: 79429 - RNA, 19 nt, Artificial Sequence
  Oligomer
ucccauaagcccagauuca

SEQ ID NO: 79430 - RNA, 19 nt, Artificial Sequence
  Oligomer
uguaaaaacacuccacaau

SEQ ID NO: 79431 - RNA, 19 nt, Artificial Sequence
  Oligomer
auauauucuccaggaaaug

SEQ ID NO: 79432 - RNA, 19 nt, Artificial Sequence
  Oligomer
ucacagacccaaaggaaca

SEQ ID NO: 79433 - RNA, 19 nt, Artificial Sequence
  Oligomer
agagggucaguauugguca

SEQ ID NO: 79434 - RNA, 19 nt, Artificial Sequence
  Oligomer
uaagagaaaggaaaagcuu

SEQ ID NO: 79435 - RNA, 19 nt, Artificial Sequence
  Oligomer
ugcaaaguucagugcucgg

SEQ ID NO: 79436 - RNA, 19 nt, Artificial Sequence
  Oligomer
agaaacaggaaauggccgc

SEQ ID NO: 79437 - RNA, 19 nt, Artificial Sequence
  Oligomer
ccagauucaccgguuuucc

SEQ ID NO: 79438 - RNA, 19 nt, Artificial Sequence
  Oligomer
agggucaguauuggucaag

SEQ ID NO: 79439 - RNA, 19 nt, Artificial Sequence
  Oligomer
ugacagugucgguaaucug

SEQ ID NO: 79440 - RNA, 19 nt, Artificial Sequence
  Oligomer
cuaaucgacaaaaaaaccu

SEQ ID NO: 79441 - RNA, 19 nt, Artificial Sequence
  Oligomer
aaccuucuaaugcauuauc

SEQ ID NO: 79442 - RNA, 19 nt, Artificial Sequence
  Oligomer
acaaggaggcauauugcuc

SEQ ID NO: 79443 - RNA, 19 nt, Artificial Sequence
  Oligomer
acuaacagaacaaccaguu

SEQ ID NO: 79444 - RNA, 19 nt, Artificial Sequence
  Oligomer
uaacagaacaaccaguuua

SEQ ID NO: 79445 - RNA, 19 nt, Artificial Sequence
  Oligomer
ucuucauuagaggaaauag

SEQ ID NO: 79446 - RNA, 19 nt, Artificial Sequence
  Oligomer
uccauuacaguacaauguu

SEQ ID NO: 79447 - RNA, 19 nt, Artificial Sequence
  Oligomer
uguaguucagaagguauuu

SEQ ID NO: 79448 - RNA, 19 nt, Artificial Sequence
  Oligomer
cuuaaucugaacaagaaug

SEQ ID NO: 79449 - RNA, 19 nt, Artificial Sequence
  Oligomer
uaacaaaaaguuggcauug

SEQ ID NO: 79450 - RNA, 19 nt, Artificial Sequence
  Oligomer
aacacugucuugaggccuc

SEQ ID NO: 79451 - RNA, 19 nt, Artificial Sequence
  Oligomer
ucaagugacagugucggua

SEQ ID NO: 79452 - RNA, 19 nt, Artificial Sequence
  Oligomer
auaaaguaacauggaaagc

SEQ ID NO: 79453 - RNA, 19 nt, Artificial Sequence
  Oligomer
aaagcacuuacuaaguuag

SEQ ID NO: 79454 - RNA, 19 nt, Artificial Sequence
  Oligomer
agugucugcaccuccuaac

SEQ ID NO: 79455 - RNA, 19 nt, Artificial Sequence
  Oligomer
uaaucugaacaagaauggg

SEQ ID NO: 79456 - RNA, 19 nt, Artificial Sequence
  Oligomer
cucuuccucuucuucacgg

SEQ ID NO: 79457 - RNA, 19 nt, Artificial Sequence
  Oligomer
acuuugcacggacauuuuc

SEQ ID NO: 79458 - RNA, 19 nt, Artificial Sequence
  Oligomer
cauaaucuucuuguccagc

SEQ ID NO: 79459 - RNA, 19 nt, Artificial Sequence
  Oligomer
caccgguuuuccaucuacc

SEQ ID NO: 79460 - RNA, 19 nt, Artificial Sequence
  Oligomer
ucuccaggaaaugcauugg

SEQ ID NO: 79461 - RNA, 19 nt, Artificial Sequence
  Oligomer
acuauaaagcugcaacaca

SEQ ID NO: 79462 - RNA, 19 nt, Artificial Sequence
  Oligomer
uagcgacuaacagaacaac

SEQ ID NO: 79463 - RNA, 19 nt, Artificial Sequence
  Oligomer
gauaauaccaaccuuucuu

SEQ ID NO: 79464 - RNA, 19 nt, Artificial Sequence
  Oligomer
acaauguaguguaaaucuc

SEQ ID NO: 79465 - RNA, 19 nt, Artificial Sequence
  Oligomer
gcaaguuuuaccuacagcu

SEQ ID NO: 79466 - RNA, 19 nt, Artificial Sequence
  Oligomer
auagcaguucuguucaaaa

SEQ ID NO: 79467 - RNA, 19 nt, Artificial Sequence
  Oligomer
uuuacgcaucugagaacua

SEQ ID NO: 79468 - RNA, 19 nt, Artificial Sequence
  Oligomer
ugcagaagcuaccgucuuc

SEQ ID NO: 79469 - RNA, 19 nt, Artificial Sequence
  Oligomer
aaacacugucuugaggccu

SEQ ID NO: 79470 - RNA, 19 nt, Artificial Sequence
  Oligomer
ugggagucagcuucuucuc

SEQ ID NO: 79471 - RNA, 19 nt, Artificial Sequence
  Oligomer
ucagcuucuucuccuucag

SEQ ID NO: 79472 - RNA, 19 nt, Artificial Sequence
  Oligomer
accucaggauaccacuuug

SEQ ID NO: 79473 - RNA, 19 nt, Artificial Sequence
  Oligomer
uaccacuuugcacggacau

SEQ ID NO: 79474 - RNA, 19 nt, Artificial Sequence
  Oligomer
aaugaugcaggacucacaa

SEQ ID NO: 79475 - RNA, 19 nt, Artificial Sequence
  Oligomer
ucacaagggaaaagcaaau

SEQ ID NO: 79476 - RNA, 19 nt, Artificial Sequence
  Oligomer
cuauaagaaaagcacuuac

SEQ ID NO: 79477 - RNA, 19 nt, Artificial Sequence
  Oligomer
cuaaguuagcgacuaacag

SEQ ID NO: 79478 - RNA, 19 nt, Artificial Sequence
  Oligomer
uggcagguguaagagaaag

SEQ ID NO: 79479 - RNA, 19 nt, Artificial Sequence
  Oligomer
aaacaggaaauggccgcuc

SEQ ID NO: 79480 - RNA, 19 nt, Artificial Sequence
  Oligomer
uaguguaaaucuccacuuc

SEQ ID NO: 79481 - RNA, 19 nt, Artificial Sequence
  Oligomer
aggcuguucugcuuuacgc

SEQ ID NO: 79482 - RNA, 19 nt, Artificial Sequence
  Oligomer
cuguucugcuuuacgcauc

SEQ ID NO: 79483 - RNA, 19 nt, Artificial Sequence
  Oligomer
aguucagugcucgguguuc

SEQ ID NO: 79484 - RNA, 19 nt, Artificial Sequence
  Oligomer
guucagugcucgguguucu

SEQ ID NO: 79485 - RNA, 19 nt, Artificial Sequence
  Oligomer
cagagaaacaggaaauggc

SEQ ID NO: 79486 - RNA, 19 nt, Artificial Sequence
  Oligomer
acagcaggcauuuucucuu

SEQ ID NO: 79487 - RNA, 19 nt, Artificial Sequence
  Oligomer
gucuuuaucaucccuaaga

SEQ ID NO: 79488 - RNA, 19 nt, Artificial Sequence
  Oligomer
ucuuuaucaucccuaagau

SEQ ID NO: 79489 - RNA, 19 nt, Artificial Sequence
  Oligomer
caaagcugaggaaaacugc

SEQ ID NO: 79490 - RNA, 19 nt, Artificial Sequence
  Oligomer
gucauaaucuucuugucca

SEQ ID NO: 79491 - RNA, 19 nt, Artificial Sequence
  Oligomer
auugucaaagacaguaggg

SEQ ID NO: 79492 - RNA, 19 nt, Artificial Sequence
  Oligomer
uugucaaagacaguaggga

SEQ ID NO: 79493 - RNA, 19 nt, Artificial Sequence
  Oligomer
cacaguuuacagaaccuca

SEQ ID NO: 79494 - RNA, 19 nt, Artificial Sequence
  Oligomer
guaaucuggcaagacagug

SEQ ID NO: 79495 - RNA, 19 nt, Artificial Sequence
  Oligomer
ugcauugguuguguaacug

SEQ ID NO: 79496 - RNA, 19 nt, Artificial Sequence
  Oligomer
aguaacauggaaagcacuu

SEQ ID NO: 79497 - RNA, 19 nt, Artificial Sequence
  Oligomer
aagcacuuacuaaguuagc

SEQ ID NO: 79498 - RNA, 19 nt, Artificial Sequence
  Oligomer
cucacuggugaguucaaug

SEQ ID NO: 79499 - RNA, 19 nt, Artificial Sequence
  Oligomer
aacuacauaggagagcaag

SEQ ID NO: 79500 - RNA, 19 nt, Artificial Sequence
  Oligomer
agguauuuuggcaacucuu

SEQ ID NO: 79501 - RNA, 19 nt, Artificial Sequence
  Oligomer
agucugaacucuuacauuu

SEQ ID NO: 79502 - RNA, 19 nt, Artificial Sequence
  Oligomer
ucggaucgcuucgucaaac

SEQ ID NO: 79503 - RNA, 19 nt, Artificial Sequence
  Oligomer
ucgaucgugucuuuaucau

SEQ ID NO: 79504 - RNA, 19 nt, Artificial Sequence
  Oligomer
ucuguuguaguggcugaag

SEQ ID NO: 79505 - RNA, 19 nt, Artificial Sequence
  Oligomer
uucucgccagugaguuaag

SEQ ID NO: 79506 - RNA, 19 nt, Artificial Sequence
  Oligomer
gagguaaagagggucagua

SEQ ID NO: 79507 - RNA, 19 nt, Artificial Sequence
  Oligomer
aguauuggucaagugacag

SEQ ID NO: 79508 - RNA, 19 nt, Artificial Sequence
  Oligomer
aaagcacuuauuagcucug

SEQ ID NO: 79509 - RNA, 19 nt, Artificial Sequence
  Oligomer
ccugauaauaccaaccuuu

SEQ ID NO: 79510 - RNA, 19 nt, Artificial Sequence
  Oligomer
caaccuuucuuucaucauc

SEQ ID NO: 79511 - RNA, 19 nt, Artificial Sequence
  Oligomer
aaaauacugucuuuguccu

SEQ ID NO: 79512 - RNA, 19 nt, Artificial Sequence
  Oligomer
uacaaagguuccaagggac

SEQ ID NO: 79513 - RNA, 19 nt, Artificial Sequence
  Oligomer
cacuccagguauuuuacag

SEQ ID NO: 79514 - RNA, 19 nt, Artificial Sequence
  Oligomer
cgugucuuuaucaucccua

SEQ ID NO: 79515 - RNA, 19 nt, Artificial Sequence
  Oligomer
ccacuuugcacggacauuu

SEQ ID NO: 79516 - RNA, 19 nt, Artificial Sequence
  Oligomer
cauuuucaaaugaugcagg

SEQ ID NO: 79517 - RNA, 19 nt, Artificial Sequence
  Oligomer
cuguaucccauaagcccag

SEQ ID NO: 79518 - RNA, 19 nt, Artificial Sequence
  Oligomer
aggcaaagcgacuacagga

SEQ ID NO: 79519 - RNA, 19 nt, Artificial Sequence
  Oligomer
aaacuauaaagcugcaaca

SEQ ID NO: 79520 - RNA, 19 nt, Artificial Sequence
  Oligomer
acauggaaagcacuuuuac

SEQ ID NO: 79521 - RNA, 19 nt, Artificial Sequence
  Oligomer
uaauacaaggaggcauauu

SEQ ID NO: 79522 - RNA, 19 nt, Artificial Sequence
  Oligomer
acuuacuaaguuagcgacu

SEQ ID NO: 79523 - RNA, 19 nt, Artificial Sequence
  Oligomer
cugaucaguaggcaaguuu

SEQ ID NO: 79524 - RNA, 19 nt, Artificial Sequence
  Oligomer
uacugcauuugacagaaau

SEQ ID NO: 79525 - RNA, 19 nt, Artificial Sequence
  Oligomer
agaguuuuuacccgugaca

SEQ ID NO: 79526 - RNA, 19 nt, Artificial Sequence
  Oligomer
agacugauccaaagagcug

SEQ ID NO: 79527 - RNA, 19 nt, Artificial Sequence
  Oligomer
gaacacgugcugcuaacuc

SEQ ID NO: 79528 - RNA, 19 nt, Artificial Sequence
  Oligomer
cugagaacuacauaggaga

SEQ ID NO: 79529 - RNA, 19 nt, Artificial Sequence
  Oligomer
acuacauaggagagcaagu

SEQ ID NO: 79530 - RNA, 19 nt, Artificial Sequence
  Oligomer
agaaggcuugucauuuuag

SEQ ID NO: 79531 - RNA, 19 nt, Artificial Sequence
  Oligomer
aaaaguuggcauugagugc

SEQ ID NO: 79532 - RNA, 19 nt, Artificial Sequence
  Oligomer
uuacaacagcaggcauuuu

SEQ ID NO: 79533 - RNA, 19 nt, Artificial Sequence
  Oligomer
gaugggagucagcuucuuc

SEQ ID NO: 79534 - RNA, 19 nt, Artificial Sequence
  Oligomer
ucaaaugaugcaggacuca

SEQ ID NO: 79535 - RNA, 19 nt, Artificial Sequence
  Oligomer
ccacaauucugcaacuguc

SEQ ID NO: 79536 - RNA, 19 nt, Artificial Sequence
  Oligomer
ucgguaaucuggcaagaca

SEQ ID NO: 79537 - RNA, 19 nt, Artificial Sequence
  Oligomer
aaagcugcaacacaugauu

SEQ ID NO: 79538 - RNA, 19 nt, Artificial Sequence
  Oligomer
aaaguaacauggaaagcac

SEQ ID NO: 79539 - RNA, 19 nt, Artificial Sequence
  Oligomer
ucgacaaaaaaaccuucua

SEQ ID NO: 79540 - RNA, 19 nt, Artificial Sequence
  Oligomer
cuucuaaugcauuaucaga

SEQ ID NO: 79541 - RNA, 19 nt, Artificial Sequence
  Oligomer
aagagaaaggaaaagcuua

SEQ ID NO: 79542 - RNA, 19 nt, Artificial Sequence
  Oligomer
uccugauaauaccaaccuu

SEQ ID NO: 79543 - RNA, 19 nt, Artificial Sequence
  Oligomer
uaggcaaguuuuaccuaca

SEQ ID NO: 79544 - RNA, 19 nt, Artificial Sequence
  Oligomer
cuacgcucacuccauuaca

SEQ ID NO: 79545 - RNA, 19 nt, Artificial Sequence
  Oligomer
ugcugcuaacucacuggug

SEQ ID NO: 79546 - RNA, 19 nt, Artificial Sequence
  Oligomer
acugcagaagcuaccgucu

SEQ ID NO: 79547 - RNA, 19 nt, Artificial Sequence
  Oligomer
cucggcacaacaaugcagu

SEQ ID NO: 79548 - RNA, 19 nt, Artificial Sequence
  Oligomer
auagaaugugagucugaac

SEQ ID NO: 79549 - RNA, 19 nt, Artificial Sequence
  Oligomer
ugagucugaacucuuacau

SEQ ID NO: 79550 - RNA, 19 nt, Artificial Sequence
  Oligomer
caaaugaugcaggacucac

SEQ ID NO: 79551 - RNA, 19 nt, Artificial Sequence
  Oligomer
aagggaaaagcaaauuaag

SEQ ID NO: 79552 - RNA, 19 nt, Artificial Sequence
  Oligomer
cccagauucaccgguuuuc

SEQ ID NO: 79553 - RNA, 19 nt, Artificial Sequence
  Oligomer
aucuaccauaacauuggca

SEQ ID NO: 79554 - RNA, 19 nt, Artificial Sequence
  Oligomer
aggaaaacugcagagaaac

SEQ ID NO: 79555 - RNA, 19 nt, Artificial Sequence
  Oligomer
guaaaaacacuccacaauu

SEQ ID NO: 79556 - RNA, 19 nt, Artificial Sequence
  Oligomer
ugaguuaaguuguacagaa

SEQ ID NO: 79557 - RNA, 19 nt, Artificial Sequence
  Oligomer
aaaacugcagagaaacagg

SEQ ID NO: 79558 - RNA, 19 nt, Artificial Sequence
  Oligomer
cuauaaagcugcaacacau

SEQ ID NO: 79559 - RNA, 19 nt, Artificial Sequence
  Oligomer
aaaacuaaggaaagcacuu

SEQ ID NO: 79560 - RNA, 19 nt, Artificial Sequence
  Oligomer
ccuuucuuucaucaucuac

SEQ ID NO: 79561 - RNA, 19 nt, Artificial Sequence
  Oligomer
aguuuuuacccgugacacu

SEQ ID NO: 79562 - RNA, 19 nt, Artificial Sequence
  Oligomer
caaguuuuaccuacagcuc

SEQ ID NO: 79563 - RNA, 19 nt, Artificial Sequence
  Oligomer
uacugucuuuguccuuuga

SEQ ID NO: 79564 - RNA, 19 nt, Artificial Sequence
  Oligomer
acugucuuuguccuuugau

SEQ ID NO: 79565 - RNA, 19 nt, Artificial Sequence
  Oligomer
agcaguucuguucaaaauc

SEQ ID NO: 79566 - RNA, 19 nt, Artificial Sequence
  Oligomer
acucgcuaugaaaucacaa

SEQ ID NO: 79567 - RNA, 19 nt, Artificial Sequence
  Oligomer
uggugaguucaauggcaac

SEQ ID NO: 79568 - RNA, 19 nt, Artificial Sequence
  Oligomer
ucugcaccuccuaacugca

SEQ ID NO: 79569 - RNA, 19 nt, Artificial Sequence
  Oligomer
agcuaccgucuucucaaag

SEQ ID NO: 79570 - RNA, 19 nt, Artificial Sequence
  Oligomer
uguaacaaaaaguuggcau

SEQ ID NO: 79571 - RNA, 19 nt, Artificial Sequence
  Oligomer
caggcauuuucucuuccuc

SEQ ID NO: 79572 - RNA, 19 nt, Artificial Sequence
  Oligomer
cgcuucgucaaacacuguc

SEQ ID NO: 79573 - RNA, 19 nt, Artificial Sequence
  Oligomer
cucgaucgugucuuuauca

SEQ ID NO: 79574 - RNA, 19 nt, Artificial Sequence
  Oligomer
ccucaggauaccacuuugc

SEQ ID NO: 79575 - RNA, 19 nt, Artificial Sequence
  Oligomer
aggauaccacuuugcacgg

SEQ ID NO: 79576 - RNA, 19 nt, Artificial Sequence
  Oligomer
augaugcaggacucacaag

SEQ ID NO: 79577 - RNA, 19 nt, Artificial Sequence
  Oligomer
uaccauaacauuggcagaa

SEQ ID NO: 79578 - RNA, 19 nt, Artificial Sequence
  Oligomer
auguaaaaacacuccacaa

SEQ ID NO: 79579 - RNA, 19 nt, Artificial Sequence
  Oligomer
cacuccacaauucugcaac

SEQ ID NO: 79580 - RNA, 19 nt, Artificial Sequence
  Oligomer
acuagcacaguuuacagaa

SEQ ID NO: 79581 - RNA, 19 nt, Artificial Sequence
  Oligomer
agguaaagagggucaguau

SEQ ID NO: 79582 - RNA, 19 nt, Artificial Sequence
  Oligomer
uguuaagaagguucauagu

SEQ ID NO: 79583 - RNA, 19 nt, Artificial Sequence
  Oligomer
acuagaaaacuaaggaaag

SEQ ID NO: 79584 - RNA, 19 nt, Artificial Sequence
  Oligomer
uggaaagcacuuuuacuaa

SEQ ID NO: 79585 - RNA, 19 nt, Artificial Sequence
  Oligomer
accuucuaaugcauuauca

SEQ ID NO: 79586 - RNA, 19 nt, Artificial Sequence
  Oligomer
uuacuaaguuagcgacuaa

SEQ ID NO: 79587 - RNA, 19 nt, Artificial Sequence
  Oligomer
acauuuccugauaauacca

SEQ ID NO: 79588 - RNA, 19 nt, Artificial Sequence
  Oligomer
uacccgugacacuuucauu

SEQ ID NO: 79589 - RNA, 19 nt, Artificial Sequence
  Oligomer
cuaugaaaucacaaagacu

SEQ ID NO: 79590 - RNA, 19 nt, Artificial Sequence
  Oligomer
agagcaagugucugcaccu

SEQ ID NO: 79591 - RNA, 19 nt, Artificial Sequence
  Oligomer
ucagaagguauuuuggcaa

SEQ ID NO: 79592 - RNA, 19 nt, Artificial Sequence
  Oligomer
acaaaaaguuggcauugag

SEQ ID NO: 79593 - RNA, 19 nt, Artificial Sequence
  Oligomer
ucgcuucgucaaacacugu

SEQ ID NO: 79594 - RNA, 19 nt, Artificial Sequence
  Oligomer
cucaggauaccacuuugca

SEQ ID NO: 79595 - RNA, 19 nt, Artificial Sequence
  Oligomer
uucuguuguaguggcugaa

SEQ ID NO: 79596 - RNA, 19 nt, Artificial Sequence
  Oligomer
uauucuccaggaaaugcau

SEQ ID NO: 79597 - RNA, 19 nt, Artificial Sequence
  Oligomer
acaucaauaggcaaagcga

SEQ ID NO: 79598 - RNA, 19 nt, Artificial Sequence
  Oligomer
cauggaaagcacuuuuacu

SEQ ID NO: 79599 - RNA, 19 nt, Artificial Sequence
  Oligomer
aaauacugucuuuguccuu

SEQ ID NO: 79600 - RNA, 19 nt, Artificial Sequence
  Oligomer
acgcucacuccauuacagu

SEQ ID NO: 79601 - RNA, 19 nt, Artificial Sequence
  Oligomer
guucaauggcaacgcuuca

SEQ ID NO: 79602 - RNA, 19 nt, Artificial Sequence
  Oligomer
cuuuacgcaucugagaacu

SEQ ID NO: 79603 - RNA, 19 nt, Artificial Sequence
  Oligomer
gcaucugagaacuacauag

SEQ ID NO: 79604 - RNA, 19 nt, Artificial Sequence
  Oligomer
agaagcuaccgucuucuca

SEQ ID NO: 79605 - RNA, 19 nt, Artificial Sequence
  Oligomer
gcauuuucucuuccucuuc

SEQ ID NO: 79606 - RNA, 19 nt, Artificial Sequence
  Oligomer
accaccacacacuugaugg

SEQ ID NO: 79607 - RNA, 19 nt, Artificial Sequence
  Oligomer
acacacuugauggccugca

SEQ ID NO: 79608 - RNA, 19 nt, Artificial Sequence
  Oligomer
auaccacuuugcacggaca

SEQ ID NO: 79609 - RNA, 19 nt, Artificial Sequence
  Oligomer
aaucuucuuguccagcugu

SEQ ID NO: 79610 - RNA, 19 nt, Artificial Sequence
  Oligomer
uguccagcuguaucccaua

SEQ ID NO: 79611 - RNA, 19 nt, Artificial Sequence
  Oligomer
ugaggaaaacugcagagaa

SEQ ID NO: 79612 - RNA, 19 nt, Artificial Sequence
  Oligomer
ucaaagacaguagggauau

SEQ ID NO: 79613 - RNA, 19 nt, Artificial Sequence
  Oligomer
aagacaguagggauauauu

SEQ ID NO: 79614 - RNA, 19 nt, Artificial Sequence
  Oligomer
gacaguagggauauauucu

SEQ ID NO: 79615 - RNA, 19 nt, Artificial Sequence
  Oligomer
aguagggauauauucucca

SEQ ID NO: 79616 - RNA, 19 nt, Artificial Sequence
  Oligomer
acaucgucagcacuagcac

SEQ ID NO: 79617 - RNA, 19 nt, Artificial Sequence
  Oligomer
acagacccaaaggaacauc

SEQ ID NO: 79618 - RNA, 19 nt, Artificial Sequence
  Oligomer
gucaguauuggucaaguga

SEQ ID NO: 79619 - RNA, 19 nt, Artificial Sequence
  Oligomer
aacuauaaagcugcaacac

SEQ ID NO: 79620 - RNA, 19 nt, Artificial Sequence
  Oligomer
aaguuagcgacuaacagaa

SEQ ID NO: 79621 - RNA, 19 nt, Artificial Sequence
  Oligomer
ucuacugcauuugacagaa

SEQ ID NO: 79622 - RNA, 19 nt, Artificial Sequence
  Oligomer
gaguuuuuacccgugacac

SEQ ID NO: 79623 - RNA, 19 nt, Artificial Sequence
  Oligomer
ugaaaucacaaagacugau

SEQ ID NO: 79624 - RNA, 19 nt, Artificial Sequence
  Oligomer
ugagaacuacauaggagag

SEQ ID NO: 79625 - RNA, 19 nt, Artificial Sequence
  Oligomer
agcguacaaagguuccaag

SEQ ID NO: 79626 - RNA, 19 nt, Artificial Sequence
  Oligomer
aauugucaaagacaguagg

SEQ ID NO: 79627 - RNA, 19 nt, Artificial Sequence
  Oligomer
uauucucgccagugaguua

SEQ ID NO: 79628 - RNA, 19 nt, Artificial Sequence
  Oligomer
aguuguacagaacaucguc

SEQ ID NO: 79629 - RNA, 19 nt, Artificial Sequence
  Oligomer
ucgucagcacuagcacagu

SEQ ID NO: 79630 - RNA, 19 nt, Artificial Sequence
  Oligomer
acccaaaggaacaucaaua

SEQ ID NO: 79631 - RNA, 19 nt, Artificial Sequence
  Oligomer
uuacaccuaguuacuagaa

SEQ ID NO: 79632 - RNA, 19 nt, Artificial Sequence
  Oligomer
guucuauaagaaaagcacu

SEQ ID NO: 79633 - RNA, 19 nt, Artificial Sequence
  Oligomer
cuuucauuccuuguacaau

SEQ ID NO: 79634 - RNA, 19 nt, Artificial Sequence
  Oligomer
guaaaucuccacuucguau

SEQ ID NO: 79635 - RNA, 19 nt, Artificial Sequence
  Oligomer
ucagaaaacucgcuaugaa

SEQ ID NO: 79636 - RNA, 19 nt, Artificial Sequence
  Oligomer
ugcaccuccuaacugcaga

SEQ ID NO: 79637 - RNA, 19 nt, Artificial Sequence
  Oligomer
aguguaguucagaagguau

SEQ ID NO: 79638 - RNA, 19 nt, Artificial Sequence
  Oligomer
ugucauuuuagggcuaaau

SEQ ID NO: 79639 - RNA, 19 nt, Artificial Sequence
  Oligomer
agcacuccagguauuuuac

SEQ ID NO: 79640 - RNA, 19 nt, Artificial Sequence
  Oligomer
ugaugggaguguugggaca

SEQ ID NO: 79641 - RNA, 19 nt, Artificial Sequence
  Oligomer
ugcaggacucacaagggaa

SEQ ID NO: 79642 - RNA, 19 nt, Artificial Sequence
  Oligomer
ucuucuuguccagcuguau

SEQ ID NO: 79643 - RNA, 19 nt, Artificial Sequence
  Oligomer
agauucaccgguuuuccau

SEQ ID NO: 79644 - RNA, 19 nt, Artificial Sequence
  Oligomer
uguauucucgccagugagu

SEQ ID NO: 79645 - RNA, 19 nt, Artificial Sequence
  Oligomer
cagugaguuaaguuguaca

SEQ ID NO: 79646 - RNA, 19 nt, Artificial Sequence
  Oligomer
cagaacaucgucagcacua

SEQ ID NO: 79647 - RNA, 19 nt, Artificial Sequence
  Oligomer
augcauugguuguguaacu

SEQ ID NO: 79648 - RNA, 19 nt, Artificial Sequence
  Oligomer
acagcuaaacagaauucuu

SEQ ID NO: 79649 - RNA, 19 nt, Artificial Sequence
  Oligomer
aagugucugcaccuccuaa

SEQ ID NO: 79650 - RNA, 19 nt, Artificial Sequence
  Oligomer
guauuuuggcaacucuuaa

SEQ ID NO: 79651 - RNA, 19 nt, Artificial Sequence
  Oligomer
uugucauuuuagggcuaaa

SEQ ID NO: 79652 - RNA, 19 nt, Artificial Sequence
  Oligomer
agcuucuucuccuucaguu

SEQ ID NO: 79653 - RNA, 19 nt, Artificial Sequence
  Oligomer
ucuccuucaguuucucgau

SEQ ID NO: 79654 - RNA, 19 nt, Artificial Sequence
  Oligomer
aagcugaggaaaacugcag

SEQ ID NO: 79655 - RNA, 19 nt, Artificial Sequence
  Oligomer
gauucaccgguuuuccauc

SEQ ID NO: 79656 - RNA, 19 nt, Artificial Sequence
  Oligomer
auucugcaacugucaauuu

SEQ ID NO: 79657 - RNA, 19 nt, Artificial Sequence
  Oligomer
ucagcacuagcacaguuua

SEQ ID NO: 79658 - RNA, 19 nt, Artificial Sequence
  Oligomer
cucacagacccaaaggaac

SEQ ID NO: 79659 - RNA, 19 nt, Artificial Sequence
  Oligomer
caucaauaggcaaagcgac

SEQ ID NO: 79660 - RNA, 19 nt, Artificial Sequence
  Oligomer
gguaaagagggucaguauu

SEQ ID NO: 79661 - RNA, 19 nt, Artificial Sequence
  Oligomer
ugguuguguaacugaucag

SEQ ID NO: 79662 - RNA, 19 nt, Artificial Sequence
  Oligomer
aacauggaaagcacuuuua

SEQ ID NO: 79663 - RNA, 19 nt, Artificial Sequence
  Oligomer
acuaaguuagcgacuaaca

SEQ ID NO: 79664 - RNA, 19 nt, Artificial Sequence
  Oligomer
ucauuccuuguacaaugua

SEQ ID NO: 79665 - RNA, 19 nt, Artificial Sequence
  Oligomer
ccuuguacaauguagugua

SEQ ID NO: 79666 - RNA, 19 nt, Artificial Sequence
  Oligomer
gucuuuguccuuugaucac

SEQ ID NO: 79667 - RNA, 19 nt, Artificial Sequence
  Oligomer
acacccacagcuaaacaga

SEQ ID NO: 79668 - RNA, 19 nt, Artificial Sequence
  Oligomer
ugcagagaaacaggaaaug

SEQ ID NO: 79669 - RNA, 19 nt, Artificial Sequence
  Oligomer
ucggcacaacaaugcagug

SEQ ID NO: 79670 - RNA, 19 nt, Artificial Sequence
  Oligomer
caaaaaguuggcauugagu

SEQ ID NO: 79671 - RNA, 19 nt, Artificial Sequence
  Oligomer
ucuccuuagccauggcuag

SEQ ID NO: 79672 - RNA, 19 nt, Artificial Sequence
  Oligomer
augggaguguugggacagu

SEQ ID NO: 79673 - RNA, 19 nt, Artificial Sequence
  Oligomer
agggaaaagcaaauuaaga

SEQ ID NO: 79674 - RNA, 19 nt, Artificial Sequence
  Oligomer
cacaauucugcaacuguca

SEQ ID NO: 79675 - RNA, 19 nt, Artificial Sequence
  Oligomer
aucuggcaagacagugaug

SEQ ID NO: 79676 - RNA, 19 nt, Artificial Sequence
  Oligomer
aaguaacauggaaagcacu

SEQ ID NO: 79677 - RNA, 19 nt, Artificial Sequence
  Oligomer
aggcauauugcucagucag

SEQ ID NO: 79678 - RNA, 19 nt, Artificial Sequence
  Oligomer
agaaaagcacuuacuaagu

SEQ ID NO: 79679 - RNA, 19 nt, Artificial Sequence
  Oligomer
cagaacaaccaguuuaaag

SEQ ID NO: 79680 - RNA, 19 nt, Artificial Sequence
  Oligomer
gucaaaauacugucuuugu

SEQ ID NO: 79681 - RNA, 19 nt, Artificial Sequence
  Oligomer
agaaaacucgcuaugaaau

SEQ ID NO: 79682 - RNA, 19 nt, Artificial Sequence
  Oligomer
ugcuuuacgcaucugagaa

SEQ ID NO: 79683 - RNA, 19 nt, Artificial Sequence
  Oligomer
aucuccuuagccauggcua

SEQ ID NO: 79684 - RNA, 19 nt, Artificial Sequence
  Oligomer
cgaucgugucuuuaucauc

SEQ ID NO: 79685 - RNA, 19 nt, Artificial Sequence
  Oligomer
aagggucccacgcuguauu

SEQ ID NO: 79686 - RNA, 19 nt, Artificial Sequence
  Oligomer
gucagcacuagcacaguuu

SEQ ID NO: 79687 - RNA, 19 nt, Artificial Sequence
  Oligomer
gcacaguuuacagaaccuc

SEQ ID NO: 79688 - RNA, 19 nt, Artificial Sequence
  Oligomer
uggcaagacagugauguua

SEQ ID NO: 79689 - RNA, 19 nt, Artificial Sequence
  Oligomer
caugauuuuuacaccuagu

SEQ ID NO: 79690 - RNA, 19 nt, Artificial Sequence
  Oligomer
accuaguuacuagaaaacu

SEQ ID NO: 79691 - RNA, 19 nt, Artificial Sequence
  Oligomer
gaaagcacuuuuacuaauc

SEQ ID NO: 79692 - RNA, 19 nt, Artificial Sequence
  Oligomer
agcacuuacuaaguuagcg

SEQ ID NO: 79693 - RNA, 19 nt, Artificial Sequence
  Oligomer
gaauuaaaugcccaauuug

SEQ ID NO: 79694 - RNA, 19 nt, Artificial Sequence
  Oligomer
cccgugacacuuucauucc

SEQ ID NO: 79695 - RNA, 19 nt, Artificial Sequence
  Oligomer
acaauguuaugucgggaac

SEQ ID NO: 79696 - RNA, 19 nt, Artificial Sequence
  Oligomer
caauggcaacgcuucauuc

SEQ ID NO: 79697 - RNA, 19 nt, Artificial Sequence
  Oligomer
ucucaaagacgaaggucuu

SEQ ID NO: 79698 - RNA, 19 nt, Artificial Sequence
  Oligomer
acaacaaugcaguguaguu

SEQ ID NO: 79699 - RNA, 19 nt, Artificial Sequence
  Oligomer
guguaguucagaagguauu

SEQ ID NO: 79700 - RNA, 19 nt, Artificial Sequence
  Oligomer
cguacaaagguuccaaggg

SEQ ID NO: 79701 - RNA, 19 nt, Artificial Sequence
  Oligomer
cagguauuuuacagcacca

SEQ ID NO: 79702 - RNA, 19 nt, Artificial Sequence
  Oligomer
gauaccacuuugcacggac

SEQ ID NO: 79703 - RNA, 19 nt, Artificial Sequence
  Oligomer
aucuucuuguccagcugua

SEQ ID NO: 79704 - RNA, 19 nt, Artificial Sequence
  Oligomer
accgguuuuccaucuacca

SEQ ID NO: 79705 - RNA, 19 nt, Artificial Sequence
  Oligomer
cuccacaauucugcaacug

SEQ ID NO: 79706 - RNA, 19 nt, Artificial Sequence
  Oligomer
acagaacaucgucagcacu

SEQ ID NO: 79707 - RNA, 19 nt, Artificial Sequence
  Oligomer
agcacuagcacaguuuaca

SEQ ID NO: 79708 - RNA, 19 nt, Artificial Sequence
  Oligomer
uacaccuaguuacuagaaa

SEQ ID NO: 79709 - RNA, 19 nt, Artificial Sequence
  Oligomer
acuaaggaaagcacuuauu

SEQ ID NO: 79710 - RNA, 19 nt, Artificial Sequence
  Oligomer
gcacuuuuacuaaucgaca

SEQ ID NO: 79711 - RNA, 19 nt, Artificial Sequence
  Oligomer
agaacaaccaguuuaaaga

SEQ ID NO: 79712 - RNA, 19 nt, Artificial Sequence
  Oligomer
acuuucauuccuuguacaa

SEQ ID NO: 79713 - RNA, 19 nt, Artificial Sequence
  Oligomer
guuaugucgggaacacgug

SEQ ID NO: 79714 - RNA, 19 nt, Artificial Sequence
  Oligomer
ggugaguucaauggcaacg

SEQ ID NO: 79715 - RNA, 19 nt, Artificial Sequence
  Oligomer
cauaggagagcaagugucu

SEQ ID NO: 79716 - RNA, 19 nt, Artificial Sequence
  Oligomer
cuuuaagaaggcuugucau

SEQ ID NO: 79717 - RNA, 19 nt, Artificial Sequence
  Oligomer
gcguacaaagguuccaagg

SEQ ID NO: 79718 - RNA, 19 nt, Artificial Sequence
  Oligomer
uguaucccauaagcccaga

SEQ ID NO: 79719 - RNA, 19 nt, Artificial Sequence
  Oligomer
cccauaagcccagauucac

SEQ ID NO: 79720 - RNA, 19 nt, Artificial Sequence
  Oligomer
ccaucuaccauaacauugg

SEQ ID NO: 79721 - RNA, 19 nt, Artificial Sequence
  Oligomer
guuguaguggcugaagggu

SEQ ID NO: 79722 - RNA, 19 nt, Artificial Sequence
  Oligomer
cuguauucucgccagugag

SEQ ID NO: 79723 - RNA, 19 nt, Artificial Sequence
  Oligomer
aguuaaguuguacagaaca

SEQ ID NO: 79724 - RNA, 19 nt, Artificial Sequence
  Oligomer
gaacaucgucagcacuagc

SEQ ID NO: 79725 - RNA, 19 nt, Artificial Sequence
  Oligomer
cauauugcucagucagaag

SEQ ID NO: 79726 - RNA, 19 nt, Artificial Sequence
  Oligomer
agguguaagagaaaggaaa

SEQ ID NO: 79727 - RNA, 19 nt, Artificial Sequence
  Oligomer
cuguucaaaaucuccgcaa

SEQ ID NO: 79728 - RNA, 19 nt, Artificial Sequence
  Oligomer
gaggcuguucugcuuuacg

SEQ ID NO: 79729 - RNA, 19 nt, Artificial Sequence
  Oligomer
aaguucagugcucgguguu

SEQ ID NO: 79730 - RNA, 19 nt, Artificial Sequence
  Oligomer
aacucuuaaucugaacaag

SEQ ID NO: 79731 - RNA, 19 nt, Artificial Sequence
  Oligomer
ggcugagacauuuacaaca

SEQ ID NO: 79732 - RNA, 19 nt, Artificial Sequence
  Oligomer
cuccuucaguuucucgauc

SEQ ID NO: 79733 - RNA, 19 nt, Artificial Sequence
  Oligomer
agucauacaugcaaaacau

SEQ ID NO: 79734 - RNA, 19 nt, Artificial Sequence
  Oligomer
ugcuaauugcauuagcaaa

SEQ ID NO: 79735 - RNA, 19 nt, Artificial Sequence
  Oligomer
auucuccaggaaaugcauu

SEQ ID NO: 79736 - RNA, 19 nt, Artificial Sequence
  Oligomer
aggaacaucaauaggcaaa

SEQ ID NO: 79737 - RNA, 19 nt, Artificial Sequence
  Oligomer
agugacagugucgguaauc

SEQ ID NO: 79738 - RNA, 19 nt, Artificial Sequence
  Oligomer
aagcugcaacacaugauuu

SEQ ID NO: 79739 - RNA, 19 nt, Artificial Sequence
  Oligomer
aaacugcagagaaacagga

SEQ ID NO: 79740 - RNA, 19 nt, Artificial Sequence
  Oligomer
ccuucuaaugcauuaucag

SEQ ID NO: 79741 - RNA, 19 nt, Artificial Sequence
  Oligomer
gguucuauaagaaaagcac

SEQ ID NO: 79742 - RNA, 19 nt, Artificial Sequence
  Oligomer
aggcauggcagguguaaga

SEQ ID NO: 79743 - RNA, 19 nt, Artificial Sequence
  Oligomer
aggaaaagcuuaagaaaac

SEQ ID NO: 79744 - RNA, 19 nt, Artificial Sequence
  Oligomer
gcauuugacagaaauuaac

SEQ ID NO: 79745 - RNA, 19 nt, Artificial Sequence
  Oligomer
gaaaacucgcuaugaaauc

SEQ ID NO: 79746 - RNA, 19 nt, Artificial Sequence
  Oligomer
acgcaucugagaacuacau

SEQ ID NO: 79747 - RNA, 21 nt, Artificial Sequence
  Oligomer
gguuguucuguuagucgcuaa

SEQ ID NO: 79748 - RNA, 21 nt, Artificial Sequence
  Oligomer
caauacugacccucuuuaccu

SEQ ID NO: 79749 - RNA, 21 nt, Artificial Sequence
  Oligomer
caauguuaugguagauggaaa

SEQ ID NO: 79750 - RNA, 21 nt, Artificial Sequence
  Oligomer
ccgugaagaagaggaagagaa

SEQ ID NO: 79751 - RNA, 21 nt, Artificial Sequence
  Oligomer
cgugaagaagaggaagagaaa

SEQ ID NO: 79752 - RNA, 21 nt, Artificial Sequence
  Oligomer
ggagauuuacacuacauugua

SEQ ID NO: 79753 - RNA, 21 nt, Artificial Sequence
  Oligomer
gaaugaaagugucacggguaa

SEQ ID NO: 79754 - RNA, 21 nt, Artificial Sequence
  Oligomer
gauaaagacacgaucgagaaa

SEQ ID NO: 79755 - RNA, 21 nt, Artificial Sequence
  Oligomer
uaaggagauuggugcuguaaa

SEQ ID NO: 79756 - RNA, 21 nt, Artificial Sequence
  Oligomer
gugucacggguaaaaacucua

SEQ ID NO: 79757 - RNA, 21 nt, Artificial Sequence
  Oligomer
cauuugaaaauguccgugcaa

SEQ ID NO: 79758 - RNA, 21 nt, Artificial Sequence
  Oligomer
ggguaaaaacucuaaaagguu

SEQ ID NO: 79759 - RNA, 21 nt, Artificial Sequence
  Oligomer
ggacaagaagauuaugacaga

SEQ ID NO: 79760 - RNA, 21 nt, Artificial Sequence
  Oligomer
ggugaaucugggcuuauggga

SEQ ID NO: 79761 - RNA, 21 nt, Artificial Sequence
  Oligomer
gaucgagaaacugaaggagaa

SEQ ID NO: 79762 - RNA, 21 nt, Artificial Sequence
  Oligomer
ccgugcaaagugguauccuga

SEQ ID NO: 79763 - RNA, 21 nt, Artificial Sequence
  Oligomer
ggaugauaaagacacgaucga

SEQ ID NO: 79764 - RNA, 21 nt, Artificial Sequence
  Oligomer
ugauaaagacacgaucgagaa

SEQ ID NO: 79765 - RNA, 21 nt, Artificial Sequence
  Oligomer
ggaaugaaagugucacgggua

SEQ ID NO: 79766 - RNA, 21 nt, Artificial Sequence
  Oligomer
ccaauacugacccucuuuacc

SEQ ID NO: 79767 - RNA, 21 nt, Artificial Sequence
  Oligomer
ggauacagcuggacaagaaga

SEQ ID NO: 79768 - RNA, 21 nt, Artificial Sequence
  Oligomer
acugcuauuuccucuaaugaa

SEQ ID NO: 79769 - RNA, 21 nt, Artificial Sequence
  Oligomer
cauuguacaaggaaugaaagu

SEQ ID NO: 79770 - RNA, 21 nt, Artificial Sequence
  Oligomer
agacacgaucgagaaacugaa

SEQ ID NO: 79771 - RNA, 21 nt, Artificial Sequence
  Oligomer
ugaucuuagggaugauaaaga

SEQ ID NO: 79772 - RNA, 21 nt, Artificial Sequence
  Oligomer
cagcuuuugcggagauuuuga

SEQ ID NO: 79773 - RNA, 21 nt, Artificial Sequence
  Oligomer
cgugcaaagugguauccugag

SEQ ID NO: 79774 - RNA, 21 nt, Artificial Sequence
  Oligomer
gauguuccuuugggucuguga

SEQ ID NO: 79775 - RNA, 21 nt, Artificial Sequence
  Oligomer
gaaguggagauuuacacuaca

SEQ ID NO: 79776 - RNA, 21 nt, Artificial Sequence
  Oligomer
caaagaccuucgucuuugaga

SEQ ID NO: 79777 - RNA, 21 nt, Artificial Sequence
  Oligomer
ccuacugucuuugacaauuau

SEQ ID NO: 79778 - RNA, 21 nt, Artificial Sequence
  Oligomer
gugcuuuccauguuacuuuau

SEQ ID NO: 79779 - RNA, 21 nt, Artificial Sequence
  Oligomer
guaaaagugcuuuccauguua

SEQ ID NO: 79780 - RNA, 21 nt, Artificial Sequence
  Oligomer
ucacggguaaaaacucuaaaa

SEQ ID NO: 79781 - RNA, 21 nt, Artificial Sequence
  Oligomer
gucacggguaaaaacucuaaa

SEQ ID NO: 79782 - RNA, 21 nt, Artificial Sequence
  Oligomer
gaucaaaggacaaagacagua

SEQ ID NO: 79783 - RNA, 21 nt, Artificial Sequence
  Oligomer
cgguagcuucugcaguuagga

SEQ ID NO: 79784 - RNA, 21 nt, Artificial Sequence
  Oligomer
ccgagcacugaacuuugcaaa

SEQ ID NO: 79785 - RNA, 21 nt, Artificial Sequence
  Oligomer
aaauguccgugcaaaguggua

SEQ ID NO: 79786 - RNA, 21 nt, Artificial Sequence
  Oligomer
caccgagcacugaacuuugca

SEQ ID NO: 79787 - RNA, 21 nt, Artificial Sequence
  Oligomer
aagacacgaucgagaaacuga

SEQ ID NO: 79788 - RNA, 21 nt, Artificial Sequence
  Oligomer
gaaagugucacggguaaaaac

SEQ ID NO: 79789 - RNA, 21 nt, Artificial Sequence
  Oligomer
aggacaaagacaguauuuuga

SEQ ID NO: 79790 - RNA, 21 nt, Artificial Sequence
  Oligomer
ugaagaagaggaagagaaaau

SEQ ID NO: 79791 - RNA, 21 nt, Artificial Sequence
  Oligomer
gacaguguuugacgaagcgau

SEQ ID NO: 79792 - RNA, 21 nt, Artificial Sequence
  Oligomer
caucauccuagugggaacuaa

SEQ ID NO: 79793 - RNA, 21 nt, Artificial Sequence
  Oligomer
cagugaguuagcagcacgugu

SEQ ID NO: 79794 - RNA, 21 nt, Artificial Sequence
  Oligomer
agcuggacaagaagauuauga

SEQ ID NO: 79795 - RNA, 21 nt, Artificial Sequence
  Oligomer
ugggauacagcuggacaagaa

SEQ ID NO: 79796 - RNA, 21 nt, Artificial Sequence
  Oligomer
gaauuguggaguguuuuuaca

SEQ ID NO: 79797 - RNA, 21 nt, Artificial Sequence
  Oligomer
ugugaucaaaggacaaagaca

SEQ ID NO: 79798 - RNA, 21 nt, Artificial Sequence
  Oligomer
gacgguagcuucugcaguuag

SEQ ID NO: 79799 - RNA, 21 nt, Artificial Sequence
  Oligomer
gugaagaagaggaagagaaaa

SEQ ID NO: 79800 - RNA, 21 nt, Artificial Sequence
  Oligomer
cccuacugucuuugacaauua

SEQ ID NO: 79801 - RNA, 21 nt, Artificial Sequence
  Oligomer
uguaauggagugagcguagca

SEQ ID NO: 79802 - RNA, 21 nt, Artificial Sequence
  Oligomer
cauuguacuguaauggaguga

SEQ ID NO: 79803 - RNA, 21 nt, Artificial Sequence
  Oligomer
auguaguucucagaugcguaa

SEQ ID NO: 79804 - RNA, 21 nt, Artificial Sequence
  Oligomer
aguccugcaucauuugaaaau

SEQ ID NO: 79805 - RNA, 21 nt, Artificial Sequence
  Oligomer
gacccuucagccacuacaaca

SEQ ID NO: 79806 - RNA, 21 nt, Artificial Sequence
  Oligomer
uguuagucgcuaacuuaguaa

SEQ ID NO: 79807 - RNA, 21 nt, Artificial Sequence
  Oligomer
guucuguuagucgcuaacuua

SEQ ID NO: 79808 - RNA, 21 nt, Artificial Sequence
  Oligomer
ccauucuuguucagauuaaga

SEQ ID NO: 79809 - RNA, 21 nt, Artificial Sequence
  Oligomer
cuuugacaauuauucugccaa

SEQ ID NO: 79810 - RNA, 21 nt, Artificial Sequence
  Oligomer
agcuaauaagugcuuuccuua

SEQ ID NO: 79811 - RNA, 21 nt, Artificial Sequence
  Oligomer
ugaaagugucacggguaaaaa

SEQ ID NO: 79812 - RNA, 21 nt, Artificial Sequence
  Oligomer
gacaaaauacgaaguggagau

SEQ ID NO: 79813 - RNA, 21 nt, Artificial Sequence
  Oligomer
caaaggacaaagacaguauuu

SEQ ID NO: 79814 - RNA, 21 nt, Artificial Sequence
  Oligomer
gggauacagcuggacaagaag

SEQ ID NO: 79815 - RNA, 21 nt, Artificial Sequence
  Oligomer
ugcauuuccuggagaauauau

SEQ ID NO: 79816 - RNA, 21 nt, Artificial Sequence
  Oligomer
caaugcauuuccuggagaaua

SEQ ID NO: 79817 - RNA, 21 nt, Artificial Sequence
  Oligomer
uguagucgcuuugccuauuga

SEQ ID NO: 79818 - RNA, 21 nt, Artificial Sequence
  Oligomer
gauuaguaaaagugcuuucca

SEQ ID NO: 79819 - RNA, 21 nt, Artificial Sequence
  Oligomer
ugucacggguaaaaacucuaa

SEQ ID NO: 79820 - RNA, 21 nt, Artificial Sequence
  Oligomer
ugacaaaauacgaaguggaga

SEQ ID NO: 79821 - RNA, 21 nt, Artificial Sequence
  Oligomer
uuugacaaaauacgaagugga

SEQ ID NO: 79822 - RNA, 21 nt, Artificial Sequence
  Oligomer
gacaaagacaguauuuugaca

SEQ ID NO: 79823 - RNA, 21 nt, Artificial Sequence
  Oligomer
cuuugugauuucauagcgagu

SEQ ID NO: 79824 - RNA, 21 nt, Artificial Sequence
  Oligomer
aguucagacucacauucuauu

SEQ ID NO: 79825 - RNA, 21 nt, Artificial Sequence
  Oligomer
gauacagcuggacaagaagau

SEQ ID NO: 79826 - RNA, 21 nt, Artificial Sequence
  Oligomer
ccaauguuaugguagauggaa

SEQ ID NO: 79827 - RNA, 21 nt, Artificial Sequence
  Oligomer
gucaaaugcaguagaugauga

SEQ ID NO: 79828 - RNA, 21 nt, Artificial Sequence
  Oligomer
cggguaaaaacucuaaaaggu

SEQ ID NO: 79829 - RNA, 21 nt, Artificial Sequence
  Oligomer
aauacgaaguggagauuuaca

SEQ ID NO: 79830 - RNA, 21 nt, Artificial Sequence
  Oligomer
cagaacagccucccgaaugaa

SEQ ID NO: 79831 - RNA, 21 nt, Artificial Sequence
  Oligomer
guucagauuaagaguugccaa

SEQ ID NO: 79832 - RNA, 21 nt, Artificial Sequence
  Oligomer
auuugaaaauguccgugcaaa

SEQ ID NO: 79833 - RNA, 21 nt, Artificial Sequence
  Oligomer
uagugcugacgauguucugua

SEQ ID NO: 79834 - RNA, 21 nt, Artificial Sequence
  Oligomer
uucagauuaagaguugccaaa

SEQ ID NO: 79835 - RNA, 21 nt, Artificial Sequence
  Oligomer
gaauauaucccuacugucuuu

SEQ ID NO: 79836 - RNA, 21 nt, Artificial Sequence
  Oligomer
acugaucaguuacacaaccaa

SEQ ID NO: 79837 - RNA, 21 nt, Artificial Sequence
  Oligomer
agugcuuuccauguuacuuua

SEQ ID NO: 79838 - RNA, 21 nt, Artificial Sequence
  Oligomer
aaaagugcuuuccauguuacu

SEQ ID NO: 79839 - RNA, 21 nt, Artificial Sequence
  Oligomer
cuguuagucgcuaacuuagua

SEQ ID NO: 79840 - RNA, 21 nt, Artificial Sequence
  Oligomer
aaugaaagugucacggguaaa

SEQ ID NO: 79841 - RNA, 21 nt, Artificial Sequence
  Oligomer
aggagaagaagcugacuccca

SEQ ID NO: 79842 - RNA, 21 nt, Artificial Sequence
  Oligomer
ggcuuaugggauacagcugga

SEQ ID NO: 79843 - RNA, 21 nt, Artificial Sequence
  Oligomer
guguaaaaaucauguguugca

SEQ ID NO: 79844 - RNA, 21 nt, Artificial Sequence
  Oligomer
ugaucaaaggacaaagacagu

SEQ ID NO: 79845 - RNA, 21 nt, Artificial Sequence
  Oligomer
uauguaguucucagaugcgua

SEQ ID NO: 79846 - RNA, 21 nt, Artificial Sequence
  Oligomer
cacucaaugccaacuuuuugu

SEQ ID NO: 79847 - RNA, 21 nt, Artificial Sequence
  Oligomer
aggccucaagacaguguuuga

SEQ ID NO: 79848 - RNA, 21 nt, Artificial Sequence
  Oligomer
aacugaaggagaagaagcuga

SEQ ID NO: 79849 - RNA, 21 nt, Artificial Sequence
  Oligomer
uagggaugauaaagacacgau

SEQ ID NO: 79850 - RNA, 21 nt, Artificial Sequence
  Oligomer
cccaacacucccaucauccua

SEQ ID NO: 79851 - RNA, 21 nt, Artificial Sequence
  Oligomer
ugugaguccugcaucauuuga

SEQ ID NO: 79852 - RNA, 21 nt, Artificial Sequence
  Oligomer
gccaauguuaugguagaugga

SEQ ID NO: 79853 - RNA, 21 nt, Artificial Sequence
  Oligomer
ucucagaugcguaaagcagaa

SEQ ID NO: 79854 - RNA, 21 nt, Artificial Sequence
  Oligomer
uucucagaugcguaaagcaga

SEQ ID NO: 79855 - RNA, 21 nt, Artificial Sequence
  Oligomer
aguucucagaugcguaaagca

SEQ ID NO: 79856 - RNA, 21 nt, Artificial Sequence
  Oligomer
agacgguagcuucugcaguua

SEQ ID NO: 79857 - RNA, 21 nt, Artificial Sequence
  Oligomer
ugaaucugggcuuaugggaua

SEQ ID NO: 79858 - RNA, 21 nt, Artificial Sequence
  Oligomer
augcauuuccuggagaauaua

SEQ ID NO: 79859 - RNA, 21 nt, Artificial Sequence
  Oligomer
aauacagcgugggacccuuca

SEQ ID NO: 79860 - RNA, 21 nt, Artificial Sequence
  Oligomer
cugugagguucuguaaacugu

SEQ ID NO: 79861 - RNA, 21 nt, Artificial Sequence
  Oligomer
gaagguuuuuuugucgauuag

SEQ ID NO: 79862 - RNA, 21 nt, Artificial Sequence
  Oligomer
gcuaacuuaguaagugcuuuu

SEQ ID NO: 79863 - RNA, 21 nt, Artificial Sequence
  Oligomer
guaaaacuugccuacugauca

SEQ ID NO: 79864 - RNA, 21 nt, Artificial Sequence
  Oligomer
aaugcaguagaugaugaaaga

SEQ ID NO: 79865 - RNA, 21 nt, Artificial Sequence
  Oligomer
ugugugugaucaaaggacaaa

SEQ ID NO: 79866 - RNA, 21 nt, Artificial Sequence
  Oligomer
gagaagacgguagcuucugca

SEQ ID NO: 79867 - RNA, 21 nt, Artificial Sequence
  Oligomer
cuccuguagucgcuuugccua

SEQ ID NO: 79868 - RNA, 21 nt, Artificial Sequence
  Oligomer
gggugugugugaucaaaggac

SEQ ID NO: 79869 - RNA, 21 nt, Artificial Sequence
  Oligomer
cgagcacugaacuuugcaaag

SEQ ID NO: 79870 - RNA, 21 nt, Artificial Sequence
  Oligomer
cauccuagugggaacuaaacu

SEQ ID NO: 79871 - RNA, 21 nt, Artificial Sequence
  Oligomer
accaaugcauuuccuggagaa

SEQ ID NO: 79872 - RNA, 21 nt, Artificial Sequence
  Oligomer
caguagaugaugaaagaaagg

SEQ ID NO: 79873 - RNA, 21 nt, Artificial Sequence
  Oligomer
gugugaucaaaggacaaagac

SEQ ID NO: 79874 - RNA, 21 nt, Artificial Sequence
  Oligomer
accgagcacugaacuuugcaa

SEQ ID NO: 79875 - RNA, 21 nt, Artificial Sequence
  Oligomer
caaugccaacuuuuuguuaca

SEQ ID NO: 79876 - RNA, 21 nt, Artificial Sequence
  Oligomer
augauaaagacacgaucgaga

SEQ ID NO: 79877 - RNA, 21 nt, Artificial Sequence
  Oligomer
aaccaaugcauuuccuggaga

SEQ ID NO: 79878 - RNA, 21 nt, Artificial Sequence
  Oligomer
aacugugcuagugcugacgau

SEQ ID NO: 79879 - RNA, 21 nt, Artificial Sequence
  Oligomer
caguuacacaaccaaugcauu

SEQ ID NO: 79880 - RNA, 21 nt, Artificial Sequence
  Oligomer
cuuuggaucagucuuugugau

SEQ ID NO: 79881 - RNA, 21 nt, Artificial Sequence
  Oligomer
gaagcguugccauugaacuca

SEQ ID NO: 79882 - RNA, 21 nt, Artificial Sequence
  Oligomer
ucagaugcguaaagcagaaca

SEQ ID NO: 79883 - RNA, 21 nt, Artificial Sequence
  Oligomer
cgaggccucaagacaguguuu

SEQ ID NO: 79884 - RNA, 21 nt, Artificial Sequence
  Oligomer
cuggacaagaagauuaugaca

SEQ ID NO: 79885 - RNA, 21 nt, Artificial Sequence
  Oligomer
uuaugggauacagcuggacaa

SEQ ID NO: 79886 - RNA, 21 nt, Artificial Sequence
  Oligomer
uugggucugugagguucugua

SEQ ID NO: 79887 - RNA, 21 nt, Artificial Sequence
  Oligomer
aaucauguguugcagcuuuau

SEQ ID NO: 79888 - RNA, 21 nt, Artificial Sequence
  Oligomer
gcuguagguaaaacuugccua

SEQ ID NO: 79889 - RNA, 21 nt, Artificial Sequence
  Oligomer
aguggagauuuacacuacauu

SEQ ID NO: 79890 - RNA, 21 nt, Artificial Sequence
  Oligomer
aaagcagaacagccucccgaa

SEQ ID NO: 79891 - RNA, 21 nt, Artificial Sequence
  Oligomer
acagcuggacaagaagauuau

SEQ ID NO: 79892 - RNA, 21 nt, Artificial Sequence
  Oligomer
guuucucugcaguuuuccuca

SEQ ID NO: 79893 - RNA, 21 nt, Artificial Sequence
  Oligomer
agaauauaucccuacugucuu

SEQ ID NO: 79894 - RNA, 21 nt, Artificial Sequence
  Oligomer
auuucauagcgaguuuucuga

SEQ ID NO: 79895 - RNA, 21 nt, Artificial Sequence
  Oligomer
uuuggaucagucuuugugauu

SEQ ID NO: 79896 - RNA, 21 nt, Artificial Sequence
  Oligomer
aaugaagcguugccauugaac

SEQ ID NO: 79897 - RNA, 21 nt, Artificial Sequence
  Oligomer
auguaagaguucagacucaca

SEQ ID NO: 79898 - RNA, 21 nt, Artificial Sequence
  Oligomer
agccuucgcacucaaugccaa

SEQ ID NO: 79899 - RNA, 21 nt, Artificial Sequence
  Oligomer
ucuugguccugucccuuggaa

SEQ ID NO: 79900 - RNA, 21 nt, Artificial Sequence
  Oligomer
cucaagacaguguuugacgaa

SEQ ID NO: 79901 - RNA, 21 nt, Artificial Sequence
  Oligomer
cuguaaaauaccuggagugcu

SEQ ID NO: 79902 - RNA, 21 nt, Artificial Sequence
  Oligomer
gagcggccauuuccuguuucu

SEQ ID NO: 79903 - RNA, 21 nt, Artificial Sequence
  Oligomer
agauggaaaaccggugaaucu

SEQ ID NO: 79904 - RNA, 21 nt, Artificial Sequence
  Oligomer
guguugcagcuuuauaguuuu

SEQ ID NO: 79905 - RNA, 21 nt, Artificial Sequence
  Oligomer
agaugaugaaagaaagguugg

SEQ ID NO: 79906 - RNA, 21 nt, Artificial Sequence
  Oligomer
aacugcuauuuccucuaauga

SEQ ID NO: 79907 - RNA, 21 nt, Artificial Sequence
  Oligomer
cucccgugaagaagaggaaga

SEQ ID NO: 79908 - RNA, 21 nt, Artificial Sequence
  Oligomer
agaagaagcugacucccauca

SEQ ID NO: 79909 - RNA, 21 nt, Artificial Sequence
  Oligomer
gcuggacaagaagauuaugac

SEQ ID NO: 79910 - RNA, 21 nt, Artificial Sequence
  Oligomer
augggauacagcuggacaaga

SEQ ID NO: 79911 - RNA, 21 nt, Artificial Sequence
  Oligomer
gugaaucugggcuuaugggau

SEQ ID NO: 79912 - RNA, 21 nt, Artificial Sequence
  Oligomer
uaugguagauggaaaaccggu

SEQ ID NO: 79913 - RNA, 21 nt, Artificial Sequence
  Oligomer
aaugcauuuccuggagaauau

SEQ ID NO: 79914 - RNA, 21 nt, Artificial Sequence
  Oligomer
aauugacaguugcagaauugu

SEQ ID NO: 79915 - RNA, 21 nt, Artificial Sequence
  Oligomer
uggagauuuacacuacauugu

SEQ ID NO: 79916 - RNA, 21 nt, Artificial Sequence
  Oligomer
caaaauacgaaguggagauuu

SEQ ID NO: 79917 - RNA, 21 nt, Artificial Sequence
  Oligomer
ggacaaagacaguauuuugac

SEQ ID NO: 79918 - RNA, 21 nt, Artificial Sequence
  Oligomer
ugugugaucaaaggacaaaga

SEQ ID NO: 79919 - RNA, 21 nt, Artificial Sequence
  Oligomer
cuuuugcggagauuuugaaca

SEQ ID NO: 79920 - RNA, 21 nt, Artificial Sequence
  Oligomer
ugcuguaaaauaccuggagug

SEQ ID NO: 79921 - RNA, 21 nt, Artificial Sequence
  Oligomer
aaaauguccgugcaaaguggu

SEQ ID NO: 79922 - RNA, 21 nt, Artificial Sequence
  Oligomer
gacaguugcagaauuguggag

SEQ ID NO: 79923 - RNA, 21 nt, Artificial Sequence
  Oligomer
cuuuaaacugguuguucuguu

SEQ ID NO: 79924 - RNA, 21 nt, Artificial Sequence
  Oligomer
aagaaagguugguauuaucag

SEQ ID NO: 79925 - RNA, 21 nt, Artificial Sequence
  Oligomer
aguagaugaugaaagaaaggu

SEQ ID NO: 79926 - RNA, 21 nt, Artificial Sequence
  Oligomer
gagauuuacacuacauuguac

SEQ ID NO: 79927 - RNA, 21 nt, Artificial Sequence
  Oligomer
aaguggagauuuacacuacau

SEQ ID NO: 79928 - RNA, 21 nt, Artificial Sequence
  Oligomer
guacuguaauggagugagcgu

SEQ ID NO: 79929 - RNA, 21 nt, Artificial Sequence
  Oligomer
gguagcuucugcaguuaggag

SEQ ID NO: 79930 - RNA, 21 nt, Artificial Sequence
  Oligomer
gccaacuuuuuguuacagauu

SEQ ID NO: 79931 - RNA, 21 nt, Artificial Sequence
  Oligomer
ucgagaaacugaaggagaaga

SEQ ID NO: 79932 - RNA, 21 nt, Artificial Sequence
  Oligomer
cacgaucgagaaacugaagga

SEQ ID NO: 79933 - RNA, 21 nt, Artificial Sequence
  Oligomer
aacuaaacuugaucuuaggga

SEQ ID NO: 79934 - RNA, 21 nt, Artificial Sequence
  Oligomer
gacaagaagauuaugacagau

SEQ ID NO: 79935 - RNA, 21 nt, Artificial Sequence
  Oligomer
ggagaauauaucccuacuguc

SEQ ID NO: 79936 - RNA, 21 nt, Artificial Sequence
  Oligomer
acuuaacucacuggcgagaau

SEQ ID NO: 79937 - RNA, 21 nt, Artificial Sequence
  Oligomer
auguguugcagcuuuauaguu

SEQ ID NO: 79938 - RNA, 21 nt, Artificial Sequence
  Oligomer
ccauguuacuuuauucagagc

SEQ ID NO: 79939 - RNA, 21 nt, Artificial Sequence
  Oligomer
agaacagccucccgaaugaag

SEQ ID NO: 79940 - RNA, 21 nt, Artificial Sequence
  Oligomer
cuugcucuccuauguaguucu

SEQ ID NO: 79941 - RNA, 21 nt, Artificial Sequence
  Oligomer
aaaugacaagccuucuuaaag

SEQ ID NO: 79942 - RNA, 21 nt, Artificial Sequence
  Oligomer
aaauguaagaguucagacuca

SEQ ID NO: 79943 - RNA, 21 nt, Artificial Sequence
  Oligomer
cccgugaagaagaggaagaga

SEQ ID NO: 79944 - RNA, 21 nt, Artificial Sequence
  Oligomer
auauaucccuacugucuuuga

SEQ ID NO: 79945 - RNA, 21 nt, Artificial Sequence
  Oligomer
ccuggagaauauaucccuacu

SEQ ID NO: 79946 - RNA, 21 nt, Artificial Sequence
  Oligomer
cauguguugcagcuuuauagu

SEQ ID NO: 79947 - RNA, 21 nt, Artificial Sequence
  Oligomer
aucauguguugcagcuuuaua

SEQ ID NO: 79948 - RNA, 21 nt, Artificial Sequence
  Oligomer
augccaacuuuuuguuacaga

SEQ ID NO: 79949 - RNA, 21 nt, Artificial Sequence
  Oligomer
cugucccuuggaaccuuugua

SEQ ID NO: 79950 - RNA, 21 nt, Artificial Sequence
  Oligomer
uggugcuguaaaauaccugga

SEQ ID NO: 79951 - RNA, 21 nt, Artificial Sequence
  Oligomer
gucuagccauggcuaaggaga

SEQ ID NO: 79952 - RNA, 21 nt, Artificial Sequence
  Oligomer
gaaacugaaggagaagaagcu

SEQ ID NO: 79953 - RNA, 21 nt, Artificial Sequence
  Oligomer
gacacgaucgagaaacugaag

SEQ ID NO: 79954 - RNA, 21 nt, Artificial Sequence
  Oligomer
aaacugugcuagugcugacga

SEQ ID NO: 79955 - RNA, 21 nt, Artificial Sequence
  Oligomer
ugguuguucuguuagucgcua

SEQ ID NO: 79956 - RNA, 21 nt, Artificial Sequence
  Oligomer
cugguuguucuguuagucgcu

SEQ ID NO: 79957 - RNA, 21 nt, Artificial Sequence
  Oligomer
gaugaugaaagaaagguuggu

SEQ ID NO: 79958 - RNA, 21 nt, Artificial Sequence
  Oligomer
acuacauuguacaaggaauga

SEQ ID NO: 79959 - RNA, 21 nt, Artificial Sequence
  Oligomer
cuauguaguucucagaugcgu

SEQ ID NO: 79960 - RNA, 21 nt, Artificial Sequence
  Oligomer
caguuaggaggugcagacacu

SEQ ID NO: 79961 - RNA, 21 nt, Artificial Sequence
  Oligomer
gagcacugaacuuugcaaaga

SEQ ID NO: 79962 - RNA, 21 nt, Artificial Sequence
  Oligomer
ugccaacuuuuuguuacagau

SEQ ID NO: 79963 - RNA, 21 nt, Artificial Sequence
  Oligomer
auuggugcuguaaaauaccug

SEQ ID NO: 79964 - RNA, 21 nt, Artificial Sequence
  Oligomer
uuagggaugauaaagacacga

SEQ ID NO: 79965 - RNA, 21 nt, Artificial Sequence
  Oligomer
uaaacuugaucuuagggauga

SEQ ID NO: 79966 - RNA, 21 nt, Artificial Sequence
  Oligomer
cugucccaacacucccaucau

SEQ ID NO: 79967 - RNA, 21 nt, Artificial Sequence
  Oligomer
aaucugggcuuaugggauaca

SEQ ID NO: 79968 - RNA, 21 nt, Artificial Sequence
  Oligomer
cugugcuagugcugacgaugu

SEQ ID NO: 79969 - RNA, 21 nt, Artificial Sequence
  Oligomer
aguuacacaaccaaugcauuu

SEQ ID NO: 79970 - RNA, 21 nt, Artificial Sequence
  Oligomer
uacugaucaguuacacaacca

SEQ ID NO: 79971 - RNA, 21 nt, Artificial Sequence
  Oligomer
cuugccuacugaucaguuaca

SEQ ID NO: 79972 - RNA, 21 nt, Artificial Sequence
  Oligomer
acgaaguggagauuuacacua

SEQ ID NO: 79973 - RNA, 21 nt, Artificial Sequence
  Oligomer
aacauuguacuguaauggagu

SEQ ID NO: 79974 - RNA, 21 nt, Artificial Sequence
  Oligomer
agugaguuagcagcacguguu

SEQ ID NO: 79975 - RNA, 21 nt, Artificial Sequence
  Oligomer
gccauuuccuguuucucugca

SEQ ID NO: 79976 - RNA, 21 nt, Artificial Sequence
  Oligomer
cucccaucauccuagugggaa

SEQ ID NO: 79977 - RNA, 21 nt, Artificial Sequence
  Oligomer
gcaucauuugaaaauguccgu

SEQ ID NO: 79978 - RNA, 21 nt, Artificial Sequence
  Oligomer
cuuuugcuaaugcaauuagca

SEQ ID NO: 79979 - RNA, 21 nt, Artificial Sequence
  Oligomer
ucauguguugcagcuuuauag

SEQ ID NO: 79980 - RNA, 21 nt, Artificial Sequence
  Oligomer
cacggguaaaaacucuaaaag

SEQ ID NO: 79981 - RNA, 21 nt, Artificial Sequence
  Oligomer
aaagugucacggguaaaaacu

SEQ ID NO: 79982 - RNA, 21 nt, Artificial Sequence
  Oligomer
augaaagugucacggguaaaa

SEQ ID NO: 79983 - RNA, 21 nt, Artificial Sequence
  Oligomer
gugugugaucaaaggacaaag

SEQ ID NO: 79984 - RNA, 21 nt, Artificial Sequence
  Oligomer
gauuggugcuguaaaauaccu

SEQ ID NO: 79985 - RNA, 21 nt, Artificial Sequence
  Oligomer
aucuuagggaugauaaagaca

SEQ ID NO: 79986 - RNA, 21 nt, Artificial Sequence
  Oligomer
uacagcuggacaagaagauua

SEQ ID NO: 79987 - RNA, 21 nt, Artificial Sequence
  Oligomer
caacuuaacucacuggcgaga

SEQ ID NO: 79988 - RNA, 21 nt, Artificial Sequence
  Oligomer
agucgcuuugccuauugaugu

SEQ ID NO: 79989 - RNA, 21 nt, Artificial Sequence
  Oligomer
cauguuacuuuauucagagcu

SEQ ID NO: 79990 - RNA, 21 nt, Artificial Sequence
  Oligomer
auuucugucaaaugcaguaga

SEQ ID NO: 79991 - RNA, 21 nt, Artificial Sequence
  Oligomer
cauucuuguucagauuaagag

SEQ ID NO: 79992 - RNA, 21 nt, Artificial Sequence
  Oligomer
gugcuguaaaauaccuggagu

SEQ ID NO: 79993 - RNA, 21 nt, Artificial Sequence
  Oligomer
gagauuggugcuguaaaauac

SEQ ID NO: 79994 - RNA, 21 nt, Artificial Sequence
  Oligomer
gcggccauuuccuguuucucu

SEQ ID NO: 79995 - RNA, 21 nt, Artificial Sequence
  Oligomer
uuugaaaauguccgugcaaag

SEQ ID NO: 79996 - RNA, 21 nt, Artificial Sequence
  Oligomer
cuugugaguccugcaucauuu

SEQ ID NO: 79997 - RNA, 21 nt, Artificial Sequence
  Oligomer
ugugcuagugcugacgauguu

SEQ ID NO: 79998 - RNA, 21 nt, Artificial Sequence
  Oligomer
cuugaccaauacugacccucu

SEQ ID NO: 79999 - RNA, 21 nt, Artificial Sequence
  Oligomer
uaguaaaagugcuuuccaugu

SEQ ID NO: 80000 - RNA, 21 nt, Artificial Sequence
  Oligomer
ucuguuagucgcuaacuuagu

SEQ ID NO: 80001 - RNA, 21 nt, Artificial Sequence
  Oligomer
aaaugcaguagaugaugaaag

SEQ ID NO: 80002 - RNA, 21 nt, Artificial Sequence
  Oligomer
gaagaauucuguuuagcugug

SEQ ID NO: 80003 - RNA, 21 nt, Artificial Sequence
  Oligomer
uacuguaauggagugagcgua

SEQ ID NO: 80004 - RNA, 21 nt, Artificial Sequence
  Oligomer
ugccauugaacucaccaguga

SEQ ID NO: 80005 - RNA, 21 nt, Artificial Sequence
  Oligomer
guaguucucagaugcguaaag

SEQ ID NO: 80006 - RNA, 21 nt, Artificial Sequence
  Oligomer
cagacacuugcucuccuaugu

SEQ ID NO: 80007 - RNA, 21 nt, Artificial Sequence
  Oligomer
agaccuucgucuuugagaaga

SEQ ID NO: 80008 - RNA, 21 nt, Artificial Sequence
  Oligomer
cuaaauguaagaguucagacu

SEQ ID NO: 80009 - RNA, 21 nt, Artificial Sequence
  Oligomer
uucuugguccugucccuugga

SEQ ID NO: 80010 - RNA, 21 nt, Artificial Sequence
  Oligomer
aaaaugccugcuguuguaaau

SEQ ID NO: 80011 - RNA, 21 nt, Artificial Sequence
  Oligomer
ccaacacucccaucauccuag

SEQ ID NO: 80012 - RNA, 21 nt, Artificial Sequence
  Oligomer
ugaaaauguccgugcaaagug

SEQ ID NO: 80013 - RNA, 21 nt, Artificial Sequence
  Oligomer
uggacaagaagauuaugacag

SEQ ID NO: 80014 - RNA, 21 nt, Artificial Sequence
  Oligomer
aagugcuuuccauguuacuuu

SEQ ID NO: 80015 - RNA, 21 nt, Artificial Sequence
  Oligomer
aguaaaagugcuuuccauguu

SEQ ID NO: 80016 - RNA, 21 nt, Artificial Sequence
  Oligomer
uagguaaaacuugccuacuga

SEQ ID NO: 80017 - RNA, 21 nt, Artificial Sequence
  Oligomer
ucaaaggacaaagacaguauu

SEQ ID NO: 80018 - RNA, 21 nt, Artificial Sequence
  Oligomer
aucaaaggacaaagacaguau

SEQ ID NO: 80019 - RNA, 21 nt, Artificial Sequence
  Oligomer
cagucuuugugauuucauagc

SEQ ID NO: 80020 - RNA, 21 nt, Artificial Sequence
  Oligomer
cuucgucuuugagaagacggu

SEQ ID NO: 80021 - RNA, 21 nt, Artificial Sequence
  Oligomer
acugaacuuugcaaagaccuu

SEQ ID NO: 80022 - RNA, 21 nt, Artificial Sequence
  Oligomer
agaacaccgagcacugaacuu

SEQ ID NO: 80023 - RNA, 21 nt, Artificial Sequence
  Oligomer
uuguugugccgagaacaccga

SEQ ID NO: 80024 - RNA, 21 nt, Artificial Sequence
  Oligomer
uaagaguugccaaaauaccuu

SEQ ID NO: 80025 - RNA, 21 nt, Artificial Sequence
  Oligomer
ccucaagacaguguuugacga

SEQ ID NO: 80026 - RNA, 21 nt, Artificial Sequence
  Oligomer
acacgaucgagaaacugaagg

SEQ ID NO: 80027 - RNA, 21 nt, Artificial Sequence
  Oligomer
ugcaaagugguauccugaggu

SEQ ID NO: 80028 - RNA, 21 nt, Artificial Sequence
  Oligomer
uugugaguccugcaucauuug

SEQ ID NO: 80029 - RNA, 21 nt, Artificial Sequence
  Oligomer
caguuuuccucagcuuugggu

SEQ ID NO: 80030 - RNA, 21 nt, Artificial Sequence
  Oligomer
gaaucugggcuuaugggauac

SEQ ID NO: 80031 - RNA, 21 nt, Artificial Sequence
  Oligomer
aaccggugaaucugggcuuau

SEQ ID NO: 80032 - RNA, 21 nt, Artificial Sequence
  Oligomer
uauucugccaauguuauggua

SEQ ID NO: 80033 - RNA, 21 nt, Artificial Sequence
  Oligomer
uguaaacugugcuagugcuga

SEQ ID NO: 80034 - RNA, 21 nt, Artificial Sequence
  Oligomer
ugugagguucuguaaacugug

SEQ ID NO: 80035 - RNA, 21 nt, Artificial Sequence
  Oligomer
agcacguguucccgacauaac

SEQ ID NO: 80036 - RNA, 21 nt, Artificial Sequence
  Oligomer
uuaagaguugccaaaauaccu

SEQ ID NO: 80037 - RNA, 21 nt, Artificial Sequence
  Oligomer
acucaaugccaacuuuuuguu

SEQ ID NO: 80038 - RNA, 21 nt, Artificial Sequence
  Oligomer
ccugucccuuggaaccuuugu

SEQ ID NO: 80039 - RNA, 21 nt, Artificial Sequence
  Oligomer
cucugcaguuuuccucagcuu

SEQ ID NO: 80040 - RNA, 21 nt, Artificial Sequence
  Oligomer
gcauuuccuggagaauauauc

SEQ ID NO: 80041 - RNA, 21 nt, Artificial Sequence
  Oligomer
ccaaugcauuuccuggagaau

SEQ ID NO: 80042 - RNA, 21 nt, Artificial Sequence
  Oligomer
cugaucaguuacacaaccaau

SEQ ID NO: 80043 - RNA, 21 nt, Artificial Sequence
  Oligomer
uguguugcagcuuuauaguuu

SEQ ID NO: 80044 - RNA, 21 nt, Artificial Sequence
  Oligomer
aguuuucuaguaacuaggugu

SEQ ID NO: 80045 - RNA, 21 nt, Artificial Sequence
  Oligomer
gagcuaauaagugcuuuccuu

SEQ ID NO: 80046 - RNA, 21 nt, Artificial Sequence
  Oligomer
agagcuaauaagugcuuuccu

SEQ ID NO: 80047 - RNA, 21 nt, Artificial Sequence
  Oligomer
gcuuuuccuuucucuuacacc

SEQ ID NO: 80048 - RNA, 21 nt, Artificial Sequence
  Oligomer
acggguaaaaacucuaaaagg

SEQ ID NO: 80049 - RNA, 21 nt, Artificial Sequence
  Oligomer
aagugucacggguaaaaacuc

SEQ ID NO: 80050 - RNA, 21 nt, Artificial Sequence
  Oligomer
ucuuugugauuucauagcgag

SEQ ID NO: 80051 - RNA, 21 nt, Artificial Sequence
  Oligomer
acuguaauggagugagcguag

SEQ ID NO: 80052 - RNA, 21 nt, Artificial Sequence
  Oligomer
ccuauguaguucucagaugcg

SEQ ID NO: 80053 - RNA, 21 nt, Artificial Sequence
  Oligomer
cucaaugccaacuuuuuguua

SEQ ID NO: 80054 - RNA, 21 nt, Artificial Sequence
  Oligomer
agaggaagagaaaaugccugc

SEQ ID NO: 80055 - RNA, 21 nt, Artificial Sequence
  Oligomer
gaugauaaagacacgaucgag

SEQ ID NO: 80056 - RNA, 21 nt, Artificial Sequence
  Oligomer
ugucuugccagauuaccgaca

SEQ ID NO: 80057 - RNA, 21 nt, Artificial Sequence
  Oligomer
cuuaguuuucuaguaacuagg

SEQ ID NO: 80058 - RNA, 21 nt, Artificial Sequence
  Oligomer
cuaauaagugcuuuccuuagu

SEQ ID NO: 80059 - RNA, 21 nt, Artificial Sequence
  Oligomer
gcauuagaagguuuuuuuguc

SEQ ID NO: 80060 - RNA, 21 nt, Artificial Sequence
  Oligomer
cgaaguggagauuuacacuac

SEQ ID NO: 80061 - RNA, 21 nt, Artificial Sequence
  Oligomer
ucugcaguuaggaggugcaga

SEQ ID NO: 80062 - RNA, 21 nt, Artificial Sequence
  Oligomer
cuucugcaguuaggaggugca

SEQ ID NO: 80063 - RNA, 21 nt, Artificial Sequence
  Oligomer
aaauaccuucugaacuacacu

SEQ ID NO: 80064 - RNA, 21 nt, Artificial Sequence
  Oligomer
aagaguucagacucacauucu

SEQ ID NO: 80065 - RNA, 21 nt, Artificial Sequence
  Oligomer
agugggaacuaaacuugaucu

SEQ ID NO: 80066 - RNA, 21 nt, Artificial Sequence
  Oligomer
gaaaauguccgugcaaagugg

SEQ ID NO: 80067 - RNA, 21 nt, Artificial Sequence
  Oligomer
cuuaugggauacagcuggaca

SEQ ID NO: 80068 - RNA, 21 nt, Artificial Sequence
  Oligomer
gauggaaaaccggugaaucug

SEQ ID NO: 80069 - RNA, 21 nt, Artificial Sequence
  Oligomer
aucccuacugucuuugacaau

SEQ ID NO: 80070 - RNA, 21 nt, Artificial Sequence
  Oligomer
uccuggagaauauaucccuac

SEQ ID NO: 80071 - RNA, 21 nt, Artificial Sequence
  Oligomer
aacucacuggcgagaauacag

SEQ ID NO: 80072 - RNA, 21 nt, Artificial Sequence
  Oligomer
gccuauugauguuccuuuggg

SEQ ID NO: 80073 - RNA, 21 nt, Artificial Sequence
  Oligomer
uuaacaucacugucuugccag

SEQ ID NO: 80074 - RNA, 21 nt, Artificial Sequence
  Oligomer
ucgcuaacuuaguaagugcuu

SEQ ID NO: 80075 - RNA, 21 nt, Artificial Sequence
  Oligomer
uucuguuagucgcuaacuuag

SEQ ID NO: 80076 - RNA, 21 nt, Artificial Sequence
  Oligomer
uguucuguuagucgcuaacuu

SEQ ID NO: 80077 - RNA, 21 nt, Artificial Sequence
  Oligomer
cuuucucuuacaccugccaug

SEQ ID NO: 80078 - RNA, 21 nt, Artificial Sequence
  Oligomer
uuugcggagauuuugaacaga

SEQ ID NO: 80079 - RNA, 21 nt, Artificial Sequence
  Oligomer
auugaacucaccagugaguua

SEQ ID NO: 80080 - RNA, 21 nt, Artificial Sequence
  Oligomer
gacacuugcucuccuauguag

SEQ ID NO: 80081 - RNA, 21 nt, Artificial Sequence
  Oligomer
ccuucgucuuugagaagacgg

SEQ ID NO: 80082 - RNA, 21 nt, Artificial Sequence
  Oligomer
cugcauuguugugccgagaac

SEQ ID NO: 80083 - RNA, 21 nt, Artificial Sequence
  Oligomer
uguaagaguucagacucacau

SEQ ID NO: 80084 - RNA, 21 nt, Artificial Sequence
  Oligomer
uaaagacacgaucgagaaacu

SEQ ID NO: 80085 - RNA, 21 nt, Artificial Sequence
  Oligomer
cugggcuuaugggauacagcu

SEQ ID NO: 80086 - RNA, 21 nt, Artificial Sequence
  Oligomer
uucuguacaacuuaacucacu

SEQ ID NO: 80087 - RNA, 21 nt, Artificial Sequence
  Oligomer
acuugaccaauacugacccuc

SEQ ID NO: 80088 - RNA, 21 nt, Artificial Sequence
  Oligomer
aggaaugaaagugucacgggu

SEQ ID NO: 80089 - RNA, 21 nt, Artificial Sequence
  Oligomer
gugaucaaaggacaaagacag

SEQ ID NO: 80090 - RNA, 21 nt, Artificial Sequence
  Oligomer
gauuucauagcgaguuuucug

SEQ ID NO: 80091 - RNA, 21 nt, Artificial Sequence
  Oligomer
ucuuuggaucagucuuuguga

SEQ ID NO: 80092 - RNA, 21 nt, Artificial Sequence
  Oligomer
guucccgacauaacauuguac

SEQ ID NO: 80093 - RNA, 21 nt, Artificial Sequence
  Oligomer
aagcguugccauugaacucac

SEQ ID NO: 80094 - RNA, 21 nt, Artificial Sequence
  Oligomer
aagcagaacagccucccgaau

SEQ ID NO: 80095 - RNA, 21 nt, Artificial Sequence
  Oligomer
gaacaccgagcacugaacuuu

SEQ ID NO: 80096 - RNA, 21 nt, Artificial Sequence
  Oligomer
uaccuucugaacuacacugca

SEQ ID NO: 80097 - RNA, 21 nt, Artificial Sequence
  Oligomer
aaugccugcuguuguaaaugu

SEQ ID NO: 80098 - RNA, 21 nt, Artificial Sequence
  Oligomer
ucccaacacucccaucauccu

SEQ ID NO: 80099 - RNA, 21 nt, Artificial Sequence
  Oligomer
guccgugcaaagugguauccu

SEQ ID NO: 80100 - RNA, 21 nt, Artificial Sequence
  Oligomer
uguucuguacaacuuaacuca

SEQ ID NO: 80101 - RNA, 21 nt, Artificial Sequence
  Oligomer
gauguucuguacaacuuaacu

SEQ ID NO: 80102 - RNA, 21 nt, Artificial Sequence
  Oligomer
uauugauguuccuuugggucu

SEQ ID NO: 80103 - RNA, 21 nt, Artificial Sequence
  Oligomer
uugaccaauacugacccucuu

SEQ ID NO: 80104 - RNA, 21 nt, Artificial Sequence
  Oligomer
uaacaucacugucuugccaga

SEQ ID NO: 80105 - RNA, 21 nt, Artificial Sequence
  Oligomer
agugucacggguaaaaacucu

SEQ ID NO: 80106 - RNA, 21 nt, Artificial Sequence
  Oligomer
cguugccauugaacucaccag

SEQ ID NO: 80107 - RNA, 21 nt, Artificial Sequence
  Oligomer
gcucuccuauguaguucucag

SEQ ID NO: 80108 - RNA, 21 nt, Artificial Sequence
  Oligomer
guucuaaauguaagaguucag

SEQ ID NO: 80109 - RNA, 21 nt, Artificial Sequence
  Oligomer
gaggaagagaaaaugccugcu

SEQ ID NO: 80110 - RNA, 21 nt, Artificial Sequence
  Oligomer
ucuuagggaugauaaagacac

SEQ ID NO: 80111 - RNA, 21 nt, Artificial Sequence
  Oligomer
uaacucacuggcgagaauaca

SEQ ID NO: 80112 - RNA, 21 nt, Artificial Sequence
  Oligomer
auacugacccucuuuaccucg

SEQ ID NO: 80113 - RNA, 21 nt, Artificial Sequence
  Oligomer
gagcuguagguaaaacuugcc

SEQ ID NO: 80114 - RNA, 21 nt, Artificial Sequence
  Oligomer
aaauacgaaguggagauuuac

SEQ ID NO: 80115 - RNA, 21 nt, Artificial Sequence
  Oligomer
cauagcgaguuuucugaccag

SEQ ID NO: 80116 - RNA, 21 nt, Artificial Sequence
  Oligomer
ggccauuuccuguuucucugc

SEQ ID NO: 80117 - RNA, 21 nt, Artificial Sequence
  Oligomer
ccuuauuuuucaaaagcgccc

SEQ ID NO: 80118 - RNA, 21 nt, Artificial Sequence
  Oligomer
uguaaaauaccuggagugcuc

SEQ ID NO: 80119 - RNA, 21 nt, Artificial Sequence
  Oligomer
caacacucccaucauccuagu

SEQ ID NO: 80120 - RNA, 21 nt, Artificial Sequence
  Oligomer
gcaaagugguauccugaggug

SEQ ID NO: 80121 - RNA, 21 nt, Artificial Sequence
  Oligomer
uuuucccuugugaguccugca

SEQ ID NO: 80122 - RNA, 21 nt, Artificial Sequence
  Oligomer
uaucccuacugucuuugacaa

SEQ ID NO: 80123 - RNA, 21 nt, Artificial Sequence
  Oligomer
auaucccuacugucuuugaca

SEQ ID NO: 80124 - RNA, 21 nt, Artificial Sequence
  Oligomer
ucaguuacacaaccaaugcau

SEQ ID NO: 80125 - RNA, 21 nt, Artificial Sequence
  Oligomer
uacugacccucuuuaccucgc

SEQ ID NO: 80126 - RNA, 21 nt, Artificial Sequence
  Oligomer
aauacugacccucuuuaccuc

SEQ ID NO: 80127 - RNA, 21 nt, Artificial Sequence
  Oligomer
uaaaagugcuuuccauguuac

SEQ ID NO: 80128 - RNA, 21 nt, Artificial Sequence
  Oligomer
ucugauaaugcauuagaaggu

SEQ ID NO: 80129 - RNA, 21 nt, Artificial Sequence
  Oligomer
uagcgaguuuucugaccagcu

SEQ ID NO: 80130 - RNA, 21 nt, Artificial Sequence
  Oligomer
uaacauuguacuguaauggag

SEQ ID NO: 80131 - RNA, 21 nt, Artificial Sequence
  Oligomer
acgguagcuucugcaguuagg

SEQ ID NO: 80132 - RNA, 21 nt, Artificial Sequence
  Oligomer
aagacgguagcuucugcaguu

SEQ ID NO: 80133 - RNA, 21 nt, Artificial Sequence
  Oligomer
cggccauuuccuguuucucug

SEQ ID NO: 80134 - RNA, 21 nt, Artificial Sequence
  Oligomer
uguuugacgaagcgauccgag

SEQ ID NO: 80135 - RNA, 21 nt, Artificial Sequence
  Oligomer
guguuugacgaagcgauccga

SEQ ID NO: 80136 - RNA, 21 nt, Artificial Sequence
  Oligomer
uagugggaacuaaacuugauc

SEQ ID NO: 80137 - RNA, 21 nt, Artificial Sequence
  Oligomer
caaagugguauccugaggugc

SEQ ID NO: 80138 - RNA, 21 nt, Artificial Sequence
  Oligomer
gagaauauaucccuacugucu

SEQ ID NO: 80139 - RNA, 21 nt, Artificial Sequence
  Oligomer
caaccaaugcauuuccuggag

SEQ ID NO: 80140 - RNA, 21 nt, Artificial Sequence
  Oligomer
aucaguuacacaaccaaugca

SEQ ID NO: 80141 - RNA, 21 nt, Artificial Sequence
  Oligomer
guaaaaaucauguguugcagc

SEQ ID NO: 80142 - RNA, 21 nt, Artificial Sequence
  Oligomer
ucugucaaaugcaguagauga

SEQ ID NO: 80143 - RNA, 21 nt, Artificial Sequence
  Oligomer
acaaaauacgaaguggagauu

SEQ ID NO: 80144 - RNA, 21 nt, Artificial Sequence
  Oligomer
ugauuucauagcgaguuuucu

SEQ ID NO: 80145 - RNA, 21 nt, Artificial Sequence
  Oligomer
cuccuauguaguucucagaug

SEQ ID NO: 80146 - RNA, 21 nt, Artificial Sequence
  Oligomer
guagcuucugcaguuaggagg

SEQ ID NO: 80147 - RNA, 21 nt, Artificial Sequence
  Oligomer
gaagacgguagcuucugcagu

SEQ ID NO: 80148 - RNA, 21 nt, Artificial Sequence
  Oligomer
ccuucgcacucaaugccaacu

SEQ ID NO: 80149 - RNA, 21 nt, Artificial Sequence
  Oligomer
aagcugacucccaucaccuau

SEQ ID NO: 80150 - RNA, 21 nt, Artificial Sequence
  Oligomer
acugucccaacacucccauca

SEQ ID NO: 80151 - RNA, 21 nt, Artificial Sequence
  Oligomer
uuaugguagauggaaaaccgg

SEQ ID NO: 80152 - RNA, 21 nt, Artificial Sequence
  Oligomer
aguugcagaauuguggagugu

SEQ ID NO: 80153 - RNA, 21 nt, Artificial Sequence
  Oligomer
uuaguaaaagugcuuuccaug

SEQ ID NO: 80154 - RNA, 21 nt, Artificial Sequence
  Oligomer
gguaaaacuugccuacugauc

SEQ ID NO: 80155 - RNA, 21 nt, Artificial Sequence
  Oligomer
aacucaccagugaguuagcag

SEQ ID NO: 80156 - RNA, 21 nt, Artificial Sequence
  Oligomer
agaagaggaagagaaaaugcc

SEQ ID NO: 80157 - RNA, 21 nt, Artificial Sequence
  Oligomer
gcaguuuuccucagcuuuggg

SEQ ID NO: 80158 - RNA, 21 nt, Artificial Sequence
  Oligomer
ugacaauuauucugccaaugu

SEQ ID NO: 80159 - RNA, 21 nt, Artificial Sequence
  Oligomer
acaaccaaugcauuuccugga

SEQ ID NO: 80160 - RNA, 21 nt, Artificial Sequence
  Oligomer
ucugugagguucuguaaacug

SEQ ID NO: 80161 - RNA, 21 nt, Artificial Sequence
  Oligomer
uuugggucugugagguucugu

SEQ ID NO: 80162 - RNA, 21 nt, Artificial Sequence
  Oligomer
cugucuugccagauuaccgac

SEQ ID NO: 80163 - RNA, 21 nt, Artificial Sequence
  Oligomer
cgcuaacuuaguaagugcuuu

SEQ ID NO: 80164 - RNA, 21 nt, Artificial Sequence
  Oligomer
augugaguggagcggccauuu

SEQ ID NO: 80165 - RNA, 21 nt, Artificial Sequence
  Oligomer
uaaacugguuguucuguuagu

SEQ ID NO: 80166 - RNA, 21 nt, Artificial Sequence
  Oligomer
guggagauuuacacuacauug

SEQ ID NO: 80167 - RNA, 21 nt, Artificial Sequence
  Oligomer
cagaugcguaaagcagaacag

SEQ ID NO: 80168 - RNA, 21 nt, Artificial Sequence
  Oligomer
agaagacgguagcuucugcag

SEQ ID NO: 80169 - RNA, 21 nt, Artificial Sequence
  Oligomer
aaagaccuucgucuuugagaa

SEQ ID NO: 80170 - RNA, 21 nt, Artificial Sequence
  Oligomer
aguugccaaaauaccuucuga

SEQ ID NO: 80171 - RNA, 21 nt, Artificial Sequence
  Oligomer
gacaagccuucuuaaagccuu

SEQ ID NO: 80172 - RNA, 21 nt, Artificial Sequence
  Oligomer
gccucaagacaguguuugacg

SEQ ID NO: 80173 - RNA, 21 nt, Artificial Sequence
  Oligomer
cauggcuaaggagauuggugc

SEQ ID NO: 80174 - RNA, 21 nt, Artificial Sequence
  Oligomer
ccugcaucauuugaaaauguc

SEQ ID NO: 80175 - RNA, 21 nt, Artificial Sequence
  Oligomer
ucugcaguuuuccucagcuuu

SEQ ID NO: 80176 - RNA, 21 nt, Artificial Sequence
  Oligomer
gcuuaugggauacagcuggac

SEQ ID NO: 80177 - RNA, 21 nt, Artificial Sequence
  Oligomer
ugggcuuaugggauacagcug

SEQ ID NO: 80178 - RNA, 21 nt, Artificial Sequence
  Oligomer
uacaacuuaacucacuggcga

SEQ ID NO: 80179 - RNA, 21 nt, Artificial Sequence
  Oligomer
cuguacaacuuaacucacugg

SEQ ID NO: 80180 - RNA, 21 nt, Artificial Sequence
  Oligomer
guucuguacaacuuaacucac

SEQ ID NO: 80181 - RNA, 21 nt, Artificial Sequence
  Oligomer
ugaucaguuacacaaccaaug

SEQ ID NO: 80182 - RNA, 21 nt, Artificial Sequence
  Oligomer
acugucuugccagauuaccga

SEQ ID NO: 80183 - RNA, 21 nt, Artificial Sequence
  Oligomer
cacugucuugccagauuaccg

SEQ ID NO: 80184 - RNA, 21 nt, Artificial Sequence
  Oligomer
aucacugucuugccagauuac

SEQ ID NO: 80185 - RNA, 21 nt, Artificial Sequence
  Oligomer
cugauaaugcauuagaagguu

SEQ ID NO: 80186 - RNA, 21 nt, Artificial Sequence
  Oligomer
gucgcuaacuuaguaagugcu

SEQ ID NO: 80187 - RNA, 21 nt, Artificial Sequence
  Oligomer
uugacaaaauacgaaguggag

SEQ ID NO: 80188 - RNA, 21 nt, Artificial Sequence
  Oligomer
augaagcguugccauugaacu

SEQ ID NO: 80189 - RNA, 21 nt, Artificial Sequence
  Oligomer
cuguuguaaaugucucagccc

SEQ ID NO: 80190 - RNA, 21 nt, Artificial Sequence
  Oligomer
aagaggaagagaaaaugccug

SEQ ID NO: 80191 - RNA, 21 nt, Artificial Sequence
  Oligomer
aucaccuauccgcagggucua

SEQ ID NO: 80192 - RNA, 21 nt, Artificial Sequence
  Oligomer
acugaaggagaagaagcugac

SEQ ID NO: 80193 - RNA, 21 nt, Artificial Sequence
  Oligomer
gaugcaggccaucaagugugu

SEQ ID NO: 80194 - RNA, 21 nt, Artificial Sequence
  Oligomer
guaaacugugcuagugcugac

SEQ ID NO: 80195 - RNA, 21 nt, Artificial Sequence
  Oligomer
auuaccgacacugucacuuga

SEQ ID NO: 80196 - RNA, 21 nt, Artificial Sequence
  Oligomer
ucuugccagauuaccgacacu

SEQ ID NO: 80197 - RNA, 21 nt, Artificial Sequence
  Oligomer
uccauguuacuuuauucagag

SEQ ID NO: 80198 - RNA, 21 nt, Artificial Sequence
  Oligomer
cauuagaagguuuuuuugucg

SEQ ID NO: 80199 - RNA, 21 nt, Artificial Sequence
  Oligomer
aacuugccuacugaucaguua

SEQ ID NO: 80200 - RNA, 21 nt, Artificial Sequence
  Oligomer
cuguaauggagugagcguagc

SEQ ID NO: 80201 - RNA, 21 nt, Artificial Sequence
  Oligomer
gagaacaccgagcacugaacu

SEQ ID NO: 80202 - RNA, 21 nt, Artificial Sequence
  Oligomer
gugcaaagugguauccugagg

SEQ ID NO: 80203 - RNA, 21 nt, Artificial Sequence
  Oligomer
ucccuugugaguccugcauca

SEQ ID NO: 80204 - RNA, 21 nt, Artificial Sequence
  Oligomer
uguucuuaauuugcuuuuccc

SEQ ID NO: 80205 - RNA, 21 nt, Artificial Sequence
  Oligomer
uugcagaauuguggaguguuu

SEQ ID NO: 80206 - RNA, 21 nt, Artificial Sequence
  Oligomer
agugcugacgauguucuguac

SEQ ID NO: 80207 - RNA, 21 nt, Artificial Sequence
  Oligomer
acacaaccaaugcauuuccug

SEQ ID NO: 80208 - RNA, 21 nt, Artificial Sequence
  Oligomer
cuuaacaucacugucuugcca

SEQ ID NO: 80209 - RNA, 21 nt, Artificial Sequence
  Oligomer
ccuucugacugagcaauaugc

SEQ ID NO: 80210 - RNA, 21 nt, Artificial Sequence
  Oligomer
guuagucgcuaacuuaguaag

SEQ ID NO: 80211 - RNA, 21 nt, Artificial Sequence
  Oligomer
aacugguuguucuguuagucg

SEQ ID NO: 80212 - RNA, 21 nt, Artificial Sequence
  Oligomer
ugucaaaugcaguagaugaug

SEQ ID NO: 80213 - RNA, 21 nt, Artificial Sequence
  Oligomer
guuaauuucugucaaaugcag

SEQ ID NO: 80214 - RNA, 21 nt, Artificial Sequence
  Oligomer
aauggagugagcguagcagcu

SEQ ID NO: 80215 - RNA, 21 nt, Artificial Sequence
  Oligomer
gaacucaccagugaguuagca

SEQ ID NO: 80216 - RNA, 21 nt, Artificial Sequence
  Oligomer
uacacugcauuguugugccga

SEQ ID NO: 80217 - RNA, 21 nt, Artificial Sequence
  Oligomer
aaaauaccuucugaacuacac

SEQ ID NO: 80218 - RNA, 21 nt, Artificial Sequence
  Oligomer
aagaguugccaaaauaccuuc

SEQ ID NO: 80219 - RNA, 21 nt, Artificial Sequence
  Oligomer
uguucagauuaagaguugcca

SEQ ID NO: 80220 - RNA, 21 nt, Artificial Sequence
  Oligomer
auggcuaaggagauuggugcu

SEQ ID NO: 80221 - RNA, 21 nt, Artificial Sequence
  Oligomer
auccuagugggaacuaaacuu

SEQ ID NO: 80222 - RNA, 21 nt, Artificial Sequence
  Oligomer
ucauccuagugggaacuaaac

SEQ ID NO: 80223 - RNA, 21 nt, Artificial Sequence
  Oligomer
agaagauuaugacagauuacg

SEQ ID NO: 80224 - RNA, 21 nt, Artificial Sequence
  Oligomer
auggaaaaccggugaaucugg

SEQ ID NO: 80225 - RNA, 21 nt, Artificial Sequence
  Oligomer
gacaauuauucugccaauguu

SEQ ID NO: 80226 - RNA, 21 nt, Artificial Sequence
  Oligomer
cuguuucucugcaguuuuccu

SEQ ID NO: 80227 - RNA, 21 nt, Artificial Sequence
  Oligomer
cuggagaauauaucccuacug

SEQ ID NO: 80228 - RNA, 21 nt, Artificial Sequence
  Oligomer
cuagugcugacgauguucugu

SEQ ID NO: 80229 - RNA, 21 nt, Artificial Sequence
  Oligomer
uauucagagcuaauaagugcu

SEQ ID NO: 80230 - RNA, 21 nt, Artificial Sequence
  Oligomer
aaaacuugccuacugaucagu

SEQ ID NO: 80231 - RNA, 21 nt, Artificial Sequence
  Oligomer
uaagcuuuuccuuucucuuac

SEQ ID NO: 80232 - RNA, 21 nt, Artificial Sequence
  Oligomer
agaaagguugguauuaucagg

SEQ ID NO: 80233 - RNA, 21 nt, Artificial Sequence
  Oligomer
uguacaaggaaugaaaguguc

SEQ ID NO: 80234 - RNA, 21 nt, Artificial Sequence
  Oligomer
agcuguagguaaaacuugccu

SEQ ID NO: 80235 - RNA, 21 nt, Artificial Sequence
  Oligomer
ccauuuccuguuucucugcag

SEQ ID NO: 80236 - RNA, 21 nt, Artificial Sequence
  Oligomer
cucaccagugaguuagcagca

SEQ ID NO: 80237 - RNA, 21 nt, Artificial Sequence
  Oligomer
ugaacucaccagugaguuagc

SEQ ID NO: 80238 - RNA, 21 nt, Artificial Sequence
  Oligomer
ucgucuuugagaagacgguag

SEQ ID NO: 80239 - RNA, 21 nt, Artificial Sequence
  Oligomer
agauuggugcuguaaaauacc

SEQ ID NO: 80240 - RNA, 21 nt, Artificial Sequence
  Oligomer
gaucuuagggaugauaaagac

SEQ ID NO: 80241 - RNA, 21 nt, Artificial Sequence
  Oligomer
accggugaaucugggcuuaug

SEQ ID NO: 80242 - RNA, 21 nt, Artificial Sequence
  Oligomer
uucugccaauguuaugguaga

SEQ ID NO: 80243 - RNA, 21 nt, Artificial Sequence
  Oligomer
ucuuugacaauuauucugcca

SEQ ID NO: 80244 - RNA, 21 nt, Artificial Sequence
  Oligomer
uggagaauauaucccuacugu

SEQ ID NO: 80245 - RNA, 21 nt, Artificial Sequence
  Oligomer
ugcuagugcugacgauguucu

SEQ ID NO: 80246 - RNA, 21 nt, Artificial Sequence
  Oligomer
gugagguucuguaaacugugc

SEQ ID NO: 80247 - RNA, 21 nt, Artificial Sequence
  Oligomer
uuagcgacuaacagaacaacc

SEQ ID NO: 80248 - RNA, 21 nt, Artificial Sequence
  Oligomer
agguaaagagggucaguauug

SEQ ID NO: 80249 - RNA, 21 nt, Artificial Sequence
  Oligomer
uuuccaucuaccauaacauug

SEQ ID NO: 80250 - RNA, 21 nt, Artificial Sequence
  Oligomer
uucucuuccucuucuucacgg

SEQ ID NO: 80251 - RNA, 21 nt, Artificial Sequence
  Oligomer
uuucucuuccucuucuucacg

SEQ ID NO: 80252 - RNA, 21 nt, Artificial Sequence
  Oligomer
uacaauguaguguaaaucucc

SEQ ID NO: 80253 - RNA, 21 nt, Artificial Sequence
  Oligomer
uuacccgugacacuuucauuc

SEQ ID NO: 80254 - RNA, 21 nt, Artificial Sequence
  Oligomer
uuucucgaucgugucuuuauc

SEQ ID NO: 80255 - RNA, 21 nt, Artificial Sequence
  Oligomer
uuuacagcaccaaucuccuua

SEQ ID NO: 80256 - RNA, 21 nt, Artificial Sequence
  Oligomer
uagaguuuuuacccgugacac

SEQ ID NO: 80257 - RNA, 21 nt, Artificial Sequence
  Oligomer
uugcacggacauuuucaaaug

SEQ ID NO: 80258 - RNA, 21 nt, Artificial Sequence
  Oligomer
aaccuuuuagaguuuuuaccc

SEQ ID NO: 80259 - RNA, 21 nt, Artificial Sequence
  Oligomer
ucugucauaaucuucuugucc

SEQ ID NO: 80260 - RNA, 21 nt, Artificial Sequence
  Oligomer
ucccauaagcccagauucacc

SEQ ID NO: 80261 - RNA, 21 nt, Artificial Sequence
  Oligomer
uucuccuucaguuucucgauc

SEQ ID NO: 80262 - RNA, 21 nt, Artificial Sequence
  Oligomer
ucaggauaccacuuugcacgg

SEQ ID NO: 80263 - RNA, 21 nt, Artificial Sequence
  Oligomer
ucgaucgugucuuuaucaucc

SEQ ID NO: 80264 - RNA, 21 nt, Artificial Sequence
  Oligomer
uucucgaucgugucuuuauca

SEQ ID NO: 80265 - RNA, 21 nt, Artificial Sequence
  Oligomer
uacccgugacacuuucauucc

SEQ ID NO: 80266 - RNA, 21 nt, Artificial Sequence
  Oligomer
gguaaagagggucaguauugg

SEQ ID NO: 80267 - RNA, 21 nt, Artificial Sequence
  Oligomer
ucuucuuguccagcuguaucc

SEQ ID NO: 80268 - RNA, 21 nt, Artificial Sequence
  Oligomer
uucauuagaggaaauagcagu

SEQ ID NO: 80269 - RNA, 21 nt, Artificial Sequence
  Oligomer
acuuucauuccuuguacaaug

SEQ ID NO: 80270 - RNA, 21 nt, Artificial Sequence
  Oligomer
uucaguuucucgaucgugucu

SEQ ID NO: 80271 - RNA, 21 nt, Artificial Sequence
  Oligomer
ucuuuaucaucccuaagauca

SEQ ID NO: 80272 - RNA, 21 nt, Artificial Sequence
  Oligomer
ucaaaaucuccgcaaaagcug

SEQ ID NO: 80273 - RNA, 21 nt, Artificial Sequence
  Oligomer
cucaggauaccacuuugcacg

SEQ ID NO: 80274 - RNA, 21 nt, Artificial Sequence
  Oligomer
ucacagacccaaaggaacauc

SEQ ID NO: 80275 - RNA, 21 nt, Artificial Sequence
  Oligomer
uguaguguaaaucuccacuuc

SEQ ID NO: 80276 - RNA, 21 nt, Artificial Sequence
  Oligomer
ucucaaagacgaaggucuuug

SEQ ID NO: 80277 - RNA, 21 nt, Artificial Sequence
  Oligomer
auaauugucaaagacaguagg

SEQ ID NO: 80278 - RNA, 21 nt, Artificial Sequence
  Oligomer
auaaaguaacauggaaagcac

SEQ ID NO: 80279 - RNA, 21 nt, Artificial Sequence
  Oligomer
uaacauggaaagcacuuuuac

SEQ ID NO: 80280 - RNA, 21 nt, Artificial Sequence
  Oligomer
uuuuagaguuuuuacccguga

SEQ ID NO: 80281 - RNA, 21 nt, Artificial Sequence
  Oligomer
uuuagaguuuuuacccgugac

SEQ ID NO: 80282 - RNA, 21 nt, Artificial Sequence
  Oligomer
uacugucuuuguccuuugauc

SEQ ID NO: 80283 - RNA, 21 nt, Artificial Sequence
  Oligomer
uccuaacugcagaagcuaccg

SEQ ID NO: 80284 - RNA, 21 nt, Artificial Sequence
  Oligomer
uuugcaaaguucagugcucgg

SEQ ID NO: 80285 - RNA, 21 nt, Artificial Sequence
  Oligomer
uaccacuuugcacggacauuu

SEQ ID NO: 80286 - RNA, 21 nt, Artificial Sequence
  Oligomer
ugcaaaguucagugcucggug

SEQ ID NO: 80287 - RNA, 21 nt, Artificial Sequence
  Oligomer
ucaguuucucgaucgugucuu

SEQ ID NO: 80288 - RNA, 21 nt, Artificial Sequence
  Oligomer
guuuuuacccgugacacuuuc

SEQ ID NO: 80289 - RNA, 21 nt, Artificial Sequence
  Oligomer
ucaaaauacugucuuuguccu

SEQ ID NO: 80290 - RNA, 21 nt, Artificial Sequence
  Oligomer
auuuucucuuccucuucuuca

SEQ ID NO: 80291 - RNA, 21 nt, Artificial Sequence
  Oligomer
aucgcuucgucaaacacuguc

SEQ ID NO: 80292 - RNA, 21 nt, Artificial Sequence
  Oligomer
uuaguucccacuaggaugaug

SEQ ID NO: 80293 - RNA, 21 nt, Artificial Sequence
  Oligomer
acacgugcugcuaacucacug

SEQ ID NO: 80294 - RNA, 21 nt, Artificial Sequence
  Oligomer
ucauaaucuucuuguccagcu

SEQ ID NO: 80295 - RNA, 21 nt, Artificial Sequence
  Oligomer
uucuuguccagcuguauccca

SEQ ID NO: 80296 - RNA, 21 nt, Artificial Sequence
  Oligomer
uguaaaaacacuccacaauuc

SEQ ID NO: 80297 - RNA, 21 nt, Artificial Sequence
  Oligomer
ugucuuuguccuuugaucaca

SEQ ID NO: 80298 - RNA, 21 nt, Artificial Sequence
  Oligomer
cuaacugcagaagcuaccguc

SEQ ID NO: 80299 - RNA, 21 nt, Artificial Sequence
  Oligomer
uuuucucuuccucuucuucac

SEQ ID NO: 80300 - RNA, 21 nt, Artificial Sequence
  Oligomer
uaauugucaaagacaguaggg

SEQ ID NO: 80301 - RNA, 21 nt, Artificial Sequence
  Oligomer
ugcuacgcucacuccauuaca

SEQ ID NO: 80302 - RNA, 21 nt, Artificial Sequence
  Oligomer
ucacuccauuacaguacaaug

SEQ ID NO: 80303 - RNA, 21 nt, Artificial Sequence
  Oligomer
uuacgcaucugagaacuacau

SEQ ID NO: 80304 - RNA, 21 nt, Artificial Sequence
  Oligomer
auuuucaaaugaugcaggacu

SEQ ID NO: 80305 - RNA, 21 nt, Artificial Sequence
  Oligomer
uguuguaguggcugaaggguc

SEQ ID NO: 80306 - RNA, 21 nt, Artificial Sequence
  Oligomer
uuacuaaguuagcgacuaaca

SEQ ID NO: 80307 - RNA, 21 nt, Artificial Sequence
  Oligomer
uaaguuagcgacuaacagaac

SEQ ID NO: 80308 - RNA, 21 nt, Artificial Sequence
  Oligomer
ucuuaaucugaacaagaaugg

SEQ ID NO: 80309 - RNA, 21 nt, Artificial Sequence
  Oligomer
uuggcagaauaauugucaaag

SEQ ID NO: 80310 - RNA, 21 nt, Artificial Sequence
  Oligomer
uaaggaaagcacuuauuagcu

SEQ ID NO: 80311 - RNA, 21 nt, Artificial Sequence
  Oligomer
uuuuuacccgugacacuuuca

SEQ ID NO: 80312 - RNA, 21 nt, Artificial Sequence
  Oligomer
aucuccacuucguauuuuguc

SEQ ID NO: 80313 - RNA, 21 nt, Artificial Sequence
  Oligomer
aaauacugucuuuguccuuug

SEQ ID NO: 80314 - RNA, 21 nt, Artificial Sequence
  Oligomer
cuucuuguccagcuguauccc

SEQ ID NO: 80315 - RNA, 21 nt, Artificial Sequence
  Oligomer
auauauucuccaggaaaugca

SEQ ID NO: 80316 - RNA, 21 nt, Artificial Sequence
  Oligomer
uauucuccaggaaaugcauug

SEQ ID NO: 80317 - RNA, 21 nt, Artificial Sequence
  Oligomer
ucaauaggcaaagcgacuaca

SEQ ID NO: 80318 - RNA, 21 nt, Artificial Sequence
  Oligomer
uggaaagcacuuuuacuaauc

SEQ ID NO: 80319 - RNA, 21 nt, Artificial Sequence
  Oligomer
uuagaguuuuuacccgugaca

SEQ ID NO: 80320 - RNA, 21 nt, Artificial Sequence
  Oligomer
ucuccacuucguauuuuguca

SEQ ID NO: 80321 - RNA, 21 nt, Artificial Sequence
  Oligomer
uccacuucguauuuugucaaa

SEQ ID NO: 80322 - RNA, 21 nt, Artificial Sequence
  Oligomer
ugucaaaauacugucuuuguc

SEQ ID NO: 80323 - RNA, 21 nt, Artificial Sequence
  Oligomer
acucgcuaugaaaucacaaag

SEQ ID NO: 80324 - RNA, 21 nt, Artificial Sequence
  Oligomer
aauagaaugugagucugaacu

SEQ ID NO: 80325 - RNA, 21 nt, Artificial Sequence
  Oligomer
aucuucuuguccagcuguauc

SEQ ID NO: 80326 - RNA, 21 nt, Artificial Sequence
  Oligomer
uuccaucuaccauaacauugg

SEQ ID NO: 80327 - RNA, 21 nt, Artificial Sequence
  Oligomer
ucaucaucuacugcauuugac

SEQ ID NO: 80328 - RNA, 21 nt, Artificial Sequence
  Oligomer
accuuuuagaguuuuuacccg

SEQ ID NO: 80329 - RNA, 21 nt, Artificial Sequence
  Oligomer
uguaaaucuccacuucguauu

SEQ ID NO: 80330 - RNA, 21 nt, Artificial Sequence
  Oligomer
uucauucgggaggcuguucug

SEQ ID NO: 80331 - RNA, 21 nt, Artificial Sequence
  Oligomer
uuggcaacucuuaaucugaac

SEQ ID NO: 80332 - RNA, 21 nt, Artificial Sequence
  Oligomer
uuugcacggacauuuucaaau

SEQ ID NO: 80333 - RNA, 21 nt, Artificial Sequence
  Oligomer
uacagaacaucgucagcacua

SEQ ID NO: 80334 - RNA, 21 nt, Artificial Sequence
  Oligomer
uuuggcaacucuuaaucugaa

SEQ ID NO: 80335 - RNA, 21 nt, Artificial Sequence
  Oligomer
aaagacaguagggauauauuc

SEQ ID NO: 80336 - RNA, 21 nt, Artificial Sequence
  Oligomer
uugguuguguaacugaucagu

SEQ ID NO: 80337 - RNA, 21 nt, Artificial Sequence
  Oligomer
uaaaguaacauggaaagcacu

SEQ ID NO: 80338 - RNA, 21 nt, Artificial Sequence
  Oligomer
aguaacauggaaagcacuuuu

SEQ ID NO: 80339 - RNA, 21 nt, Artificial Sequence
  Oligomer
uacuaaguuagcgacuaacag

SEQ ID NO: 80340 - RNA, 21 nt, Artificial Sequence
  Oligomer
uuuacccgugacacuuucauu

SEQ ID NO: 80341 - RNA, 21 nt, Artificial Sequence
  Oligomer
ugggagucagcuucuucuccu

SEQ ID NO: 80342 - RNA, 21 nt, Artificial Sequence
  Oligomer
uccagcuguaucccauaagcc

SEQ ID NO: 80343 - RNA, 21 nt, Artificial Sequence
  Oligomer
ugcaacacaugauuuuuacac

SEQ ID NO: 80344 - RNA, 21 nt, Artificial Sequence
  Oligomer
acugucuuuguccuuugauca

SEQ ID NO: 80345 - RNA, 21 nt, Artificial Sequence
  Oligomer
uacgcaucugagaacuacaua

SEQ ID NO: 80346 - RNA, 21 nt, Artificial Sequence
  Oligomer
acaaaaaguuggcauugagug

SEQ ID NO: 80347 - RNA, 21 nt, Artificial Sequence
  Oligomer
ucaaacacugucuugaggccu

SEQ ID NO: 80348 - RNA, 21 nt, Artificial Sequence
  Oligomer
ucagcuucuucuccuucaguu

SEQ ID NO: 80349 - RNA, 21 nt, Artificial Sequence
  Oligomer
aucgugucuuuaucaucccua

SEQ ID NO: 80350 - RNA, 21 nt, Artificial Sequence
  Oligomer
uaggaugaugggaguguuggg

SEQ ID NO: 80351 - RNA, 21 nt, Artificial Sequence
  Oligomer
ucaaaugaugcaggacucaca

SEQ ID NO: 80352 - RNA, 21 nt, Artificial Sequence
  Oligomer
uccaucuaccauaacauuggc

SEQ ID NO: 80353 - RNA, 21 nt, Artificial Sequence
  Oligomer
uucugcuuuacgcaucugaga

SEQ ID NO: 80354 - RNA, 21 nt, Artificial Sequence
  Oligomer
ucugcuuuacgcaucugagaa

SEQ ID NO: 80355 - RNA, 21 nt, Artificial Sequence
  Oligomer
ugcuuuacgcaucugagaacu

SEQ ID NO: 80356 - RNA, 21 nt, Artificial Sequence
  Oligomer
uaacugcagaagcuaccgucu

SEQ ID NO: 80357 - RNA, 21 nt, Artificial Sequence
  Oligomer
uaucccauaagcccagauuca

SEQ ID NO: 80358 - RNA, 21 nt, Artificial Sequence
  Oligomer
uauauucuccaggaaaugcau

SEQ ID NO: 80359 - RNA, 21 nt, Artificial Sequence
  Oligomer
ugaagggucccacgcuguauu

SEQ ID NO: 80360 - RNA, 21 nt, Artificial Sequence
  Oligomer
acaguuuacagaaccucacag

SEQ ID NO: 80361 - RNA, 21 nt, Artificial Sequence
  Oligomer
cuaaucgacaaaaaaaccuuc

SEQ ID NO: 80362 - RNA, 21 nt, Artificial Sequence
  Oligomer
aaaagcacuuacuaaguuagc

SEQ ID NO: 80363 - RNA, 21 nt, Artificial Sequence
  Oligomer
ugaucaguaggcaaguuuuac

SEQ ID NO: 80364 - RNA, 21 nt, Artificial Sequence
  Oligomer
ucuuucaucaucuacugcauu

SEQ ID NO: 80365 - RNA, 21 nt, Artificial Sequence
  Oligomer
uuuguccuuugaucacacaca

SEQ ID NO: 80366 - RNA, 21 nt, Artificial Sequence
  Oligomer
ugcagaagcuaccgucuucuc

SEQ ID NO: 80367 - RNA, 21 nt, Artificial Sequence
  Oligomer
uaggcaaagcgacuacaggag

SEQ ID NO: 80368 - RNA, 21 nt, Artificial Sequence
  Oligomer
guccuuugaucacacacaccc

SEQ ID NO: 80369 - RNA, 21 nt, Artificial Sequence
  Oligomer
cuuugcaaaguucagugcucg

SEQ ID NO: 80370 - RNA, 21 nt, Artificial Sequence
  Oligomer
aguuuaguucccacuaggaug

SEQ ID NO: 80371 - RNA, 21 nt, Artificial Sequence
  Oligomer
uucuccaggaaaugcauuggu

SEQ ID NO: 80372 - RNA, 21 nt, Artificial Sequence
  Oligomer
ccuuucuuucaucaucuacug

SEQ ID NO: 80373 - RNA, 21 nt, Artificial Sequence
  Oligomer
gucuuuguccuuugaucacac

SEQ ID NO: 80374 - RNA, 21 nt, Artificial Sequence
  Oligomer
uugcaaaguucagugcucggu

SEQ ID NO: 80375 - RNA, 21 nt, Artificial Sequence
  Oligomer
uguaacaaaaaguuggcauug

SEQ ID NO: 80376 - RNA, 21 nt, Artificial Sequence
  Oligomer
ucucgaucgugucuuuaucau

SEQ ID NO: 80377 - RNA, 21 nt, Artificial Sequence
  Oligomer
ucuccaggaaaugcauugguu

SEQ ID NO: 80378 - RNA, 21 nt, Artificial Sequence
  Oligomer
aucgucagcacuagcacaguu

SEQ ID NO: 80379 - RNA, 21 nt, Artificial Sequence
  Oligomer
aaugcauugguuguguaacug

SEQ ID NO: 80380 - RNA, 21 nt, Artificial Sequence
  Oligomer
aucacaaagacugauccaaag

SEQ ID NO: 80381 - RNA, 21 nt, Artificial Sequence
  Oligomer
ugaguucaauggcaacgcuuc

SEQ ID NO: 80382 - RNA, 21 nt, Artificial Sequence
  Oligomer
uguucugcuuuacgcaucuga

SEQ ID NO: 80383 - RNA, 21 nt, Artificial Sequence
  Oligomer
aaacacugucuugaggccucg

SEQ ID NO: 80384 - RNA, 21 nt, Artificial Sequence
  Oligomer
ugucauaaucuucuuguccag

SEQ ID NO: 80385 - RNA, 21 nt, Artificial Sequence
  Oligomer
uuguccagcuguaucccauaa

SEQ ID NO: 80386 - RNA, 21 nt, Artificial Sequence
  Oligomer
uacagaaccucacagacccaa

SEQ ID NO: 80387 - RNA, 21 nt, Artificial Sequence
  Oligomer
auaaagcugcaacacaugauu

SEQ ID NO: 80388 - RNA, 21 nt, Artificial Sequence
  Oligomer
uaggcaaguuuuaccuacagc

SEQ ID NO: 80389 - RNA, 21 nt, Artificial Sequence
  Oligomer
aauguaguguaaaucuccacu

SEQ ID NO: 80390 - RNA, 21 nt, Artificial Sequence
  Oligomer
uucgggaggcuguucugcuuu

SEQ ID NO: 80391 - RNA, 21 nt, Artificial Sequence
  Oligomer
auaaucuucuuguccagcugu

SEQ ID NO: 80392 - RNA, 21 nt, Artificial Sequence
  Oligomer
ugaggaaaacugcagagaaac

SEQ ID NO: 80393 - RNA, 21 nt, Artificial Sequence
  Oligomer
aagacaguagggauauauucu

SEQ ID NO: 80394 - RNA, 21 nt, Artificial Sequence
  Oligomer
ucagaaaacucgcuaugaaau

SEQ ID NO: 80395 - RNA, 21 nt, Artificial Sequence
  Oligomer
aaucacaaagacugauccaaa

SEQ ID NO: 80396 - RNA, 21 nt, Artificial Sequence
  Oligomer
guucaauggcaacgcuucauu

SEQ ID NO: 80397 - RNA, 21 nt, Artificial Sequence
  Oligomer
ugugagucugaacucuuacau

SEQ ID NO: 80398 - RNA, 21 nt, Artificial Sequence
  Oligomer
uuggcauugagugcgaaggcu

SEQ ID NO: 80399 - RNA, 21 nt, Artificial Sequence
  Oligomer
uuccaagggacaggaccaaga

SEQ ID NO: 80400 - RNA, 21 nt, Artificial Sequence
  Oligomer
uucgucaaacacugucuugag

SEQ ID NO: 80401 - RNA, 21 nt, Artificial Sequence
  Oligomer
agcacuccagguauuuuacag

SEQ ID NO: 80402 - RNA, 21 nt, Artificial Sequence
  Oligomer
agaaacaggaaauggccgcuc

SEQ ID NO: 80403 - RNA, 21 nt, Artificial Sequence
  Oligomer
agauucaccgguuuuccaucu

SEQ ID NO: 80404 - RNA, 21 nt, Artificial Sequence
  Oligomer
aaaacuauaaagcugcaacac

SEQ ID NO: 80405 - RNA, 21 nt, Artificial Sequence
  Oligomer
ccaaccuuucuuucaucaucu

SEQ ID NO: 80406 - RNA, 21 nt, Artificial Sequence
  Oligomer
ucauuagaggaaauagcaguu

SEQ ID NO: 80407 - RNA, 21 nt, Artificial Sequence
  Oligomer
ucuuccucuucuucacgggag

SEQ ID NO: 80408 - RNA, 21 nt, Artificial Sequence
  Oligomer
ugaugggagucagcuucuucu

SEQ ID NO: 80409 - RNA, 21 nt, Artificial Sequence
  Oligomer
gucauaaucuucuuguccagc

SEQ ID NO: 80410 - RNA, 21 nt, Artificial Sequence
  Oligomer
ucuuguccagcuguaucccau

SEQ ID NO: 80411 - RNA, 21 nt, Artificial Sequence
  Oligomer
aucccauaagcccagauucac

SEQ ID NO: 80412 - RNA, 21 nt, Artificial Sequence
  Oligomer
accgguuuuccaucuaccaua

SEQ ID NO: 80413 - RNA, 21 nt, Artificial Sequence
  Oligomer
auauucuccaggaaaugcauu

SEQ ID NO: 80414 - RNA, 21 nt, Artificial Sequence
  Oligomer
acaauucugcaacugucaauu

SEQ ID NO: 80415 - RNA, 21 nt, Artificial Sequence
  Oligomer
acaauguaguguaaaucucca

SEQ ID NO: 80416 - RNA, 21 nt, Artificial Sequence
  Oligomer
aaaucuccacuucguauuuug

SEQ ID NO: 80417 - RNA, 21 nt, Artificial Sequence
  Oligomer
gucaaaauacugucuuugucc

SEQ ID NO: 80418 - RNA, 21 nt, Artificial Sequence
  Oligomer
ucuuuguccuuugaucacaca

SEQ ID NO: 80419 - RNA, 21 nt, Artificial Sequence
  Oligomer
uguucaaaaucuccgcaaaag

SEQ ID NO: 80420 - RNA, 21 nt, Artificial Sequence
  Oligomer
cacuccagguauuuuacagca

SEQ ID NO: 80421 - RNA, 21 nt, Artificial Sequence
  Oligomer
accacuuugcacggacauuuu

SEQ ID NO: 80422 - RNA, 21 nt, Artificial Sequence
  Oligomer
cuccacaauucugcaacuguc

SEQ ID NO: 80423 - RNA, 21 nt, Artificial Sequence
  Oligomer
aacagaacaaccaguuuaaag

SEQ ID NO: 80424 - RNA, 21 nt, Artificial Sequence
  Oligomer
cugauaauaccaaccuuucuu

SEQ ID NO: 80425 - RNA, 21 nt, Artificial Sequence
  Oligomer
accuuucuuucaucaucuacu

SEQ ID NO: 80426 - RNA, 21 nt, Artificial Sequence
  Oligomer
guacaauguaguguaaaucuc

SEQ ID NO: 80427 - RNA, 21 nt, Artificial Sequence
  Oligomer
auguaguguaaaucuccacuu

SEQ ID NO: 80428 - RNA, 21 nt, Artificial Sequence
  Oligomer
acgcucacuccauuacaguac

SEQ ID NO: 80429 - RNA, 21 nt, Artificial Sequence
  Oligomer
cuccuaacugcagaagcuacc

SEQ ID NO: 80430 - RNA, 21 nt, Artificial Sequence
  Oligomer
aaucuguaacaaaaaguuggc

SEQ ID NO: 80431 - RNA, 21 nt, Artificial Sequence
  Oligomer
ucuucuccuucaguuucucga

SEQ ID NO: 80432 - RNA, 21 nt, Artificial Sequence
  Oligomer
uccuucaguuucucgaucgug

SEQ ID NO: 80433 - RNA, 21 nt, Artificial Sequence
  Oligomer
ucccuaagaucaaguuuaguu

SEQ ID NO: 80434 - RNA, 21 nt, Artificial Sequence
  Oligomer
aucugucauaaucuucuuguc

SEQ ID NO: 80435 - RNA, 21 nt, Artificial Sequence
  Oligomer
gacaguagggauauauucucc

SEQ ID NO: 80436 - RNA, 21 nt, Artificial Sequence
  Oligomer
auucucgccagugaguuaagu

SEQ ID NO: 80437 - RNA, 21 nt, Artificial Sequence
  Oligomer
aacuauaaagcugcaacacau

SEQ ID NO: 80438 - RNA, 21 nt, Artificial Sequence
  Oligomer
gcucugaauaaaguaacaugg

SEQ ID NO: 80439 - RNA, 21 nt, Artificial Sequence
  Oligomer
cuucauucgggaggcuguucu

SEQ ID NO: 80440 - RNA, 21 nt, Artificial Sequence
  Oligomer
agaacuacauaggagagcaag

SEQ ID NO: 80441 - RNA, 21 nt, Artificial Sequence
  Oligomer
cuuuaagaaggcuugucauuu

SEQ ID NO: 80442 - RNA, 21 nt, Artificial Sequence
  Oligomer
ugagucugaacucuuacauuu

SEQ ID NO: 80443 - RNA, 21 nt, Artificial Sequence
  Oligomer
ucucuuccucuucuucacggg

SEQ ID NO: 80444 - RNA, 21 nt, Artificial Sequence
  Oligomer
ucaaagacaguagggauauau

SEQ ID NO: 80445 - RNA, 21 nt, Artificial Sequence
  Oligomer
aguagggauauauucuccagg

SEQ ID NO: 80446 - RNA, 21 nt, Artificial Sequence
  Oligomer
acuauaaagcugcaacacaug

SEQ ID NO: 80447 - RNA, 21 nt, Artificial Sequence
  Oligomer
uauaaagcugcaacacaugau

SEQ ID NO: 80448 - RNA, 21 nt, Artificial Sequence
  Oligomer
ucuguaacaaaaaguuggcau

SEQ ID NO: 80449 - RNA, 21 nt, Artificial Sequence
  Oligomer
uacaaagguuccaagggacag

SEQ ID NO: 80450 - RNA, 21 nt, Artificial Sequence
  Oligomer
uccagguauuuuacagcacca

SEQ ID NO: 80451 - RNA, 21 nt, Artificial Sequence
  Oligomer
ucuccuuagccauggcuagac

SEQ ID NO: 80452 - RNA, 21 nt, Artificial Sequence
  Oligomer
agcuucuucuccuucaguuuc

SEQ ID NO: 80453 - RNA, 21 nt, Artificial Sequence
  Oligomer
cuucaguuucucgaucguguc

SEQ ID NO: 80454 - RNA, 21 nt, Artificial Sequence
  Oligomer
ucgucagcacuagcacaguuu

SEQ ID NO: 80455 - RNA, 21 nt, Artificial Sequence
  Oligomer
uagcgacuaacagaacaacca

SEQ ID NO: 80456 - RNA, 21 nt, Artificial Sequence
  Oligomer
agcgacuaacagaacaaccag

SEQ ID NO: 80457 - RNA, 21 nt, Artificial Sequence
  Oligomer
accaaccuuucuuucaucauc

SEQ ID NO: 80458 - RNA, 21 nt, Artificial Sequence
  Oligomer
ucauuccuuguacaauguagu

SEQ ID NO: 80459 - RNA, 21 nt, Artificial Sequence
  Oligomer
acgcaucugagaacuacauag

SEQ ID NO: 80460 - RNA, 21 nt, Artificial Sequence
  Oligomer
agugucugcaccuccuaacug

SEQ ID NO: 80461 - RNA, 21 nt, Artificial Sequence
  Oligomer
ucuuugcaaaguucagugcuc

SEQ ID NO: 80462 - RNA, 21 nt, Artificial Sequence
  Oligomer
aucuguaacaaaaaguuggca

SEQ ID NO: 80463 - RNA, 21 nt, Artificial Sequence
  Oligomer
cagguauuuuacagcaccaau

SEQ ID NO: 80464 - RNA, 21 nt, Artificial Sequence
  Oligomer
ucgugucuuuaucaucccuaa

SEQ ID NO: 80465 - RNA, 21 nt, Artificial Sequence
  Oligomer
ucaucccuaagaucaaguuua

SEQ ID NO: 80466 - RNA, 21 nt, Artificial Sequence
  Oligomer
augaugggaguguugggacag

SEQ ID NO: 80467 - RNA, 21 nt, Artificial Sequence
  Oligomer
uguaucccauaagcccagauu

SEQ ID NO: 80468 - RNA, 21 nt, Artificial Sequence
  Oligomer
acaucgucagcacuagcacag

SEQ ID NO: 80469 - RNA, 21 nt, Artificial Sequence
  Oligomer
aaaugcauugguuguguaacu

SEQ ID NO: 80470 - RNA, 21 nt, Artificial Sequence
  Oligomer
ugguuguguaacugaucagua

SEQ ID NO: 80471 - RNA, 21 nt, Artificial Sequence
  Oligomer
uguaacugaucaguaggcaag

SEQ ID NO: 80472 - RNA, 21 nt, Artificial Sequence
  Oligomer
uaguguaaaucuccacuucgu

SEQ ID NO: 80473 - RNA, 21 nt, Artificial Sequence
  Oligomer
acuccauuacaguacaauguu

SEQ ID NO: 80474 - RNA, 21 nt, Artificial Sequence
  Oligomer
aacacgugcugcuaacucacu

SEQ ID NO: 80475 - RNA, 21 nt, Artificial Sequence
  Oligomer
ugcagagaaacaggaaauggc

SEQ ID NO: 80476 - RNA, 21 nt, Artificial Sequence
  Oligomer
uucccacuaggaugaugggag

SEQ ID NO: 80477 - RNA, 21 nt, Artificial Sequence
  Oligomer
acggacauuuucaaaugaugc

SEQ ID NO: 80478 - RNA, 21 nt, Artificial Sequence
  Oligomer
ugcuaauugcauuagcaaaag

SEQ ID NO: 80479 - RNA, 21 nt, Artificial Sequence
  Oligomer
cuauaaagcugcaacacauga

SEQ ID NO: 80480 - RNA, 21 nt, Artificial Sequence
  Oligomer
cuuuuagaguuuuuacccgug

SEQ ID NO: 80481 - RNA, 21 nt, Artificial Sequence
  Oligomer
aguuuuuacccgugacacuuu

SEQ ID NO: 80482 - RNA, 21 nt, Artificial Sequence
  Oligomer
uuuuacccgugacacuuucau

SEQ ID NO: 80483 - RNA, 21 nt, Artificial Sequence
  Oligomer
cuuuguccuuugaucacacac

SEQ ID NO: 80484 - RNA, 21 nt, Artificial Sequence
  Oligomer
agguauuuuacagcaccaauc

SEQ ID NO: 80485 - RNA, 21 nt, Artificial Sequence
  Oligomer
ugucuuuaucaucccuaagau

SEQ ID NO: 80486 - RNA, 21 nt, Artificial Sequence
  Oligomer
uaaucuucuuguccagcugua

SEQ ID NO: 80487 - RNA, 21 nt, Artificial Sequence
  Oligomer
ucucgccagugaguuaaguug

SEQ ID NO: 80488 - RNA, 21 nt, Artificial Sequence
  Oligomer
acaucaauaggcaaagcgacu

SEQ ID NO: 80489 - RNA, 21 nt, Artificial Sequence
  Oligomer
agcucugaauaaaguaacaug

SEQ ID NO: 80490 - RNA, 21 nt, Artificial Sequence
  Oligomer
ucuacugcauuugacagaaau

SEQ ID NO: 80491 - RNA, 21 nt, Artificial Sequence
  Oligomer
cucuuaaucugaacaagaaug

SEQ ID NO: 80492 - RNA, 21 nt, Artificial Sequence
  Oligomer
acuccagguauuuuacagcac

SEQ ID NO: 80493 - RNA, 21 nt, Artificial Sequence
  Oligomer
guauuuuacagcaccaaucuc

SEQ ID NO: 80494 - RNA, 21 nt, Artificial Sequence
  Oligomer
agagaaacaggaaauggccgc

SEQ ID NO: 80495 - RNA, 21 nt, Artificial Sequence
  Oligomer
cuuugcacggacauuuucaaa

SEQ ID NO: 80496 - RNA, 21 nt, Artificial Sequence
  Oligomer
aaaugaugcaggacucacaag

SEQ ID NO: 80497 - RNA, 21 nt, Artificial Sequence
  Oligomer
aacaucgucagcacuagcaca

SEQ ID NO: 80498 - RNA, 21 nt, Artificial Sequence
  Oligomer
agagggucaguauuggucaag

SEQ ID NO: 80499 - RNA, 21 nt, Artificial Sequence
  Oligomer
acauggaaagcacuuuuacua

SEQ ID NO: 80500 - RNA, 21 nt, Artificial Sequence
  Oligomer
acuaaguuagcgacuaacaga

SEQ ID NO: 80501 - RNA, 21 nt, Artificial Sequence
  Oligomer
cuuucaucaucuacugcauuu

SEQ ID NO: 80502 - RNA, 21 nt, Artificial Sequence
  Oligomer
cacagcuaaacagaauucuuc

SEQ ID NO: 80503 - RNA, 21 nt, Artificial Sequence
  Oligomer
uacgcucacuccauuacagua

SEQ ID NO: 80504 - RNA, 21 nt, Artificial Sequence
  Oligomer
ucacuggugaguucaauggca

SEQ ID NO: 80505 - RNA, 21 nt, Artificial Sequence
  Oligomer
cuuuacgcaucugagaacuac

SEQ ID NO: 80506 - RNA, 21 nt, Artificial Sequence
  Oligomer
acauaggagagcaagugucug

SEQ ID NO: 80507 - RNA, 21 nt, Artificial Sequence
  Oligomer
ucuucucaaagacgaaggucu

SEQ ID NO: 80508 - RNA, 21 nt, Artificial Sequence
  Oligomer
agucugaacucuuacauuuag

SEQ ID NO: 80509 - RNA, 21 nt, Artificial Sequence
  Oligomer
uccaagggacaggaccaagaa

SEQ ID NO: 80510 - RNA, 21 nt, Artificial Sequence
  Oligomer
auuuacaacagcaggcauuuu

SEQ ID NO: 80511 - RNA, 21 nt, Artificial Sequence
  Oligomer
cuaggaugaugggaguguugg

SEQ ID NO: 80512 - RNA, 21 nt, Artificial Sequence
  Oligomer
cacuuugcacggacauuuuca

SEQ ID NO: 80513 - RNA, 21 nt, Artificial Sequence
  Oligomer
cugucauaaucuucuugucca

SEQ ID NO: 80514 - RNA, 21 nt, Artificial Sequence
  Oligomer
aaaguaacauggaaagcacuu

SEQ ID NO: 80515 - RNA, 21 nt, Artificial Sequence
  Oligomer
aacauggaaagcacuuuuacu

SEQ ID NO: 80516 - RNA, 21 nt, Artificial Sequence
  Oligomer
ucaguaggcaaguuuuaccua

SEQ ID NO: 80517 - RNA, 21 nt, Artificial Sequence
  Oligomer
aauacugucuuuguccuuuga

SEQ ID NO: 80518 - RNA, 21 nt, Artificial Sequence
  Oligomer
auacugucuuuguccuuugau

SEQ ID NO: 80519 - RNA, 21 nt, Artificial Sequence
  Oligomer
gcuaugaaaucacaaagacug

SEQ ID NO: 80520 - RNA, 21 nt, Artificial Sequence
  Oligomer
accgucuucucaaagacgaag

SEQ ID NO: 80521 - RNA, 21 nt, Artificial Sequence
  Oligomer
aaggucuuugcaaaguucagu

SEQ ID NO: 80522 - RNA, 21 nt, Artificial Sequence
  Oligomer
aaguucagugcucgguguucu

SEQ ID NO: 80523 - RNA, 21 nt, Artificial Sequence
  Oligomer
ucgguguucucggcacaacaa

SEQ ID NO: 80524 - RNA, 21 nt, Artificial Sequence
  Oligomer
aagguauuuuggcaacucuua

SEQ ID NO: 80525 - RNA, 21 nt, Artificial Sequence
  Oligomer
ucgucaaacacugucuugagg

SEQ ID NO: 80526 - RNA, 21 nt, Artificial Sequence
  Oligomer
ccuucaguuucucgaucgugu

SEQ ID NO: 80527 - RNA, 21 nt, Artificial Sequence
  Oligomer
accucaggauaccacuuugca

SEQ ID NO: 80528 - RNA, 21 nt, Artificial Sequence
  Oligomer
caaaugaugcaggacucacaa

SEQ ID NO: 80529 - RNA, 21 nt, Artificial Sequence
  Oligomer
acccaaagcugaggaaaacug

SEQ ID NO: 80530 - RNA, 21 nt, Artificial Sequence
  Oligomer
guaucccauaagcccagauuc

SEQ ID NO: 80531 - RNA, 21 nt, Artificial Sequence
  Oligomer
auaagcccagauucaccgguu

SEQ ID NO: 80532 - RNA, 21 nt, Artificial Sequence
  Oligomer
uaccauaacauuggcagaaua

SEQ ID NO: 80533 - RNA, 21 nt, Artificial Sequence
  Oligomer
ucagcacuagcacaguuuaca

SEQ ID NO: 80534 - RNA, 21 nt, Artificial Sequence
  Oligomer
cacaguuuacagaaccucaca

SEQ ID NO: 80535 - RNA, 21 nt, Artificial Sequence
  Oligomer
guuaugucgggaacacgugcu

SEQ ID NO: 80536 - RNA, 21 nt, Artificial Sequence
  Oligomer
agguauuuuggcaacucuuaa

SEQ ID NO: 80537 - RNA, 21 nt, Artificial Sequence
  Oligomer
aacaaaaaguuggcauugagu

SEQ ID NO: 80538 - RNA, 21 nt, Artificial Sequence
  Oligomer
acaaagguuccaagggacagg

SEQ ID NO: 80539 - RNA, 21 nt, Artificial Sequence
  Oligomer
aagcugaggaaaacugcagag

SEQ ID NO: 80540 - RNA, 21 nt, Artificial Sequence
  Oligomer
gauauauucuccaggaaaugc

SEQ ID NO: 80541 - RNA, 21 nt, Artificial Sequence
  Oligomer
auucuccaggaaaugcauugg

SEQ ID NO: 80542 - RNA, 21 nt, Artificial Sequence
  Oligomer
auugguuguguaacugaucag

SEQ ID NO: 80543 - RNA, 21 nt, Artificial Sequence
  Oligomer
aaacuauaaagcugcaacaca

SEQ ID NO: 80544 - RNA, 21 nt, Artificial Sequence
  Oligomer
acaccuaguuacuagaaaacu

SEQ ID NO: 80545 - RNA, 21 nt, Artificial Sequence
  Oligomer
aaggaaagcacuuauuagcuc

SEQ ID NO: 80546 - RNA, 21 nt, Artificial Sequence
  Oligomer
aggaaagcacuuauuagcucu

SEQ ID NO: 80547 - RNA, 21 nt, Artificial Sequence
  Oligomer
gguguaagagaaaggaaaagc

SEQ ID NO: 80548 - RNA, 21 nt, Artificial Sequence
  Oligomer
ccuuuuagaguuuuuacccgu

SEQ ID NO: 80549 - RNA, 21 nt, Artificial Sequence
  Oligomer
gaguuuuuacccgugacacuu

SEQ ID NO: 80550 - RNA, 21 nt, Artificial Sequence
  Oligomer
cucgcuaugaaaucacaaaga

SEQ ID NO: 80551 - RNA, 21 nt, Artificial Sequence
  Oligomer
cuacgcucacuccauuacagu

SEQ ID NO: 80552 - RNA, 21 nt, Artificial Sequence
  Oligomer
cgcaucugagaacuacauagg

SEQ ID NO: 80553 - RNA, 21 nt, Artificial Sequence
  Oligomer
uaacaaaaaguuggcauugag

SEQ ID NO: 80554 - RNA, 21 nt, Artificial Sequence
  Oligomer
gcaggcauuuucucuuccucu

SEQ ID NO: 80555 - RNA, 21 nt, Artificial Sequence
  Oligomer
cucgaucgugucuuuaucauc

SEQ ID NO: 80556 - RNA, 21 nt, Artificial Sequence
  Oligomer
ugucgguaaucuggcaagaca

SEQ ID NO: 80557 - RNA, 21 nt, Artificial Sequence
  Oligomer
ccuaguuacuagaaaacuaag

SEQ ID NO: 80558 - RNA, 21 nt, Artificial Sequence
  Oligomer
acuaaggaaagcacuuauuag

SEQ ID NO: 80559 - RNA, 21 nt, Artificial Sequence
  Oligomer
gacaaaaaaaccuucuaaugc

SEQ ID NO: 80560 - RNA, 21 nt, Artificial Sequence
  Oligomer
guaguguaaaucuccacuucg

SEQ ID NO: 80561 - RNA, 21 nt, Artificial Sequence
  Oligomer
ucugcaccuccuaacugcaga

SEQ ID NO: 80562 - RNA, 21 nt, Artificial Sequence
  Oligomer
ugcaccuccuaacugcagaag

SEQ ID NO: 80563 - RNA, 21 nt, Artificial Sequence
  Oligomer
aguguaguucagaagguauuu

SEQ ID NO: 80564 - RNA, 21 nt, Artificial Sequence
  Oligomer
agaaugugagucugaacucuu

SEQ ID NO: 80565 - RNA, 21 nt, Artificial Sequence
  Oligomer
agaucaaguuuaguucccacu

SEQ ID NO: 80566 - RNA, 21 nt, Artificial Sequence
  Oligomer
ccacuuugcacggacauuuuc

SEQ ID NO: 80567 - RNA, 21 nt, Artificial Sequence
  Oligomer
uguccagcuguaucccauaag

SEQ ID NO: 80568 - RNA, 21 nt, Artificial Sequence
  Oligomer
cagauucaccgguuuuccauc

SEQ ID NO: 80569 - RNA, 21 nt, Artificial Sequence
  Oligomer
auugucaaagacaguagggau

SEQ ID NO: 80570 - RNA, 21 nt, Artificial Sequence
  Oligomer
guagggauauauucuccagga

SEQ ID NO: 80571 - RNA, 21 nt, Artificial Sequence
  Oligomer
cuguauucucgccagugaguu

SEQ ID NO: 80572 - RNA, 21 nt, Artificial Sequence
  Oligomer
cccaaaggaacaucaauaggc

SEQ ID NO: 80573 - RNA, 21 nt, Artificial Sequence
  Oligomer
cuggcaagacagugauguuaa

SEQ ID NO: 80574 - RNA, 21 nt, Artificial Sequence
  Oligomer
aagcacuuacuaaguuagcga

SEQ ID NO: 80575 - RNA, 21 nt, Artificial Sequence
  Oligomer
cuaaguuagcgacuaacagaa

SEQ ID NO: 80576 - RNA, 21 nt, Artificial Sequence
  Oligomer
aaguuagcgacuaacagaaca

SEQ ID NO: 80577 - RNA, 21 nt, Artificial Sequence
  Oligomer
cauggcagguguaagagaaag

SEQ ID NO: 80578 - RNA, 21 nt, Artificial Sequence
  Oligomer
ucuguucaaaaucuccgcaaa

SEQ ID NO: 80579 - RNA, 21 nt, Artificial Sequence
  Oligomer
uaacucacuggugaguucaau

SEQ ID NO: 80580 - RNA, 21 nt, Artificial Sequence
  Oligomer
cuacauaggagagcaaguguc

SEQ ID NO: 80581 - RNA, 21 nt, Artificial Sequence
  Oligomer
ccgucuucucaaagacgaagg

SEQ ID NO: 80582 - RNA, 21 nt, Artificial Sequence
  Oligomer
guucucggcacaacaaugcag

SEQ ID NO: 80583 - RNA, 21 nt, Artificial Sequence
  Oligomer
augugagucugaacucuuaca

SEQ ID NO: 80584 - RNA, 21 nt, Artificial Sequence
  Oligomer
aguuucucgaucgugucuuua

SEQ ID NO: 80585 - RNA, 21 nt, Artificial Sequence
  Oligomer
agcuguaucccauaagcccag

SEQ ID NO: 80586 - RNA, 21 nt, Artificial Sequence
  Oligomer
agugaguuaaguuguacagaa

SEQ ID NO: 80587 - RNA, 21 nt, Artificial Sequence
  Oligomer
gagggucaguauuggucaagu

SEQ ID NO: 80588 - RNA, 21 nt, Artificial Sequence
  Oligomer
acccgugacacuuucauuccu

SEQ ID NO: 80589 - RNA, 21 nt, Artificial Sequence
  Oligomer
cugucuuuguccuuugaucac

SEQ ID NO: 80590 - RNA, 21 nt, Artificial Sequence
  Oligomer
cagaaaacucgcuaugaaauc

SEQ ID NO: 80591 - RNA, 21 nt, Artificial Sequence
  Oligomer
ucacaaagacugauccaaaga

SEQ ID NO: 80592 - RNA, 21 nt, Artificial Sequence
  Oligomer
guacaauguuaugucgggaac

SEQ ID NO: 80593 - RNA, 21 nt, Artificial Sequence
  Oligomer
gugaguucaauggcaacgcuu

SEQ ID NO: 80594 - RNA, 21 nt, Artificial Sequence
  Oligomer
auucgggaggcuguucugcuu

SEQ ID NO: 80595 - RNA, 21 nt, Artificial Sequence
  Oligomer
aaaguucagugcucgguguuc

SEQ ID NO: 80596 - RNA, 21 nt, Artificial Sequence
  Oligomer
ugcaguguaguucagaaggua

SEQ ID NO: 80597 - RNA, 21 nt, Artificial Sequence
  Oligomer
acauuuacaacagcaggcauu

SEQ ID NO: 80598 - RNA, 21 nt, Artificial Sequence
  Oligomer
aggaugaugggaguguuggga

SEQ ID NO: 80599 - RNA, 21 nt, Artificial Sequence
  Oligomer
aggauaccacuuugcacggac

SEQ ID NO: 80600 - RNA, 21 nt, Artificial Sequence
  Oligomer
ugaguuaaguuguacagaaca

SEQ ID NO: 80601 - RNA, 21 nt, Artificial Sequence
  Oligomer
aguuaaguuguacagaacauc

SEQ ID NO: 80602 - RNA, 21 nt, Artificial Sequence
  Oligomer
agacccaaaggaacaucaaua

SEQ ID NO: 80603 - RNA, 21 nt, Artificial Sequence
  Oligomer
aagagggucaguauuggucaa

SEQ ID NO: 80604 - RNA, 21 nt, Artificial Sequence
  Oligomer
ucuggcaagacagugauguua

SEQ ID NO: 80605 - RNA, 21 nt, Artificial Sequence
  Oligomer
agaguuuuuacccgugacacu

SEQ ID NO: 80606 - RNA, 21 nt, Artificial Sequence
  Oligomer
cuggugaguucaauggcaacg

SEQ ID NO: 80607 - RNA, 21 nt, Artificial Sequence
  Oligomer
cugagaacuacauaggagagc

SEQ ID NO: 80608 - RNA, 21 nt, Artificial Sequence
  Oligomer
cugaacucuuacauuuagaac

SEQ ID NO: 80609 - RNA, 21 nt, Artificial Sequence
  Oligomer
agcaggcauuuucucuuccuc

SEQ ID NO: 80610 - RNA, 21 nt, Artificial Sequence
  Oligomer
gugucuuuaucaucccuaaga

SEQ ID NO: 80611 - RNA, 21 nt, Artificial Sequence
  Oligomer
uguauucucgccagugaguua

SEQ ID NO: 80612 - RNA, 21 nt, Artificial Sequence
  Oligomer
cgagguaaagagggucaguau

SEQ ID NO: 80613 - RNA, 21 nt, Artificial Sequence
  Oligomer
ggcaaguuuuaccuacagcuc

SEQ ID NO: 80614 - RNA, 21 nt, Artificial Sequence
  Oligomer
guaaaucuccacuucguauuu

SEQ ID NO: 80615 - RNA, 21 nt, Artificial Sequence
  Oligomer
cuggucagaaaacucgcuaug

SEQ ID NO: 80616 - RNA, 21 nt, Artificial Sequence
  Oligomer
gcagagaaacaggaaauggcc

SEQ ID NO: 80617 - RNA, 21 nt, Artificial Sequence
  Oligomer
gggcgcuuuugaaaaauaagg

SEQ ID NO: 80618 - RNA, 21 nt, Artificial Sequence
  Oligomer
gagcacuccagguauuuuaca

SEQ ID NO: 80619 - RNA, 21 nt, Artificial Sequence
  Oligomer
acuaggaugaugggaguguug

SEQ ID NO: 80620 - RNA, 21 nt, Artificial Sequence
  Oligomer
caccucaggauaccacuuugc

SEQ ID NO: 80621 - RNA, 21 nt, Artificial Sequence
  Oligomer
ugcaggacucacaagggaaaa

SEQ ID NO: 80622 - RNA, 21 nt, Artificial Sequence
  Oligomer
uugucaaagacaguagggaua

SEQ ID NO: 80623 - RNA, 21 nt, Artificial Sequence
  Oligomer
ugucaaagacaguagggauau

SEQ ID NO: 80624 - RNA, 21 nt, Artificial Sequence
  Oligomer
augcauugguuguguaacuga

SEQ ID NO: 80625 - RNA, 21 nt, Artificial Sequence
  Oligomer
gcgagguaaagagggucagua

SEQ ID NO: 80626 - RNA, 21 nt, Artificial Sequence
  Oligomer
gagguaaagagggucaguauu

SEQ ID NO: 80627 - RNA, 21 nt, Artificial Sequence
  Oligomer
guaacauggaaagcacuuuua

SEQ ID NO: 80628 - RNA, 21 nt, Artificial Sequence
  Oligomer
accuucuaaugcauuaucaga

SEQ ID NO: 80629 - RNA, 21 nt, Artificial Sequence
  Oligomer
agcuggucagaaaacucgcua

SEQ ID NO: 80630 - RNA, 21 nt, Artificial Sequence
  Oligomer
cuccauuacaguacaauguua

SEQ ID NO: 80631 - RNA, 21 nt, Artificial Sequence
  Oligomer
ccuaacugcagaagcuaccgu

SEQ ID NO: 80632 - RNA, 21 nt, Artificial Sequence
  Oligomer
aacugcagaagcuaccgucuu

SEQ ID NO: 80633 - RNA, 21 nt, Artificial Sequence
  Oligomer
cagagaaacaggaaauggccg

SEQ ID NO: 80634 - RNA, 21 nt, Artificial Sequence
  Oligomer
cucggaucgcuucgucaaaca

SEQ ID NO: 80635 - RNA, 21 nt, Artificial Sequence
  Oligomer
ucggaucgcuucgucaaacac

SEQ ID NO: 80636 - RNA, 21 nt, Artificial Sequence
  Oligomer
gaucaaguuuaguucccacua

SEQ ID NO: 80637 - RNA, 21 nt, Artificial Sequence
  Oligomer
gcaccucaggauaccacuuug

SEQ ID NO: 80638 - RNA, 21 nt, Artificial Sequence
  Oligomer
agacaguagggauauauucuc

SEQ ID NO: 80639 - RNA, 21 nt, Artificial Sequence
  Oligomer
cuccaggaaaugcauugguug

SEQ ID NO: 80640 - RNA, 21 nt, Artificial Sequence
  Oligomer
ugcauugguuguguaacugau

SEQ ID NO: 80641 - RNA, 21 nt, Artificial Sequence
  Oligomer
gcugcaacacaugauuuuuac

SEQ ID NO: 80642 - RNA, 21 nt, Artificial Sequence
  Oligomer
ucaucuacugcauuugacaga

SEQ ID NO: 80643 - RNA, 21 nt, Artificial Sequence
  Oligomer
aaucuccacuucguauuuugu

SEQ ID NO: 80644 - RNA, 21 nt, Artificial Sequence
  Oligomer
agaaaacucgcuaugaaauca

SEQ ID NO: 80645 - RNA, 21 nt, Artificial Sequence
  Oligomer
caucugagaacuacauaggag

SEQ ID NO: 80646 - RNA, 21 nt, Artificial Sequence
  Oligomer
ccuccuaacugcagaagcuac

SEQ ID NO: 80647 - RNA, 21 nt, Artificial Sequence
  Oligomer
acugcagaagcuaccgucuuc

SEQ ID NO: 80648 - RNA, 21 nt, Artificial Sequence
  Oligomer
aguuggcauugagugcgaagg

SEQ ID NO: 80649 - RNA, 21 nt, Artificial Sequence
  Oligomer
auaggugaugggagucagcuu

SEQ ID NO: 80650 - RNA, 21 nt, Artificial Sequence
  Oligomer
ugaugggaguguugggacagu

SEQ ID NO: 80651 - RNA, 21 nt, Artificial Sequence
  Oligomer
ccgguuuuccaucuaccauaa

SEQ ID NO: 80652 - RNA, 21 nt, Artificial Sequence
  Oligomer
acacuccacaauucugcaacu

SEQ ID NO: 80653 - RNA, 21 nt, Artificial Sequence
  Oligomer
cauggaaagcacuuuuacuaa

SEQ ID NO: 80654 - RNA, 21 nt, Artificial Sequence
  Oligomer
gaucaguaggcaaguuuuacc

SEQ ID NO: 80655 - RNA, 21 nt, Artificial Sequence
  Oligomer
cugcuaacucacuggugaguu

SEQ ID NO: 80656 - RNA, 21 nt, Artificial Sequence
  Oligomer
ggcauuuucucuuccucuucu

SEQ ID NO: 80657 - RNA, 21 nt, Artificial Sequence
  Oligomer
cccaaagcugaggaaaacugc

SEQ ID NO: 80658 - RNA, 21 nt, Artificial Sequence
  Oligomer
acauuggcagaauaauuguca

SEQ ID NO: 80659 - RNA, 21 nt, Artificial Sequence
  Oligomer
uccaggaaaugcauugguugu

SEQ ID NO: 80660 - RNA, 21 nt, Artificial Sequence
  Oligomer
caguuuacagaaccucacaga

SEQ ID NO: 80661 - RNA, 21 nt, Artificial Sequence
  Oligomer
acagaaccucacagacccaaa

SEQ ID NO: 80662 - RNA, 21 nt, Artificial Sequence
  Oligomer
gucgguaaucuggcaagacag

SEQ ID NO: 80663 - RNA, 21 nt, Artificial Sequence
  Oligomer
aaagcacuuacuaaguuagcg

SEQ ID NO: 80664 - RNA, 21 nt, Artificial Sequence
  Oligomer
aaauggccgcuccacucacau

SEQ ID NO: 80665 - RNA, 21 nt, Artificial Sequence
  Oligomer
acuaacagaacaaccaguuua

SEQ ID NO: 80666 - RNA, 21 nt, Artificial Sequence
  Oligomer
caauguaguguaaaucuccac

SEQ ID NO: 80667 - RNA, 21 nt, Artificial Sequence
  Oligomer
cuguucugcuuuacgcaucug

SEQ ID NO: 80668 - RNA, 21 nt, Artificial Sequence
  Oligomer
cugcagaagcuaccgucuucu

SEQ ID NO: 80669 - RNA, 21 nt, Artificial Sequence
  Oligomer
uucucaaagacgaaggucuuu

SEQ ID NO: 80670 - RNA, 21 nt, Artificial Sequence
  Oligomer
ucagaagguauuuuggcaacu

SEQ ID NO: 80671 - RNA, 21 nt, Artificial Sequence
  Oligomer
aaggcuuuaagaaggcuuguc

SEQ ID NO: 80672 - RNA, 21 nt, Artificial Sequence
  Oligomer
cgucaaacacugucuugaggc

SEQ ID NO: 80673 - RNA, 21 nt, Artificial Sequence
  Oligomer
gcaccaaucuccuuagccaug

SEQ ID NO: 80674 - RNA, 21 nt, Artificial Sequence
  Oligomer
gacauuuucaaaugaugcagg

SEQ ID NO: 80675 - RNA, 21 nt, Artificial Sequence
  Oligomer
aaagcugaggaaaacugcaga

SEQ ID NO: 80676 - RNA, 21 nt, Artificial Sequence
  Oligomer
guccagcuguaucccauaagc

SEQ ID NO: 80677 - RNA, 21 nt, Artificial Sequence
  Oligomer
cagcuguaucccauaagccca

SEQ ID NO: 80678 - RNA, 21 nt, Artificial Sequence
  Oligomer
ucgccagugaguuaaguugua

SEQ ID NO: 80679 - RNA, 21 nt, Artificial Sequence
  Oligomer
ccagugaguuaaguuguacag

SEQ ID NO: 80680 - RNA, 21 nt, Artificial Sequence
  Oligomer
gugaguuaaguuguacagaac

SEQ ID NO: 80681 - RNA, 21 nt, Artificial Sequence
  Oligomer
cauugguuguguaacugauca

SEQ ID NO: 80682 - RNA, 21 nt, Artificial Sequence
  Oligomer
ucgguaaucuggcaagacagu

SEQ ID NO: 80683 - RNA, 21 nt, Artificial Sequence
  Oligomer
cgguaaucuggcaagacagug

SEQ ID NO: 80684 - RNA, 21 nt, Artificial Sequence
  Oligomer
guaaucuggcaagacagugau

SEQ ID NO: 80685 - RNA, 21 nt, Artificial Sequence
  Oligomer
aaccuucuaaugcauuaucag

SEQ ID NO: 80686 - RNA, 21 nt, Artificial Sequence
  Oligomer
agcacuuacuaaguuagcgac

SEQ ID NO: 80687 - RNA, 21 nt, Artificial Sequence
  Oligomer
cuccacuucguauuuugucaa

SEQ ID NO: 80688 - RNA, 21 nt, Artificial Sequence
  Oligomer
aguucaauggcaacgcuucau

SEQ ID NO: 80689 - RNA, 21 nt, Artificial Sequence
  Oligomer
gggcugagacauuuacaacag

SEQ ID NO: 80690 - RNA, 21 nt, Artificial Sequence
  Oligomer
caggcauuuucucuuccucuu

SEQ ID NO: 80691 - RNA, 21 nt, Artificial Sequence
  Oligomer
uagacccugcggauaggugau

SEQ ID NO: 80692 - RNA, 21 nt, Artificial Sequence
  Oligomer
gucagcuucuucuccuucagu

SEQ ID NO: 80693 - RNA, 21 nt, Artificial Sequence
  Oligomer
acacacuugauggccugcauc

SEQ ID NO: 80694 - RNA, 21 nt, Artificial Sequence
  Oligomer
gucagcacuagcacaguuuac

SEQ ID NO: 80695 - RNA, 21 nt, Artificial Sequence
  Oligomer
ucaagugacagugucgguaau

SEQ ID NO: 80696 - RNA, 21 nt, Artificial Sequence
  Oligomer
agugucgguaaucuggcaaga

SEQ ID NO: 80697 - RNA, 21 nt, Artificial Sequence
  Oligomer
cucugaauaaaguaacaugga

SEQ ID NO: 80698 - RNA, 21 nt, Artificial Sequence
  Oligomer
cgacaaaaaaaccuucuaaug

SEQ ID NO: 80699 - RNA, 21 nt, Artificial Sequence
  Oligomer
uaacugaucaguaggcaaguu

SEQ ID NO: 80700 - RNA, 21 nt, Artificial Sequence
  Oligomer
gcuacgcucacuccauuacag

SEQ ID NO: 80701 - RNA, 21 nt, Artificial Sequence
  Oligomer
aguucagugcucgguguucuc

SEQ ID NO: 80702 - RNA, 21 nt, Artificial Sequence
  Oligomer
ccucaggauaccacuuugcac

SEQ ID NO: 80703 - RNA, 21 nt, Artificial Sequence
  Oligomer
ugaugcaggacucacaaggga

SEQ ID NO: 80704 - RNA, 21 nt, Artificial Sequence
  Oligomer
gggaaaagcaaauuaagaaca

SEQ ID NO: 80705 - RNA, 21 nt, Artificial Sequence
  Oligomer
aaacacuccacaauucugcaa

SEQ ID NO: 80706 - RNA, 21 nt, Artificial Sequence
  Oligomer
guacagaacaucgucagcacu

SEQ ID NO: 80707 - RNA, 21 nt, Artificial Sequence
  Oligomer
caggaaaugcauugguugugu

SEQ ID NO: 80708 - RNA, 21 nt, Artificial Sequence
  Oligomer
uggcaagacagugauguuaag

SEQ ID NO: 80709 - RNA, 21 nt, Artificial Sequence
  Oligomer
gcauauugcucagucagaagg

SEQ ID NO: 80710 - RNA, 21 nt, Artificial Sequence
  Oligomer
cuuacuaaguuagcgacuaac

SEQ ID NO: 80711 - RNA, 21 nt, Artificial Sequence
  Oligomer
cgacuaacagaacaaccaguu

SEQ ID NO: 80712 - RNA, 21 nt, Artificial Sequence
  Oligomer
caucaucuacugcauuugaca

SEQ ID NO: 80713 - RNA, 21 nt, Artificial Sequence
  Oligomer
cugcauuugacagaaauuaac

SEQ ID NO: 80714 - RNA, 21 nt, Artificial Sequence
  Oligomer
agcugcuacgcucacuccauu

SEQ ID NO: 80715 - RNA, 21 nt, Artificial Sequence
  Oligomer
ugcuaacucacuggugaguuc

SEQ ID NO: 80716 - RNA, 21 nt, Artificial Sequence
  Oligomer
ucggcacaacaaugcagugua

SEQ ID NO: 80717 - RNA, 21 nt, Artificial Sequence
  Oligomer
guguaguucagaagguauuuu

SEQ ID NO: 80718 - RNA, 21 nt, Artificial Sequence
  Oligomer
gaagguauuuuggcaacucuu

SEQ ID NO: 80719 - RNA, 21 nt, Artificial Sequence
  Oligomer
uggcaacucuuaaucugaaca

SEQ ID NO: 80720 - RNA, 21 nt, Artificial Sequence
  Oligomer
agcaccaaucuccuuagccau

SEQ ID NO: 80721 - RNA, 21 nt, Artificial Sequence
  Oligomer
aaguuuaguucccacuaggau

SEQ ID NO: 80722 - RNA, 21 nt, Artificial Sequence
  Oligomer
guuuaguucccacuaggauga

SEQ ID NO: 80723 - RNA, 21 nt, Artificial Sequence
  Oligomer
cguaaucugucauaaucuucu

SEQ ID NO: 80724 - RNA, 21 nt, Artificial Sequence
  Oligomer
ccagauucaccgguuuuccau

SEQ ID NO: 80725 - RNA, 21 nt, Artificial Sequence
  Oligomer
aacauuggcagaauaauuguc

SEQ ID NO: 80726 - RNA, 21 nt, Artificial Sequence
  Oligomer
aggaaaacugcagagaaacag

SEQ ID NO: 80727 - RNA, 21 nt, Artificial Sequence
  Oligomer
caguagggauauauucuccag

SEQ ID NO: 80728 - RNA, 21 nt, Artificial Sequence
  Oligomer
acagaacaucgucagcacuag

SEQ ID NO: 80729 - RNA, 21 nt, Artificial Sequence
  Oligomer
agcacuuauuagcucugaaua

SEQ ID NO: 80730 - RNA, 21 nt, Artificial Sequence
  Oligomer
acugaucaguaggcaaguuuu

SEQ ID NO: 80731 - RNA, 21 nt, Artificial Sequence
  Oligomer
guaagagaaaggaaaagcuua

SEQ ID NO: 80732 - RNA, 21 nt, Artificial Sequence
  Oligomer
ccugauaauaccaaccuuucu

SEQ ID NO: 80733 - RNA, 21 nt, Artificial Sequence
  Oligomer
gacacuuucauuccuuguaca

SEQ ID NO: 80734 - RNA, 21 nt, Artificial Sequence
  Oligomer
aggcaaguuuuaccuacagcu

SEQ ID NO: 80735 - RNA, 21 nt, Artificial Sequence
  Oligomer
cugcagagaaacaggaaaugg

SEQ ID NO: 80736 - RNA, 21 nt, Artificial Sequence
  Oligomer
ugcugcuaacucacuggugag

SEQ ID NO: 80737 - RNA, 21 nt, Artificial Sequence
  Oligomer
gcuaacucacuggugaguuca

SEQ ID NO: 80738 - RNA, 21 nt, Artificial Sequence
  Oligomer
cuaccgucuucucaaagacga

SEQ ID NO: 80739 - RNA, 21 nt, Artificial Sequence
  Oligomer
gguauuuuacagcaccaaucu

SEQ ID NO: 80740 - RNA, 21 nt, Artificial Sequence
  Oligomer
gucuuuaucaucccuaagauc

SEQ ID NO: 80741 - RNA, 21 nt, Artificial Sequence
  Oligomer
cauaagcccagauucaccggu

SEQ ID NO: 80742 - RNA, 21 nt, Artificial Sequence
  Oligomer
ucuaccauaacauuggcagaa

SEQ ID NO: 80743 - RNA, 21 nt, Artificial Sequence
  Oligomer
uggcagaauaauugucaaaga

SEQ ID NO: 80744 - RNA, 21 nt, Artificial Sequence
  Oligomer
acaguagggauauauucucca

SEQ ID NO: 80745 - RNA, 21 nt, Artificial Sequence
  Oligomer
agaacaucgucagcacuagca

SEQ ID NO: 80746 - RNA, 21 nt, Artificial Sequence
  Oligomer
gcacaguuuacagaaccucac

SEQ ID NO: 80747 - RNA, 23 nt, Artificial Sequence
  Oligomer
gacaguauuuugacaaaauacga

SEQ ID NO: 80748 - RNA, 23 nt, Artificial Sequence
  Oligomer
caguauuuugacaaaauacgaag

SEQ ID NO: 80749 - RNA, 23 nt, Artificial Sequence
  Oligomer
gcauguaugacuuaauaaauccu

SEQ ID NO: 80750 - RNA, 23 nt, Artificial Sequence
  Oligomer
ccauaaaaccauuuuuugaacca

SEQ ID NO: 80751 - RNA, 23 nt, Artificial Sequence
  Oligomer
guuaauuucugucaaaugcagua

SEQ ID NO: 80752 - RNA, 23 nt, Artificial Sequence
  Oligomer
agaauacagcgugggacccuuca

SEQ ID NO: 80753 - RNA, 23 nt, Artificial Sequence
  Oligomer
gcaauuagcauuauguuuugcau

SEQ ID NO: 80754 - RNA, 23 nt, Artificial Sequence
  Oligomer
gcuuuucccuugugaguccugca

SEQ ID NO: 80755 - RNA, 23 nt, Artificial Sequence
  Oligomer
cucuaaaagguuaauuucuguca

SEQ ID NO: 80756 - RNA, 23 nt, Artificial Sequence
  Oligomer
uguucuuaauuugcuuuucccuu

SEQ ID NO: 80757 - RNA, 23 nt, Artificial Sequence
  Oligomer
cauuauguuuugcauguaugacu

SEQ ID NO: 80758 - RNA, 23 nt, Artificial Sequence
  Oligomer
uaguuuucuaguaacuaggugua

SEQ ID NO: 80759 - RNA, 23 nt, Artificial Sequence
  Oligomer
caaauugggcauuuaauucaucu

SEQ ID NO: 80760 - RNA, 23 nt, Artificial Sequence
  Oligomer
guaaagcagaacagccucccgaa

SEQ ID NO: 80761 - RNA, 23 nt, Artificial Sequence
  Oligomer
guaaacugugcuagugcugacga

SEQ ID NO: 80762 - RNA, 23 nt, Artificial Sequence
  Oligomer
agacaguauuuugacaaaauacg

SEQ ID NO: 80763 - RNA, 23 nt, Artificial Sequence
  Oligomer
aguuuucuaguaacuagguguaa

SEQ ID NO: 80764 - RNA, 23 nt, Artificial Sequence
  Oligomer
gucuuugacaauuauucugccaa

SEQ ID NO: 80765 - RNA, 23 nt, Artificial Sequence
  Oligomer
uguaaaauaccuggagugcucgg

SEQ ID NO: 80766 - RNA, 23 nt, Artificial Sequence
  Oligomer
aauggagugagcguagcagcuca

SEQ ID NO: 80767 - RNA, 23 nt, Artificial Sequence
  Oligomer
ucuguaaacugugcuagugcuga

SEQ ID NO: 80768 - RNA, 23 nt, Artificial Sequence
  Oligomer
cuacacugcauuguugugccgag

SEQ ID NO: 80769 - RNA, 23 nt, Artificial Sequence
  Oligomer
guuaugguagauggaaaaccggu

SEQ ID NO: 80770 - RNA, 23 nt, Artificial Sequence
  Oligomer
uaaaaaucauguguugcagcuuu

SEQ ID NO: 80771 - RNA, 23 nt, Artificial Sequence
  Oligomer
cuguaaacugugcuagugcugac

SEQ ID NO: 80772 - RNA, 23 nt, Artificial Sequence
  Oligomer
uccuguuucucugcaguuuuccu

SEQ ID NO: 80773 - RNA, 23 nt, Artificial Sequence
  Oligomer
ccauuuccuguuucucugcaguu

SEQ ID NO: 80774 - RNA, 23 nt, Artificial Sequence
  Oligomer
gaauucuguuuagcugugggugu

SEQ ID NO: 80775 - RNA, 23 nt, Artificial Sequence
  Oligomer
acacaaccaaugcauuuccugga

SEQ ID NO: 80776 - RNA, 23 nt, Artificial Sequence
  Oligomer
ugcaauuagcauuauguuuugca

SEQ ID NO: 80777 - RNA, 23 nt, Artificial Sequence
  Oligomer
cuuucugauaaugcauuagaagg

SEQ ID NO: 80778 - RNA, 23 nt, Artificial Sequence
  Oligomer
uaauuucugucaaaugcaguaga

SEQ ID NO: 80779 - RNA, 23 nt, Artificial Sequence
  Oligomer
ccugcaucauuugaaaauguccg

SEQ ID NO: 80780 - RNA, 23 nt, Artificial Sequence
  Oligomer
gaagaagcugacucccaucaccu

SEQ ID NO: 80781 - RNA, 23 nt, Artificial Sequence
  Oligomer
aucaagugugugguggugggaga

SEQ ID NO: 80782 - RNA, 23 nt, Artificial Sequence
  Oligomer
aaauuuagcccuaaaaugacaag

SEQ ID NO: 80783 - RNA, 23 nt, Artificial Sequence
  Oligomer
cuguuucucugcaguuuuccuca

SEQ ID NO: 80784 - RNA, 23 nt, Artificial Sequence
  Oligomer
guauuuugacaaaauacgaagug

SEQ ID NO: 80785 - RNA, 23 nt, Artificial Sequence
  Oligomer
guucuguaaacugugcuagugcu

SEQ ID NO: 80786 - RNA, 23 nt, Artificial Sequence
  Oligomer
aacucaccagugaguuagcagca

SEQ ID NO: 80787 - RNA, 23 nt, Artificial Sequence
  Oligomer
acuacacugcauuguugugccga

SEQ ID NO: 80788 - RNA, 23 nt, Artificial Sequence
  Oligomer
uuagcagcacguguucccgacau

SEQ ID NO: 80789 - RNA, 23 nt, Artificial Sequence
  Oligomer
guguucuuaauuugcuuuucccu

SEQ ID NO: 80790 - RNA, 23 nt, Artificial Sequence
  Oligomer
auauaucccuacugucuuugaca

SEQ ID NO: 80791 - RNA, 23 nt, Artificial Sequence
  Oligomer
caauuagcauuauguuuugcaug

SEQ ID NO: 80792 - RNA, 23 nt, Artificial Sequence
  Oligomer
caucuuuaaacugguuguucugu

SEQ ID NO: 80793 - RNA, 23 nt, Artificial Sequence
  Oligomer
guuuucugaccagcuuuugcgga

SEQ ID NO: 80794 - RNA, 23 nt, Artificial Sequence
  Oligomer
gauuucauagcgaguuuucugac

SEQ ID NO: 80795 - RNA, 23 nt, Artificial Sequence
  Oligomer
guuuguucuaaauguaagaguuc

SEQ ID NO: 80796 - RNA, 23 nt, Artificial Sequence
  Oligomer
cugcaucauuugaaaauguccgu

SEQ ID NO: 80797 - RNA, 23 nt, Artificial Sequence
  Oligomer
cuuguucagauuaagaguugcca

SEQ ID NO: 80798 - RNA, 23 nt, Artificial Sequence
  Oligomer
uucucugcaguuuuccucagcuu

SEQ ID NO: 80799 - RNA, 23 nt, Artificial Sequence
  Oligomer
caguuuuccucagcuuugggugg

SEQ ID NO: 80800 - RNA, 23 nt, Artificial Sequence
  Oligomer
cugucuugccagauuaccgacac

SEQ ID NO: 80801 - RNA, 23 nt, Artificial Sequence
  Oligomer
acuuuauucagagcuaauaagug

SEQ ID NO: 80802 - RNA, 23 nt, Artificial Sequence
  Oligomer
cuguaaaauaccuggagugcucg

SEQ ID NO: 80803 - RNA, 23 nt, Artificial Sequence
  Oligomer
guucuuaauuugcuuuucccuug

SEQ ID NO: 80804 - RNA, 23 nt, Artificial Sequence
  Oligomer
aauuauucugccaauguuauggu

SEQ ID NO: 80805 - RNA, 23 nt, Artificial Sequence
  Oligomer
ugucuugccagauuaccgacacu

SEQ ID NO: 80806 - RNA, 23 nt, Artificial Sequence
  Oligomer
cuucugcaguuaggaggugcaga

SEQ ID NO: 80807 - RNA, 23 nt, Artificial Sequence
  Oligomer
cuuugagaagacgguagcuucug

SEQ ID NO: 80808 - RNA, 23 nt, Artificial Sequence
  Oligomer
ucuuaacaucacugucuugccag

SEQ ID NO: 80809 - RNA, 23 nt, Artificial Sequence
  Oligomer
cuuaguuuucuaguaacuaggug

SEQ ID NO: 80810 - RNA, 23 nt, Artificial Sequence
  Oligomer
auuauucugccaauguuauggua

SEQ ID NO: 80811 - RNA, 23 nt, Artificial Sequence
  Oligomer
ugucuuugacaauuauucugcca

SEQ ID NO: 80812 - RNA, 23 nt, Artificial Sequence
  Oligomer
acugucuugccagauuaccgaca

SEQ ID NO: 80813 - RNA, 23 nt, Artificial Sequence
  Oligomer
aucuuuaaacugguuguucuguu

SEQ ID NO: 80814 - RNA, 23 nt, Artificial Sequence
  Oligomer
aacagccucccgaaugaagcguu

SEQ ID NO: 80815 - RNA, 23 nt, Artificial Sequence
  Oligomer
ucuuucugauaaugcauuagaag

SEQ ID NO: 80816 - RNA, 23 nt, Artificial Sequence
  Oligomer
gaaauguuuucuuaagcuuuucc

SEQ ID NO: 80817 - RNA, 23 nt, Artificial Sequence
  Oligomer
acucuaaaagguuaauuucuguc

SEQ ID NO: 80818 - RNA, 23 nt, Artificial Sequence
  Oligomer
uuuucugaccagcuuuugcggag

SEQ ID NO: 80819 - RNA, 23 nt, Artificial Sequence
  Oligomer
uauucagagcuaauaagugcuuu

SEQ ID NO: 80820 - RNA, 23 nt, Artificial Sequence
  Oligomer
gcuguagguaaaacuugccuacu

SEQ ID NO: 80821 - RNA, 23 nt, Artificial Sequence
  Oligomer
ucguauuuugucaaaauacuguc

SEQ ID NO: 80822 - RNA, 23 nt, Artificial Sequence
  Oligomer
cuucguauuuugucaaaauacug

SEQ ID NO: 80823 - RNA, 23 nt, Artificial Sequence
  Oligomer
aggauuuauuaagucauacaugc

SEQ ID NO: 80824 - RNA, 23 nt, Artificial Sequence
  Oligomer
ugguucaaaaaaugguuuuaugg

SEQ ID NO: 80825 - RNA, 23 nt, Artificial Sequence
  Oligomer
uacugcauuugacagaaauuaac

SEQ ID NO: 80826 - RNA, 23 nt, Artificial Sequence
  Oligomer
ugaagggucccacgcuguauucu

SEQ ID NO: 80827 - RNA, 23 nt, Artificial Sequence
  Oligomer
augcaaaacauaaugcuaauugc

SEQ ID NO: 80828 - RNA, 23 nt, Artificial Sequence
  Oligomer
ugcaggacucacaagggaaaagc

SEQ ID NO: 80829 - RNA, 23 nt, Artificial Sequence
  Oligomer
ugacagaaauuaaccuuuuagag

SEQ ID NO: 80830 - RNA, 23 nt, Artificial Sequence
  Oligomer
aagggaaaagcaaauuaagaaca

SEQ ID NO: 80831 - RNA, 23 nt, Artificial Sequence
  Oligomer
agucauacaugcaaaacauaaug

SEQ ID NO: 80832 - RNA, 23 nt, Artificial Sequence
  Oligomer
uacaccuaguuacuagaaaacua

SEQ ID NO: 80833 - RNA, 23 nt, Artificial Sequence
  Oligomer
agaugaauuaaaugcccaauuug

SEQ ID NO: 80834 - RNA, 23 nt, Artificial Sequence
  Oligomer
uucgggaggcuguucugcuuuac

SEQ ID NO: 80835 - RNA, 23 nt, Artificial Sequence
  Oligomer
ucgucagcacuagcacaguuuac

SEQ ID NO: 80836 - RNA, 23 nt, Artificial Sequence
  Oligomer
cguauuuugucaaaauacugucu

SEQ ID NO: 80837 - RNA, 23 nt, Artificial Sequence
  Oligomer
uuacaccuaguuacuagaaaacu

SEQ ID NO: 80838 - RNA, 23 nt, Artificial Sequence
  Oligomer
uuggcagaauaauugucaaagac

SEQ ID NO: 80839 - RNA, 23 nt, Artificial Sequence
  Oligomer
ccgagcacuccagguauuuuaca

SEQ ID NO: 80840 - RNA, 23 nt, Artificial Sequence
  Oligomer
ugagcugcuacgcucacuccauu

SEQ ID NO: 80841 - RNA, 23 nt, Artificial Sequence
  Oligomer
ucagcacuagcacaguuuacaga

SEQ ID NO: 80842 - RNA, 23 nt, Artificial Sequence
  Oligomer
cucggcacaacaaugcaguguag

SEQ ID NO: 80843 - RNA, 23 nt, Artificial Sequence
  Oligomer
accgguuuuccaucuaccauaac

SEQ ID NO: 80844 - RNA, 23 nt, Artificial Sequence
  Oligomer
aaagcugcaacacaugauuuuua

SEQ ID NO: 80845 - RNA, 23 nt, Artificial Sequence
  Oligomer
gucagcacuagcacaguuuacag

SEQ ID NO: 80846 - RNA, 23 nt, Artificial Sequence
  Oligomer
aggaaaacugcagagaaacagga

SEQ ID NO: 80847 - RNA, 23 nt, Artificial Sequence
  Oligomer
aacugcagagaaacaggaaaugg

SEQ ID NO: 80848 - RNA, 23 nt, Artificial Sequence
  Oligomer
acacccacagcuaaacagaauuc

SEQ ID NO: 80849 - RNA, 23 nt, Artificial Sequence
  Oligomer
uccaggaaaugcauugguugugu

SEQ ID NO: 80850 - RNA, 23 nt, Artificial Sequence
  Oligomer
ugcaaaacauaaugcuaauugca

SEQ ID NO: 80851 - RNA, 23 nt, Artificial Sequence
  Oligomer
ccuucuaaugcauuaucagaaag

SEQ ID NO: 80852 - RNA, 23 nt, Artificial Sequence
  Oligomer
ucuacugcauuugacagaaauua

SEQ ID NO: 80853 - RNA, 23 nt, Artificial Sequence
  Oligomer
cggacauuuucaaaugaugcagg

SEQ ID NO: 80854 - RNA, 23 nt, Artificial Sequence
  Oligomer
aggugaugggagucagcuucuuc

SEQ ID NO: 80855 - RNA, 23 nt, Artificial Sequence
  Oligomer
ucucccaccaccacacacuugau

SEQ ID NO: 80856 - RNA, 23 nt, Artificial Sequence
  Oligomer
cuugucauuuuagggcuaaauuu

SEQ ID NO: 80857 - RNA, 23 nt, Artificial Sequence
  Oligomer
ugaggaaaacugcagagaaacag

SEQ ID NO: 80858 - RNA, 23 nt, Artificial Sequence
  Oligomer
cacuucguauuuugucaaaauac

SEQ ID NO: 80859 - RNA, 23 nt, Artificial Sequence
  Oligomer
agcacuagcacaguuuacagaac

SEQ ID NO: 80860 - RNA, 23 nt, Artificial Sequence
  Oligomer
ugcugcuaacucacuggugaguu

SEQ ID NO: 80861 - RNA, 23 nt, Artificial Sequence
  Oligomer
ucggcacaacaaugcaguguagu

SEQ ID NO: 80862 - RNA, 23 nt, Artificial Sequence
  Oligomer
augucgggaacacgugcugcuaa

SEQ ID NO: 80863 - RNA, 23 nt, Artificial Sequence
  Oligomer
agggaaaagcaaauuaagaacac

SEQ ID NO: 80864 - RNA, 23 nt, Artificial Sequence
  Oligomer
ugucaaagacaguagggauauau

SEQ ID NO: 80865 - RNA, 23 nt, Artificial Sequence
  Oligomer
caugcaaaacauaaugcuaauug

SEQ ID NO: 80866 - RNA, 23 nt, Artificial Sequence
  Oligomer
acagaacaaccaguuuaaagaug

SEQ ID NO: 80867 - RNA, 23 nt, Artificial Sequence
  Oligomer
uccgcaaaagcuggucagaaaac

SEQ ID NO: 80868 - RNA, 23 nt, Artificial Sequence
  Oligomer
gucagaaaacucgcuaugaaauc

SEQ ID NO: 80869 - RNA, 23 nt, Artificial Sequence
  Oligomer
gaacucuuacauuuagaacaaac

SEQ ID NO: 80870 - RNA, 23 nt, Artificial Sequence
  Oligomer
acggacauuuucaaaugaugcag

SEQ ID NO: 80871 - RNA, 23 nt, Artificial Sequence
  Oligomer
uggcaacucuuaaucugaacaag

SEQ ID NO: 80872 - RNA, 23 nt, Artificial Sequence
  Oligomer
aagcugaggaaaacugcagagaa

SEQ ID NO: 80873 - RNA, 23 nt, Artificial Sequence
  Oligomer
ccacccaaagcugaggaaaacug

SEQ ID NO: 80874 - RNA, 23 nt, Artificial Sequence
  Oligomer
gugucgguaaucuggcaagacag

SEQ ID NO: 80875 - RNA, 23 nt, Artificial Sequence
  Oligomer
cacuuauuagcucugaauaaagu

SEQ ID NO: 80876 - RNA, 23 nt, Artificial Sequence
  Oligomer
cgagcacuccagguauuuuacag

SEQ ID NO: 80877 - RNA, 23 nt, Artificial Sequence
  Oligomer
caagggaaaagcaaauuaagaac

SEQ ID NO: 80878 - RNA, 23 nt, Artificial Sequence
  Oligomer
accauaacauuggcagaauaauu

SEQ ID NO: 80879 - RNA, 23 nt, Artificial Sequence
  Oligomer
agugucgguaaucuggcaagaca

SEQ ID NO: 80880 - RNA, 23 nt, Artificial Sequence
  Oligomer
ucugcaccuccuaacugcagaag

SEQ ID NO: 80881 - RNA, 23 nt, Artificial Sequence
  Oligomer
cagaagcuaccgucuucucaaag

SEQ ID NO: 80882 - RNA, 23 nt, Artificial Sequence
  Oligomer
cuggcaagacagugauguuaaga

SEQ ID NO: 80883 - RNA, 23 nt, Artificial Sequence
  Oligomer
caccuaguuacuagaaaacuaag

SEQ ID NO: 80884 - RNA, 23 nt, Artificial Sequence
  Oligomer
uaccauaacauuggcagaauaau

SEQ ID NO: 80885 - RNA, 23 nt, Artificial Sequence
  Oligomer
uggcagaauaauugucaaagaca

SEQ ID NO: 80886 - RNA, 23 nt, Artificial Sequence
  Oligomer
ugucgguaaucuggcaagacagu

SEQ ID NO: 80887 - RNA, 23 nt, Artificial Sequence
  Oligomer
aacagaacaaccaguuuaaagau

SEQ ID NO: 80888 - RNA, 23 nt, Artificial Sequence
  Oligomer
aacgcuucauucgggaggcuguu

SEQ ID NO: 80889 - RNA, 23 nt, Artificial Sequence
  Oligomer
cuucuaaugcauuaucagaaaga

SEQ ID NO: 80890 - RNA, 23 nt, Artificial Sequence
  Oligomer
ggaaaagcuuaagaaaacauuuc

SEQ ID NO: 80891 - RNA, 23 nt, Artificial Sequence
  Oligomer
gacagaaauuaaccuuuuagagu

SEQ ID NO: 80892 - RNA, 23 nt, Artificial Sequence
  Oligomer
cuccgcaaaagcuggucagaaaa

SEQ ID NO: 80893 - RNA, 23 nt, Artificial Sequence
  Oligomer
aaagcacuuauuagcucugaaua

SEQ ID NO: 80894 - RNA, 23 nt, Artificial Sequence
  Oligomer
aguaggcaaguuuuaccuacagc

SEQ ID NO: 80895 - RNA, 23 nt, Artificial Sequence
  Oligomer
caauacugacccucuuuaccucg

SEQ ID NO: 80896 - RNA, 23 nt, Artificial Sequence
  Oligomer
agacacgaucgagaaacugaagg

SEQ ID NO: 80897 - RNA, 23 nt, Artificial Sequence
  Oligomer
aagacacgaucgagaaacugaag

SEQ ID NO: 80898 - RNA, 23 nt, Artificial Sequence
  Oligomer
aaagacacgaucgagaaacugaa

SEQ ID NO: 80899 - RNA, 23 nt, Artificial Sequence
  Oligomer
cccgugaagaagaggaagagaaa

SEQ ID NO: 80900 - RNA, 23 nt, Artificial Sequence
  Oligomer
ggauacagcuggacaagaagauu

SEQ ID NO: 80901 - RNA, 23 nt, Artificial Sequence
  Oligomer
gggauacagcuggacaagaagau

SEQ ID NO: 80902 - RNA, 23 nt, Artificial Sequence
  Oligomer
ugggauacagcuggacaagaaga

SEQ ID NO: 80903 - RNA, 23 nt, Artificial Sequence
  Oligomer
augggauacagcuggacaagaag

SEQ ID NO: 80904 - RNA, 23 nt, Artificial Sequence
  Oligomer
uaugggauacagcuggacaagaa

SEQ ID NO: 80905 - RNA, 23 nt, Artificial Sequence
  Oligomer
ccauguuacuuuauucagagcua

SEQ ID NO: 80906 - RNA, 23 nt, Artificial Sequence
  Oligomer
uccauguuacuuuauucagagcu

SEQ ID NO: 80907 - RNA, 23 nt, Artificial Sequence
  Oligomer
uuccauguuacuuuauucagagc

SEQ ID NO: 80908 - RNA, 23 nt, Artificial Sequence
  Oligomer
uuuccauguuacuuuauucagag

SEQ ID NO: 80909 - RNA, 23 nt, Artificial Sequence
  Oligomer
cuuuccauguuacuuuauucaga

SEQ ID NO: 80910 - RNA, 23 nt, Artificial Sequence
  Oligomer
gaaaaugccugcuguuguaaaug

SEQ ID NO: 80911 - RNA, 23 nt, Artificial Sequence
  Oligomer
agaaaaugccugcuguuguaaau

SEQ ID NO: 80912 - RNA, 23 nt, Artificial Sequence
  Oligomer
gagaaaaugccugcuguuguaaa

SEQ ID NO: 80913 - RNA, 23 nt, Artificial Sequence
  Oligomer
caaugcauuuccuggagaauaua

SEQ ID NO: 80914 - RNA, 23 nt, Artificial Sequence
  Oligomer
ccaaugcauuuccuggagaauau

SEQ ID NO: 80915 - RNA, 23 nt, Artificial Sequence
  Oligomer
accaaugcauuuccuggagaaua

SEQ ID NO: 80916 - RNA, 23 nt, Artificial Sequence
  Oligomer
aaccaaugcauuuccuggagaau

SEQ ID NO: 80917 - RNA, 23 nt, Artificial Sequence
  Oligomer
caaccaaugcauuuccuggagaa

SEQ ID NO: 80918 - RNA, 23 nt, Artificial Sequence
  Oligomer
cacggguaaaaacucuaaaaggu

SEQ ID NO: 80919 - RNA, 23 nt, Artificial Sequence
  Oligomer
ucacggguaaaaacucuaaaagg

SEQ ID NO: 80920 - RNA, 23 nt, Artificial Sequence
  Oligomer
gucacggguaaaaacucuaaaag

SEQ ID NO: 80921 - RNA, 23 nt, Artificial Sequence
  Oligomer
ugucacggguaaaaacucuaaaa

SEQ ID NO: 80922 - RNA, 23 nt, Artificial Sequence
  Oligomer
gugucacggguaaaaacucuaaa

SEQ ID NO: 80923 - RNA, 23 nt, Artificial Sequence
  Oligomer
caauguuaugguagauggaaaac

SEQ ID NO: 80924 - RNA, 23 nt, Artificial Sequence
  Oligomer
ccaauguuaugguagauggaaaa

SEQ ID NO: 80925 - RNA, 23 nt, Artificial Sequence
  Oligomer
gccaauguuaugguagauggaaa

SEQ ID NO: 80926 - RNA, 23 nt, Artificial Sequence
  Oligomer
ugccaauguuaugguagauggaa

SEQ ID NO: 80927 - RNA, 23 nt, Artificial Sequence
  Oligomer
cugccaauguuaugguagaugga

SEQ ID NO: 80928 - RNA, 23 nt, Artificial Sequence
  Oligomer
ggacaagaagauuaugacagauu

SEQ ID NO: 80929 - RNA, 23 nt, Artificial Sequence
  Oligomer
uggacaagaagauuaugacagau

SEQ ID NO: 80930 - RNA, 23 nt, Artificial Sequence
  Oligomer
cuggacaagaagauuaugacaga

SEQ ID NO: 80931 - RNA, 23 nt, Artificial Sequence
  Oligomer
gcuggacaagaagauuaugacag

SEQ ID NO: 80932 - RNA, 23 nt, Artificial Sequence
  Oligomer
agcuggacaagaagauuaugaca

SEQ ID NO: 80933 - RNA, 23 nt, Artificial Sequence
  Oligomer
ccuggagaauauaucccuacugu

SEQ ID NO: 80934 - RNA, 23 nt, Artificial Sequence
  Oligomer
uccuggagaauauaucccuacug

SEQ ID NO: 80935 - RNA, 23 nt, Artificial Sequence
  Oligomer
uuccuggagaauauaucccuacu

SEQ ID NO: 80936 - RNA, 23 nt, Artificial Sequence
  Oligomer
uuuccuggagaauauaucccuac

SEQ ID NO: 80937 - RNA, 23 nt, Artificial Sequence
  Oligomer
auuuccuggagaauauaucccua

SEQ ID NO: 80938 - RNA, 23 nt, Artificial Sequence
  Oligomer
uguuaugguagauggaaaaccgg

SEQ ID NO: 80939 - RNA, 23 nt, Artificial Sequence
  Oligomer
auguuaugguagauggaaaaccg

SEQ ID NO: 80940 - RNA, 23 nt, Artificial Sequence
  Oligomer
aauguuaugguagauggaaaacc

SEQ ID NO: 80941 - RNA, 23 nt, Artificial Sequence
  Oligomer
gaaagugucacggguaaaaacuc

SEQ ID NO: 80942 - RNA, 23 nt, Artificial Sequence
  Oligomer
ugaaagugucacggguaaaaacu

SEQ ID NO: 80943 - RNA, 23 nt, Artificial Sequence
  Oligomer
augaaagugucacggguaaaaac

SEQ ID NO: 80944 - RNA, 23 nt, Artificial Sequence
  Oligomer
aaugaaagugucacggguaaaaa

SEQ ID NO: 80945 - RNA, 23 nt, Artificial Sequence
  Oligomer
gaaugaaagugucacggguaaaa

SEQ ID NO: 80946 - RNA, 23 nt, Artificial Sequence
  Oligomer
acaccgagcacugaacuuugcaa

SEQ ID NO: 80947 - RNA, 23 nt, Artificial Sequence
  Oligomer
acaagaagauuaugacagauuac

SEQ ID NO: 80948 - RNA, 23 nt, Artificial Sequence
  Oligomer
gacaagaagauuaugacagauua

SEQ ID NO: 80949 - RNA, 23 nt, Artificial Sequence
  Oligomer
acggguaaaaacucuaaaagguu

SEQ ID NO: 80950 - RNA, 23 nt, Artificial Sequence
  Oligomer
ccauucuuguucagauuaagagu

SEQ ID NO: 80951 - RNA, 23 nt, Artificial Sequence
  Oligomer
cccauucuuguucagauuaagag

SEQ ID NO: 80952 - RNA, 23 nt, Artificial Sequence
  Oligomer
ccccauucuuguucagauuaaga

SEQ ID NO: 80953 - RNA, 23 nt, Artificial Sequence
  Oligomer
cccccauucuuguucagauuaag

SEQ ID NO: 80954 - RNA, 23 nt, Artificial Sequence
  Oligomer
ccccccauucuuguucagauuaa

SEQ ID NO: 80955 - RNA, 23 nt, Artificial Sequence
  Oligomer
caaagacaguauuuugacaaaau

SEQ ID NO: 80956 - RNA, 23 nt, Artificial Sequence
  Oligomer
acaaagacaguauuuugacaaaa

SEQ ID NO: 80957 - RNA, 23 nt, Artificial Sequence
  Oligomer
gacaaagacaguauuuugacaaa

SEQ ID NO: 80958 - RNA, 23 nt, Artificial Sequence
  Oligomer
ggacaaagacaguauuuugacaa

SEQ ID NO: 80959 - RNA, 23 nt, Artificial Sequence
  Oligomer
aggacaaagacaguauuuugaca

SEQ ID NO: 80960 - RNA, 23 nt, Artificial Sequence
  Oligomer
gagaacaccgagcacugaacuuu

SEQ ID NO: 80961 - RNA, 23 nt, Artificial Sequence
  Oligomer
cgagaacaccgagcacugaacuu

SEQ ID NO: 80962 - RNA, 23 nt, Artificial Sequence
  Oligomer
ccgagaacaccgagcacugaacu

SEQ ID NO: 80963 - RNA, 23 nt, Artificial Sequence
  Oligomer
gccgagaacaccgagcacugaac

SEQ ID NO: 80964 - RNA, 23 nt, Artificial Sequence
  Oligomer
ugccgagaacaccgagcacugaa

SEQ ID NO: 80965 - RNA, 23 nt, Artificial Sequence
  Oligomer
aacuaugaaccuucuuaacauca

SEQ ID NO: 80966 - RNA, 23 nt, Artificial Sequence
  Oligomer
aaacuaugaaccuucuuaacauc

SEQ ID NO: 80967 - RNA, 23 nt, Artificial Sequence
  Oligomer
uaaacuaugaaccuucuuaacau

SEQ ID NO: 80968 - RNA, 23 nt, Artificial Sequence
  Oligomer
ugaucaaaggacaaagacaguau

SEQ ID NO: 80969 - RNA, 23 nt, Artificial Sequence
  Oligomer
gugaucaaaggacaaagacagua

SEQ ID NO: 80970 - RNA, 23 nt, Artificial Sequence
  Oligomer
ugugaucaaaggacaaagacagu

SEQ ID NO: 80971 - RNA, 23 nt, Artificial Sequence
  Oligomer
gugugaucaaaggacaaagacag

SEQ ID NO: 80972 - RNA, 23 nt, Artificial Sequence
  Oligomer
aauaccuucugaacuacacugca

SEQ ID NO: 80973 - RNA, 23 nt, Artificial Sequence
  Oligomer
gauaaagacacgaucgagaaacu

SEQ ID NO: 80974 - RNA, 23 nt, Artificial Sequence
  Oligomer
ugauaaagacacgaucgagaaac

SEQ ID NO: 80975 - RNA, 23 nt, Artificial Sequence
  Oligomer
augauaaagacacgaucgagaaa

SEQ ID NO: 80976 - RNA, 23 nt, Artificial Sequence
  Oligomer
gaugauaaagacacgaucgagaa

SEQ ID NO: 80977 - RNA, 23 nt, Artificial Sequence
  Oligomer
ggaugauaaagacacgaucgaga

SEQ ID NO: 80978 - RNA, 23 nt, Artificial Sequence
  Oligomer
gcauuuccuggagaauauauccc

SEQ ID NO: 80979 - RNA, 23 nt, Artificial Sequence
  Oligomer
ugcauuuccuggagaauauaucc

SEQ ID NO: 80980 - RNA, 23 nt, Artificial Sequence
  Oligomer
augcauuuccuggagaauauauc

SEQ ID NO: 80981 - RNA, 23 nt, Artificial Sequence
  Oligomer
aaugcauuuccuggagaauauau

SEQ ID NO: 80982 - RNA, 23 nt, Artificial Sequence
  Oligomer
cauuguugugccgagaacaccga

SEQ ID NO: 80983 - RNA, 23 nt, Artificial Sequence
  Oligomer
aguucucagaugcguaaagcaga

SEQ ID NO: 80984 - RNA, 23 nt, Artificial Sequence
  Oligomer
gugcaaagugguauccugaggug

SEQ ID NO: 80985 - RNA, 23 nt, Artificial Sequence
  Oligomer
cgugcaaagugguauccugaggu

SEQ ID NO: 80986 - RNA, 23 nt, Artificial Sequence
  Oligomer
ccgugcaaagugguauccugagg

SEQ ID NO: 80987 - RNA, 23 nt, Artificial Sequence
  Oligomer
uccgugcaaagugguauccugag

SEQ ID NO: 80988 - RNA, 23 nt, Artificial Sequence
  Oligomer
guccgugcaaagugguauccuga

SEQ ID NO: 80989 - RNA, 23 nt, Artificial Sequence
  Oligomer
cauguguugcagcuuuauaguuu

SEQ ID NO: 80990 - RNA, 23 nt, Artificial Sequence
  Oligomer
aauacgaaguggagauuuacacu

SEQ ID NO: 80991 - RNA, 23 nt, Artificial Sequence
  Oligomer
aaauacgaaguggagauuuacac

SEQ ID NO: 80992 - RNA, 23 nt, Artificial Sequence
  Oligomer
aaaauacgaaguggagauuuaca

SEQ ID NO: 80993 - RNA, 23 nt, Artificial Sequence
  Oligomer
caaaauacgaaguggagauuuac

SEQ ID NO: 80994 - RNA, 23 nt, Artificial Sequence
  Oligomer
acaaaauacgaaguggagauuua

SEQ ID NO: 80995 - RNA, 23 nt, Artificial Sequence
  Oligomer
gucuuugugauuucauagcgagu

SEQ ID NO: 80996 - RNA, 23 nt, Artificial Sequence
  Oligomer
agucuuugugauuucauagcgag

SEQ ID NO: 80997 - RNA, 23 nt, Artificial Sequence
  Oligomer
gcuguaaaauaccuggagugcuc

SEQ ID NO: 80998 - RNA, 23 nt, Artificial Sequence
  Oligomer
gguaaaaacucuaaaagguuaau

SEQ ID NO: 80999 - RNA, 23 nt, Artificial Sequence
  Oligomer
ggguaaaaacucuaaaagguuaa

SEQ ID NO: 81000 - RNA, 23 nt, Artificial Sequence
  Oligomer
cggguaaaaacucuaaaagguua

SEQ ID NO: 81001 - RNA, 23 nt, Artificial Sequence
  Oligomer
uaaagacacgaucgagaaacuga

SEQ ID NO: 81002 - RNA, 23 nt, Artificial Sequence
  Oligomer
auaaagacacgaucgagaaacug

SEQ ID NO: 81003 - RNA, 23 nt, Artificial Sequence
  Oligomer
gcuaauaagugcuuuccuuaguu

SEQ ID NO: 81004 - RNA, 23 nt, Artificial Sequence
  Oligomer
agcuaauaagugcuuuccuuagu

SEQ ID NO: 81005 - RNA, 23 nt, Artificial Sequence
  Oligomer
gagcuaauaagugcuuuccuuag

SEQ ID NO: 81006 - RNA, 23 nt, Artificial Sequence
  Oligomer
agagcuaauaagugcuuuccuua

SEQ ID NO: 81007 - RNA, 23 nt, Artificial Sequence
  Oligomer
cagagcuaauaagugcuuuccuu

SEQ ID NO: 81008 - RNA, 23 nt, Artificial Sequence
  Oligomer
ugcuuuccauguuacuuuauuca

SEQ ID NO: 81009 - RNA, 23 nt, Artificial Sequence
  Oligomer
gugcuuuccauguuacuuuauuc

SEQ ID NO: 81010 - RNA, 23 nt, Artificial Sequence
  Oligomer
agugcuuuccauguuacuuuauu

SEQ ID NO: 81011 - RNA, 23 nt, Artificial Sequence
  Oligomer
aagugcuuuccauguuacuuuau

SEQ ID NO: 81012 - RNA, 23 nt, Artificial Sequence
  Oligomer
aaagugcuuuccauguuacuuua

SEQ ID NO: 81013 - RNA, 23 nt, Artificial Sequence
  Oligomer
agugucacggguaaaaacucuaa

SEQ ID NO: 81014 - RNA, 23 nt, Artificial Sequence
  Oligomer
ggaaugaaagugucacggguaaa

SEQ ID NO: 81015 - RNA, 23 nt, Artificial Sequence
  Oligomer
aggaaugaaagugucacggguaa

SEQ ID NO: 81016 - RNA, 23 nt, Artificial Sequence
  Oligomer
aaggaaugaaagugucacgggua

SEQ ID NO: 81017 - RNA, 23 nt, Artificial Sequence
  Oligomer
aggccucaagacaguguuugacg

SEQ ID NO: 81018 - RNA, 23 nt, Artificial Sequence
  Oligomer
gaggccucaagacaguguuugac

SEQ ID NO: 81019 - RNA, 23 nt, Artificial Sequence
  Oligomer
cgaggccucaagacaguguuuga

SEQ ID NO: 81020 - RNA, 23 nt, Artificial Sequence
  Oligomer
uguccgugcaaagugguauccug

SEQ ID NO: 81021 - RNA, 23 nt, Artificial Sequence
  Oligomer
cagcuggacaagaagauuaugac

SEQ ID NO: 81022 - RNA, 23 nt, Artificial Sequence
  Oligomer
acagcuggacaagaagauuauga

SEQ ID NO: 81023 - RNA, 23 nt, Artificial Sequence
  Oligomer
uacagcuggacaagaagauuaug

SEQ ID NO: 81024 - RNA, 23 nt, Artificial Sequence
  Oligomer
auacagcuggacaagaagauuau

SEQ ID NO: 81025 - RNA, 23 nt, Artificial Sequence
  Oligomer
uaguaaaagugcuuuccauguua

SEQ ID NO: 81026 - RNA, 23 nt, Artificial Sequence
  Oligomer
uuaguaaaagugcuuuccauguu

SEQ ID NO: 81027 - RNA, 23 nt, Artificial Sequence
  Oligomer
auuaguaaaagugcuuuccaugu

SEQ ID NO: 81028 - RNA, 23 nt, Artificial Sequence
  Oligomer
gauuaguaaaagugcuuuccaug

SEQ ID NO: 81029 - RNA, 23 nt, Artificial Sequence
  Oligomer
aaagugucacggguaaaaacucu

SEQ ID NO: 81030 - RNA, 23 nt, Artificial Sequence
  Oligomer
gaacagccucccgaaugaagcgu

SEQ ID NO: 81031 - RNA, 23 nt, Artificial Sequence
  Oligomer
agaacagccucccgaaugaagcg

SEQ ID NO: 81032 - RNA, 23 nt, Artificial Sequence
  Oligomer
cagaacagccucccgaaugaagc

SEQ ID NO: 81033 - RNA, 23 nt, Artificial Sequence
  Oligomer
gcagaacagccucccgaaugaag

SEQ ID NO: 81034 - RNA, 23 nt, Artificial Sequence
  Oligomer
agcagaacagccucccgaaugaa

SEQ ID NO: 81035 - RNA, 23 nt, Artificial Sequence
  Oligomer
aaauguaagaguucagacucaca

SEQ ID NO: 81036 - RNA, 23 nt, Artificial Sequence
  Oligomer
ucccgugaagaagaggaagagaa

SEQ ID NO: 81037 - RNA, 23 nt, Artificial Sequence
  Oligomer
cucccgugaagaagaggaagaga

SEQ ID NO: 81038 - RNA, 23 nt, Artificial Sequence
  Oligomer
gaaucugggcuuaugggauacag

SEQ ID NO: 81039 - RNA, 23 nt, Artificial Sequence
  Oligomer
ugaaucugggcuuaugggauaca

SEQ ID NO: 81040 - RNA, 23 nt, Artificial Sequence
  Oligomer
gugaaucugggcuuaugggauac

SEQ ID NO: 81041 - RNA, 23 nt, Artificial Sequence
  Oligomer
ggugaaucugggcuuaugggaua

SEQ ID NO: 81042 - RNA, 23 nt, Artificial Sequence
  Oligomer
cggugaaucugggcuuaugggau

SEQ ID NO: 81043 - RNA, 23 nt, Artificial Sequence
  Oligomer
guuacuuuauucagagcuaauaa

SEQ ID NO: 81044 - RNA, 23 nt, Artificial Sequence
  Oligomer
uguuacuuuauucagagcuaaua

SEQ ID NO: 81045 - RNA, 23 nt, Artificial Sequence
  Oligomer
auguuacuuuauucagagcuaau

SEQ ID NO: 81046 - RNA, 23 nt, Artificial Sequence
  Oligomer
cauguuacuuuauucagagcuaa

SEQ ID NO: 81047 - RNA, 23 nt, Artificial Sequence
  Oligomer
aaaagugcuuuccauguuacuuu

SEQ ID NO: 81048 - RNA, 23 nt, Artificial Sequence
  Oligomer
uaaaagugcuuuccauguuacuu

SEQ ID NO: 81049 - RNA, 23 nt, Artificial Sequence
  Oligomer
guaaaagugcuuuccauguuacu

SEQ ID NO: 81050 - RNA, 23 nt, Artificial Sequence
  Oligomer
aguaaaagugcuuuccauguuac

SEQ ID NO: 81051 - RNA, 23 nt, Artificial Sequence
  Oligomer
aaggacaaagacaguauuuugac

SEQ ID NO: 81052 - RNA, 23 nt, Artificial Sequence
  Oligomer
aaaggacaaagacaguauuuuga

SEQ ID NO: 81053 - RNA, 23 nt, Artificial Sequence
  Oligomer
caaaggacaaagacaguauuuug

SEQ ID NO: 81054 - RNA, 23 nt, Artificial Sequence
  Oligomer
ucaaaggacaaagacaguauuuu

SEQ ID NO: 81055 - RNA, 23 nt, Artificial Sequence
  Oligomer
aucaaaggacaaagacaguauuu

SEQ ID NO: 81056 - RNA, 23 nt, Artificial Sequence
  Oligomer
gaucaaaggacaaagacaguauu

SEQ ID NO: 81057 - RNA, 23 nt, Artificial Sequence
  Oligomer
ccaacuuuuuguuacagauuaau

SEQ ID NO: 81058 - RNA, 23 nt, Artificial Sequence
  Oligomer
gccaacuuuuuguuacagauuaa

SEQ ID NO: 81059 - RNA, 23 nt, Artificial Sequence
  Oligomer
ugccaacuuuuuguuacagauua

SEQ ID NO: 81060 - RNA, 23 nt, Artificial Sequence
  Oligomer
augccaacuuuuuguuacagauu

SEQ ID NO: 81061 - RNA, 23 nt, Artificial Sequence
  Oligomer
aaugccaacuuuuuguuacagau

SEQ ID NO: 81062 - RNA, 23 nt, Artificial Sequence
  Oligomer
cacucaaugccaacuuuuuguua

SEQ ID NO: 81063 - RNA, 23 nt, Artificial Sequence
  Oligomer
gcacucaaugccaacuuuuuguu

SEQ ID NO: 81064 - RNA, 23 nt, Artificial Sequence
  Oligomer
cuuaguaagugcuuuucuuauag

SEQ ID NO: 81065 - RNA, 23 nt, Artificial Sequence
  Oligomer
acuuaguaagugcuuuucuuaua

SEQ ID NO: 81066 - RNA, 23 nt, Artificial Sequence
  Oligomer
aacuuaguaagugcuuuucuuau

SEQ ID NO: 81067 - RNA, 23 nt, Artificial Sequence
  Oligomer
uaacuuaguaagugcuuuucuua

SEQ ID NO: 81068 - RNA, 23 nt, Artificial Sequence
  Oligomer
cuaacuuaguaagugcuuuucuu

SEQ ID NO: 81069 - RNA, 23 nt, Artificial Sequence
  Oligomer
aguggagauuuacacuacauugu

SEQ ID NO: 81070 - RNA, 23 nt, Artificial Sequence
  Oligomer
aaguggagauuuacacuacauug

SEQ ID NO: 81071 - RNA, 23 nt, Artificial Sequence
  Oligomer
gaaguggagauuuacacuacauu

SEQ ID NO: 81072 - RNA, 23 nt, Artificial Sequence
  Oligomer
cgaaguggagauuuacacuacau

SEQ ID NO: 81073 - RNA, 23 nt, Artificial Sequence
  Oligomer
acgaaguggagauuuacacuaca

SEQ ID NO: 81074 - RNA, 23 nt, Artificial Sequence
  Oligomer
ccggugaaucugggcuuauggga

SEQ ID NO: 81075 - RNA, 23 nt, Artificial Sequence
  Oligomer
accggugaaucugggcuuauggg

SEQ ID NO: 81076 - RNA, 23 nt, Artificial Sequence
  Oligomer
aaccggugaaucugggcuuaugg

SEQ ID NO: 81077 - RNA, 23 nt, Artificial Sequence
  Oligomer
aaaccggugaaucugggcuuaug

SEQ ID NO: 81078 - RNA, 23 nt, Artificial Sequence
  Oligomer
caguuaggaggugcagacacuug

SEQ ID NO: 81079 - RNA, 23 nt, Artificial Sequence
  Oligomer
gcaguuaggaggugcagacacuu

SEQ ID NO: 81080 - RNA, 23 nt, Artificial Sequence
  Oligomer
ugcaguuaggaggugcagacacu

SEQ ID NO: 81081 - RNA, 23 nt, Artificial Sequence
  Oligomer
cugcaguuaggaggugcagacac

SEQ ID NO: 81082 - RNA, 23 nt, Artificial Sequence
  Oligomer
ucugcaguuaggaggugcagaca

SEQ ID NO: 81083 - RNA, 23 nt, Artificial Sequence
  Oligomer
caagaagauuaugacagauuacg

SEQ ID NO: 81084 - RNA, 23 nt, Artificial Sequence
  Oligomer
gacaaaauacgaaguggagauuu

SEQ ID NO: 81085 - RNA, 23 nt, Artificial Sequence
  Oligomer
ugacaaaauacgaaguggagauu

SEQ ID NO: 81086 - RNA, 23 nt, Artificial Sequence
  Oligomer
uugacaaaauacgaaguggagau

SEQ ID NO: 81087 - RNA, 23 nt, Artificial Sequence
  Oligomer
uuugacaaaauacgaaguggaga

SEQ ID NO: 81088 - RNA, 23 nt, Artificial Sequence
  Oligomer
uuuugacaaaauacgaaguggag

SEQ ID NO: 81089 - RNA, 23 nt, Artificial Sequence
  Oligomer
auuuugacaaaauacgaagugga

SEQ ID NO: 81090 - RNA, 23 nt, Artificial Sequence
  Oligomer
agaaacugaaggagaagaagcug

SEQ ID NO: 81091 - RNA, 23 nt, Artificial Sequence
  Oligomer
gagaaacugaaggagaagaagcu

SEQ ID NO: 81092 - RNA, 23 nt, Artificial Sequence
  Oligomer
caacacucccaucauccuagugg

SEQ ID NO: 81093 - RNA, 23 nt, Artificial Sequence
  Oligomer
ccaacacucccaucauccuagug

SEQ ID NO: 81094 - RNA, 23 nt, Artificial Sequence
  Oligomer
cccaacacucccaucauccuagu

SEQ ID NO: 81095 - RNA, 23 nt, Artificial Sequence
  Oligomer
ucccaacacucccaucauccuag

SEQ ID NO: 81096 - RNA, 23 nt, Artificial Sequence
  Oligomer
gucccaacacucccaucauccua

SEQ ID NO: 81097 - RNA, 23 nt, Artificial Sequence
  Oligomer
cuuaugggauacagcuggacaag

SEQ ID NO: 81098 - RNA, 23 nt, Artificial Sequence
  Oligomer
gcuuaugggauacagcuggacaa

SEQ ID NO: 81099 - RNA, 23 nt, Artificial Sequence
  Oligomer
ggcuuaugggauacagcuggaca

SEQ ID NO: 81100 - RNA, 23 nt, Artificial Sequence
  Oligomer
gggcuuaugggauacagcuggac

SEQ ID NO: 81101 - RNA, 23 nt, Artificial Sequence
  Oligomer
ugggcuuaugggauacagcugga

SEQ ID NO: 81102 - RNA, 23 nt, Artificial Sequence
  Oligomer
ucugccaauguuaugguagaugg

SEQ ID NO: 81103 - RNA, 23 nt, Artificial Sequence
  Oligomer
uucugccaauguuaugguagaug

SEQ ID NO: 81104 - RNA, 23 nt, Artificial Sequence
  Oligomer
auucugccaauguuaugguagau

SEQ ID NO: 81105 - RNA, 23 nt, Artificial Sequence
  Oligomer
uauucugccaauguuaugguaga

SEQ ID NO: 81106 - RNA, 23 nt, Artificial Sequence
  Oligomer
caauuauucugccaauguuaugg

SEQ ID NO: 81107 - RNA, 23 nt, Artificial Sequence
  Oligomer
acaauuauucugccaauguuaug

SEQ ID NO: 81108 - RNA, 23 nt, Artificial Sequence
  Oligomer
gacaauuauucugccaauguuau

SEQ ID NO: 81109 - RNA, 23 nt, Artificial Sequence
  Oligomer
ugacaauuauucugccaauguua

SEQ ID NO: 81110 - RNA, 23 nt, Artificial Sequence
  Oligomer
uugacaauuauucugccaauguu

SEQ ID NO: 81111 - RNA, 23 nt, Artificial Sequence
  Oligomer
ugaucaguuacacaaccaaugca

SEQ ID NO: 81112 - RNA, 23 nt, Artificial Sequence
  Oligomer
cugaucaguuacacaaccaaugc

SEQ ID NO: 81113 - RNA, 23 nt, Artificial Sequence
  Oligomer
acugaucaguuacacaaccaaug

SEQ ID NO: 81114 - RNA, 23 nt, Artificial Sequence
  Oligomer
uacugaucaguuacacaaccaau

SEQ ID NO: 81115 - RNA, 23 nt, Artificial Sequence
  Oligomer
ccucccgugaagaagaggaagag

SEQ ID NO: 81116 - RNA, 23 nt, Artificial Sequence
  Oligomer
gccucccgugaagaagaggaaga

SEQ ID NO: 81117 - RNA, 23 nt, Artificial Sequence
  Oligomer
uuaugggauacagcuggacaaga

SEQ ID NO: 81118 - RNA, 23 nt, Artificial Sequence
  Oligomer
guugcagcuuuauaguuuuuaaa

SEQ ID NO: 81119 - RNA, 23 nt, Artificial Sequence
  Oligomer
uguugcagcuuuauaguuuuuaa

SEQ ID NO: 81120 - RNA, 23 nt, Artificial Sequence
  Oligomer
guguugcagcuuuauaguuuuua

SEQ ID NO: 81121 - RNA, 23 nt, Artificial Sequence
  Oligomer
uguguugcagcuuuauaguuuuu

SEQ ID NO: 81122 - RNA, 23 nt, Artificial Sequence
  Oligomer
auguguugcagcuuuauaguuuu

SEQ ID NO: 81123 - RNA, 23 nt, Artificial Sequence
  Oligomer
aagcagaacagccucccgaauga

SEQ ID NO: 81124 - RNA, 23 nt, Artificial Sequence
  Oligomer
gacgguagcuucugcaguuagga

SEQ ID NO: 81125 - RNA, 23 nt, Artificial Sequence
  Oligomer
agacgguagcuucugcaguuagg

SEQ ID NO: 81126 - RNA, 23 nt, Artificial Sequence
  Oligomer
aagacgguagcuucugcaguuag

SEQ ID NO: 81127 - RNA, 23 nt, Artificial Sequence
  Oligomer
gaagacgguagcuucugcaguua

SEQ ID NO: 81128 - RNA, 23 nt, Artificial Sequence
  Oligomer
agaagacgguagcuucugcaguu

SEQ ID NO: 81129 - RNA, 23 nt, Artificial Sequence
  Oligomer
gaagaggaagagaaaaugccugc

SEQ ID NO: 81130 - RNA, 23 nt, Artificial Sequence
  Oligomer
cuacugucuuugacaauuauucu

SEQ ID NO: 81131 - RNA, 23 nt, Artificial Sequence
  Oligomer
ccuacugucuuugacaauuauuc

SEQ ID NO: 81132 - RNA, 23 nt, Artificial Sequence
  Oligomer
cccuacugucuuugacaauuauu

SEQ ID NO: 81133 - RNA, 23 nt, Artificial Sequence
  Oligomer
ucccuacugucuuugacaauuau

SEQ ID NO: 81134 - RNA, 23 nt, Artificial Sequence
  Oligomer
aucccuacugucuuugacaauua

SEQ ID NO: 81135 - RNA, 23 nt, Artificial Sequence
  Oligomer
aagugucacggguaaaaacucua

SEQ ID NO: 81136 - RNA, 23 nt, Artificial Sequence
  Oligomer
guggagauuuacacuacauugua

SEQ ID NO: 81137 - RNA, 23 nt, Artificial Sequence
  Oligomer
ucuuagggaugauaaagacacga

SEQ ID NO: 81138 - RNA, 23 nt, Artificial Sequence
  Oligomer
aucuuagggaugauaaagacacg

SEQ ID NO: 81139 - RNA, 23 nt, Artificial Sequence
  Oligomer
gaucuuagggaugauaaagacac

SEQ ID NO: 81140 - RNA, 23 nt, Artificial Sequence
  Oligomer
uugaaaauguccgugcaaagugg

SEQ ID NO: 81141 - RNA, 23 nt, Artificial Sequence
  Oligomer
uuugaaaauguccgugcaaagug

SEQ ID NO: 81142 - RNA, 23 nt, Artificial Sequence
  Oligomer
auuugaaaauguccgugcaaagu

SEQ ID NO: 81143 - RNA, 23 nt, Artificial Sequence
  Oligomer
cauuugaaaauguccgugcaaag

SEQ ID NO: 81144 - RNA, 23 nt, Artificial Sequence
  Oligomer
ucauuugaaaauguccgugcaaa

SEQ ID NO: 81145 - RNA, 23 nt, Artificial Sequence
  Oligomer
acaguugcagaauuguggagugu

SEQ ID NO: 81146 - RNA, 23 nt, Artificial Sequence
  Oligomer
gacaguugcagaauuguggagug

SEQ ID NO: 81147 - RNA, 23 nt, Artificial Sequence
  Oligomer
ugacaguugcagaauuguggagu

SEQ ID NO: 81148 - RNA, 23 nt, Artificial Sequence
  Oligomer
uugacaguugcagaauuguggag

SEQ ID NO: 81149 - RNA, 23 nt, Artificial Sequence
  Oligomer
auugacaguugcagaauugugga

SEQ ID NO: 81150 - RNA, 23 nt, Artificial Sequence
  Oligomer
agaagguuuuuuugucgauuagu

SEQ ID NO: 81151 - RNA, 23 nt, Artificial Sequence
  Oligomer
uagaagguuuuuuugucgauuag

SEQ ID NO: 81152 - RNA, 23 nt, Artificial Sequence
  Oligomer
uuagaagguuuuuuugucgauua

SEQ ID NO: 81153 - RNA, 23 nt, Artificial Sequence
  Oligomer
auuagaagguuuuuuugucgauu

SEQ ID NO: 81154 - RNA, 23 nt, Artificial Sequence
  Oligomer
cauuagaagguuuuuuugucgau

SEQ ID NO: 81155 - RNA, 23 nt, Artificial Sequence
  Oligomer
ucuguuagucgcuaacuuaguaa

SEQ ID NO: 81156 - RNA, 23 nt, Artificial Sequence
  Oligomer
uucuguuagucgcuaacuuagua

SEQ ID NO: 81157 - RNA, 23 nt, Artificial Sequence
  Oligomer
guucuguuagucgcuaacuuagu

SEQ ID NO: 81158 - RNA, 23 nt, Artificial Sequence
  Oligomer
uguucuguuagucgcuaacuuag

SEQ ID NO: 81159 - RNA, 23 nt, Artificial Sequence
  Oligomer
uuguucuguuagucgcuaacuua

SEQ ID NO: 81160 - RNA, 23 nt, Artificial Sequence
  Oligomer
caaugccaacuuuuuguuacaga

SEQ ID NO: 81161 - RNA, 23 nt, Artificial Sequence
  Oligomer
cgccucccgugaagaagaggaag

SEQ ID NO: 81162 - RNA, 23 nt, Artificial Sequence
  Oligomer
ccgccucccgugaagaagaggaa

SEQ ID NO: 81163 - RNA, 23 nt, Artificial Sequence
  Oligomer
aaucugggcuuaugggauacagc

SEQ ID NO: 81164 - RNA, 23 nt, Artificial Sequence
  Oligomer
uuugacaauuauucugccaaugu

SEQ ID NO: 81165 - RNA, 23 nt, Artificial Sequence
  Oligomer
cuuugacaauuauucugccaaug

SEQ ID NO: 81166 - RNA, 23 nt, Artificial Sequence
  Oligomer
ucuuugacaauuauucugccaau

SEQ ID NO: 81167 - RNA, 23 nt, Artificial Sequence
  Oligomer
gguuguucuguuagucgcuaacu

SEQ ID NO: 81168 - RNA, 23 nt, Artificial Sequence
  Oligomer
ugguuguucuguuagucgcuaac

SEQ ID NO: 81169 - RNA, 23 nt, Artificial Sequence
  Oligomer
cugguuguucuguuagucgcuaa

SEQ ID NO: 81170 - RNA, 23 nt, Artificial Sequence
  Oligomer
acugguuguucuguuagucgcua

SEQ ID NO: 81171 - RNA, 23 nt, Artificial Sequence
  Oligomer
aacugguuguucuguuagucgcu

SEQ ID NO: 81172 - RNA, 23 nt, Artificial Sequence
  Oligomer
ugucccaacacucccaucauccu

SEQ ID NO: 81173 - RNA, 23 nt, Artificial Sequence
  Oligomer
cugucccaacacucccaucaucc

SEQ ID NO: 81174 - RNA, 23 nt, Artificial Sequence
  Oligomer
acugucccaacacucccaucauc

SEQ ID NO: 81175 - RNA, 23 nt, Artificial Sequence
  Oligomer
cacugucccaacacucccaucau

SEQ ID NO: 81176 - RNA, 23 nt, Artificial Sequence
  Oligomer
ugaaaauguccgugcaaaguggu

SEQ ID NO: 81177 - RNA, 23 nt, Artificial Sequence
  Oligomer
cuugugaguccugcaucauuuga

SEQ ID NO: 81178 - RNA, 23 nt, Artificial Sequence
  Oligomer
gaucaguuacacaaccaaugcau

SEQ ID NO: 81179 - RNA, 23 nt, Artificial Sequence
  Oligomer
ggagauuuacacuacauuguaca

SEQ ID NO: 81180 - RNA, 23 nt, Artificial Sequence
  Oligomer
uggagauuuacacuacauuguac

SEQ ID NO: 81181 - RNA, 23 nt, Artificial Sequence
  Oligomer
aagaagcugacucccaucaccua

SEQ ID NO: 81182 - RNA, 23 nt, Artificial Sequence
  Oligomer
cuaaauguaagaguucagacuca

SEQ ID NO: 81183 - RNA, 23 nt, Artificial Sequence
  Oligomer
ucuaaauguaagaguucagacuc

SEQ ID NO: 81184 - RNA, 23 nt, Artificial Sequence
  Oligomer
uucuaaauguaagaguucagacu

SEQ ID NO: 81185 - RNA, 23 nt, Artificial Sequence
  Oligomer
guucuaaauguaagaguucagac

SEQ ID NO: 81186 - RNA, 23 nt, Artificial Sequence
  Oligomer
uguucuaaauguaagaguucaga

SEQ ID NO: 81187 - RNA, 23 nt, Artificial Sequence
  Oligomer
gaaggagaagaagcugacuccca

SEQ ID NO: 81188 - RNA, 23 nt, Artificial Sequence
  Oligomer
aucauuugaaaauguccgugcaa

SEQ ID NO: 81189 - RNA, 23 nt, Artificial Sequence
  Oligomer
caucauuugaaaauguccgugca

SEQ ID NO: 81190 - RNA, 23 nt, Artificial Sequence
  Oligomer
aaaaccggugaaucugggcuuau

SEQ ID NO: 81191 - RNA, 23 nt, Artificial Sequence
  Oligomer
gaaaaccggugaaucugggcuua

SEQ ID NO: 81192 - RNA, 23 nt, Artificial Sequence
  Oligomer
guuagucgcuaacuuaguaagug

SEQ ID NO: 81193 - RNA, 23 nt, Artificial Sequence
  Oligomer
uguuagucgcuaacuuaguaagu

SEQ ID NO: 81194 - RNA, 23 nt, Artificial Sequence
  Oligomer
cuguuagucgcuaacuuaguaag

SEQ ID NO: 81195 - RNA, 23 nt, Artificial Sequence
  Oligomer
aagaaagguugguauuaucagga

SEQ ID NO: 81196 - RNA, 23 nt, Artificial Sequence
  Oligomer
aaagaaagguugguauuaucagg

SEQ ID NO: 81197 - RNA, 23 nt, Artificial Sequence
  Oligomer
uacgaaguggagauuuacacuac

SEQ ID NO: 81198 - RNA, 23 nt, Artificial Sequence
  Oligomer
auacgaaguggagauuuacacua

SEQ ID NO: 81199 - RNA, 23 nt, Artificial Sequence
  Oligomer
gauacagcuggacaagaagauua

SEQ ID NO: 81200 - RNA, 23 nt, Artificial Sequence
  Oligomer
guuuugcauguaugacuuaauaa

SEQ ID NO: 81201 - RNA, 23 nt, Artificial Sequence
  Oligomer
aauugacaguugcagaauugugg

SEQ ID NO: 81202 - RNA, 23 nt, Artificial Sequence
  Oligomer
aaauugacaguugcagaauugug

SEQ ID NO: 81203 - RNA, 23 nt, Artificial Sequence
  Oligomer
gucacuugaccaauacugacccu

SEQ ID NO: 81204 - RNA, 23 nt, Artificial Sequence
  Oligomer
ugucacuugaccaauacugaccc

SEQ ID NO: 81205 - RNA, 23 nt, Artificial Sequence
  Oligomer
cugucacuugaccaauacugacc

SEQ ID NO: 81206 - RNA, 23 nt, Artificial Sequence
  Oligomer
gaagguuuuuuugucgauuagua

SEQ ID NO: 81207 - RNA, 23 nt, Artificial Sequence
  Oligomer
guuguucuguuagucgcuaacuu

SEQ ID NO: 81208 - RNA, 23 nt, Artificial Sequence
  Oligomer
guagcuucugcaguuaggaggug

SEQ ID NO: 81209 - RNA, 23 nt, Artificial Sequence
  Oligomer
gguagcuucugcaguuaggaggu

SEQ ID NO: 81210 - RNA, 23 nt, Artificial Sequence
  Oligomer
cgguagcuucugcaguuaggagg

SEQ ID NO: 81211 - RNA, 23 nt, Artificial Sequence
  Oligomer
acgguagcuucugcaguuaggag

SEQ ID NO: 81212 - RNA, 23 nt, Artificial Sequence
  Oligomer
ggccauuuccuguuucucugcag

SEQ ID NO: 81213 - RNA, 23 nt, Artificial Sequence
  Oligomer
cggccauuuccuguuucucugca

SEQ ID NO: 81214 - RNA, 23 nt, Artificial Sequence
  Oligomer
gcggccauuuccuguuucucugc

SEQ ID NO: 81215 - RNA, 23 nt, Artificial Sequence
  Oligomer
agcggccauuuccuguuucucug

SEQ ID NO: 81216 - RNA, 23 nt, Artificial Sequence
  Oligomer
gagcggccauuuccuguuucucu

SEQ ID NO: 81217 - RNA, 23 nt, Artificial Sequence
  Oligomer
gaagauuaugacagauuacgccc

SEQ ID NO: 81218 - RNA, 23 nt, Artificial Sequence
  Oligomer
agaagauuaugacagauuacgcc

SEQ ID NO: 81219 - RNA, 23 nt, Artificial Sequence
  Oligomer
aagaagauuaugacagauuacgc

SEQ ID NO: 81220 - RNA, 23 nt, Artificial Sequence
  Oligomer
uuuuuuaaauugacaguugcaga

SEQ ID NO: 81221 - RNA, 23 nt, Artificial Sequence
  Oligomer
cuuaaacuaugaaccuucuuaac

SEQ ID NO: 81222 - RNA, 23 nt, Artificial Sequence
  Oligomer
ucuuaaacuaugaaccuucuuaa

SEQ ID NO: 81223 - RNA, 23 nt, Artificial Sequence
  Oligomer
uucuuaaacuaugaaccuucuua

SEQ ID NO: 81224 - RNA, 23 nt, Artificial Sequence
  Oligomer
auucuuaaacuaugaaccuucuu

SEQ ID NO: 81225 - RNA, 23 nt, Artificial Sequence
  Oligomer
aauucuuaaacuaugaaccuucu

SEQ ID NO: 81226 - RNA, 23 nt, Artificial Sequence
  Oligomer
gguuaauuucugucaaaugcagu

SEQ ID NO: 81227 - RNA, 23 nt, Artificial Sequence
  Oligomer
agguuaauuucugucaaaugcag

SEQ ID NO: 81228 - RNA, 23 nt, Artificial Sequence
  Oligomer
aagguuaauuucugucaaaugca

SEQ ID NO: 81229 - RNA, 23 nt, Artificial Sequence
  Oligomer
aaagguuaauuucugucaaaugc

SEQ ID NO: 81230 - RNA, 23 nt, Artificial Sequence
  Oligomer
aaaagguuaauuucugucaaaug

SEQ ID NO: 81231 - RNA, 23 nt, Artificial Sequence
  Oligomer
gauuuacacuacauuguacaagg

SEQ ID NO: 81232 - RNA, 23 nt, Artificial Sequence
  Oligomer
agauuuacacuacauuguacaag

SEQ ID NO: 81233 - RNA, 23 nt, Artificial Sequence
  Oligomer
gagauuuacacuacauuguacaa

SEQ ID NO: 81234 - RNA, 23 nt, Artificial Sequence
  Oligomer
guuacacaaccaaugcauuuccu

SEQ ID NO: 81235 - RNA, 23 nt, Artificial Sequence
  Oligomer
aguuacacaaccaaugcauuucc

SEQ ID NO: 81236 - RNA, 23 nt, Artificial Sequence
  Oligomer
caguuacacaaccaaugcauuuc

SEQ ID NO: 81237 - RNA, 23 nt, Artificial Sequence
  Oligomer
ucaguuacacaaccaaugcauuu

SEQ ID NO: 81238 - RNA, 23 nt, Artificial Sequence
  Oligomer
aucaguuacacaaccaaugcauu

SEQ ID NO: 81239 - RNA, 23 nt, Artificial Sequence
  Oligomer
uaauggagugagcguagcagcuc

SEQ ID NO: 81240 - RNA, 23 nt, Artificial Sequence
  Oligomer
guaauggagugagcguagcagcu

SEQ ID NO: 81241 - RNA, 23 nt, Artificial Sequence
  Oligomer
uguaauggagugagcguagcagc

SEQ ID NO: 81242 - RNA, 23 nt, Artificial Sequence
  Oligomer
gcuucugcaguuaggaggugcag

SEQ ID NO: 81243 - RNA, 23 nt, Artificial Sequence
  Oligomer
agcuucugcaguuaggaggugca

SEQ ID NO: 81244 - RNA, 23 nt, Artificial Sequence
  Oligomer
uagcuucugcaguuaggaggugc

SEQ ID NO: 81245 - RNA, 23 nt, Artificial Sequence
  Oligomer
aacaccgagcacugaacuuugca

SEQ ID NO: 81246 - RNA, 23 nt, Artificial Sequence
  Oligomer
gaacaccgagcacugaacuuugc

SEQ ID NO: 81247 - RNA, 23 nt, Artificial Sequence
  Oligomer
agaacaccgagcacugaacuuug

SEQ ID NO: 81248 - RNA, 23 nt, Artificial Sequence
  Oligomer
gguuuuuuugucgauuaguaaaa

SEQ ID NO: 81249 - RNA, 23 nt, Artificial Sequence
  Oligomer
agguuuuuuugucgauuaguaaa

SEQ ID NO: 81250 - RNA, 23 nt, Artificial Sequence
  Oligomer
aagguuuuuuugucgauuaguaa

SEQ ID NO: 81251 - RNA, 23 nt, Artificial Sequence
  Oligomer
gcauuagaagguuuuuuugucga

SEQ ID NO: 81252 - RNA, 23 nt, Artificial Sequence
  Oligomer
ugcauuagaagguuuuuuugucg

SEQ ID NO: 81253 - RNA, 23 nt, Artificial Sequence
  Oligomer
augcauuagaagguuuuuuuguc

SEQ ID NO: 81254 - RNA, 23 nt, Artificial Sequence
  Oligomer
aaugcauuagaagguuuuuuugu

SEQ ID NO: 81255 - RNA, 23 nt, Artificial Sequence
  Oligomer
uaaugcauuagaagguuuuuuug

SEQ ID NO: 81256 - RNA, 23 nt, Artificial Sequence
  Oligomer
uaaaacuugccuacugaucaguu

SEQ ID NO: 81257 - RNA, 23 nt, Artificial Sequence
  Oligomer
agaugcguaaagcagaacagccu

SEQ ID NO: 81258 - RNA, 23 nt, Artificial Sequence
  Oligomer
cagaugcguaaagcagaacagcc

SEQ ID NO: 81259 - RNA, 23 nt, Artificial Sequence
  Oligomer
cugggcuuaugggauacagcugg

SEQ ID NO: 81260 - RNA, 23 nt, Artificial Sequence
  Oligomer
ucugggcuuaugggauacagcug

SEQ ID NO: 81261 - RNA, 23 nt, Artificial Sequence
  Oligomer
aucugggcuuaugggauacagcu

SEQ ID NO: 81262 - RNA, 23 nt, Artificial Sequence
  Oligomer
gaauauaucccuacugucuuuga

SEQ ID NO: 81263 - RNA, 23 nt, Artificial Sequence
  Oligomer
agaauauaucccuacugucuuug

SEQ ID NO: 81264 - RNA, 23 nt, Artificial Sequence
  Oligomer
gagaauauaucccuacugucuuu

SEQ ID NO: 81265 - RNA, 23 nt, Artificial Sequence
  Oligomer
ggagaauauaucccuacugucuu

SEQ ID NO: 81266 - RNA, 23 nt, Artificial Sequence
  Oligomer
uggagaauauaucccuacugucu

SEQ ID NO: 81267 - RNA, 23 nt, Artificial Sequence
  Oligomer
cauuuccuggagaauauaucccu

SEQ ID NO: 81268 - RNA, 23 nt, Artificial Sequence
  Oligomer
auguuccuuugggucugugaggu

SEQ ID NO: 81269 - RNA, 23 nt, Artificial Sequence
  Oligomer
gauguuccuuugggucugugagg

SEQ ID NO: 81270 - RNA, 23 nt, Artificial Sequence
  Oligomer
cacuugaccaauacugacccucu

SEQ ID NO: 81271 - RNA, 23 nt, Artificial Sequence
  Oligomer
ggagcggccauuuccuguuucuc

SEQ ID NO: 81272 - RNA, 23 nt, Artificial Sequence
  Oligomer
uggagcggccauuuccuguuucu

SEQ ID NO: 81273 - RNA, 23 nt, Artificial Sequence
  Oligomer
ggaaaaccggugaaucugggcuu

SEQ ID NO: 81274 - RNA, 23 nt, Artificial Sequence
  Oligomer
uggaaaaccggugaaucugggcu

SEQ ID NO: 81275 - RNA, 23 nt, Artificial Sequence
  Oligomer
auggaaaaccggugaaucugggc

SEQ ID NO: 81276 - RNA, 23 nt, Artificial Sequence
  Oligomer
gauggaaaaccggugaaucuggg

SEQ ID NO: 81277 - RNA, 23 nt, Artificial Sequence
  Oligomer
ucacuugaccaauacugacccuc

SEQ ID NO: 81278 - RNA, 23 nt, Artificial Sequence
  Oligomer
gauaaugcauuagaagguuuuuu

SEQ ID NO: 81279 - RNA, 23 nt, Artificial Sequence
  Oligomer
ugauaaugcauuagaagguuuuu

SEQ ID NO: 81280 - RNA, 23 nt, Artificial Sequence
  Oligomer
cugauaaugcauuagaagguuuu

SEQ ID NO: 81281 - RNA, 23 nt, Artificial Sequence
  Oligomer
ucugauaaugcauuagaagguuu

SEQ ID NO: 81282 - RNA, 23 nt, Artificial Sequence
  Oligomer
uucugauaaugcauuagaagguu

SEQ ID NO: 81283 - RNA, 23 nt, Artificial Sequence
  Oligomer
aaacugguuguucuguuagucgc

SEQ ID NO: 81284 - RNA, 23 nt, Artificial Sequence
  Oligomer
uaaacugguuguucuguuagucg

SEQ ID NO: 81285 - RNA, 23 nt, Artificial Sequence
  Oligomer
uuaaacugguuguucuguuaguc

SEQ ID NO: 81286 - RNA, 23 nt, Artificial Sequence
  Oligomer
uuuaaacugguuguucuguuagu

SEQ ID NO: 81287 - RNA, 23 nt, Artificial Sequence
  Oligomer
cuuuaaacugguuguucuguuag

SEQ ID NO: 81288 - RNA, 23 nt, Artificial Sequence
  Oligomer
ucuuuaaacugguuguucuguua

SEQ ID NO: 81289 - RNA, 23 nt, Artificial Sequence
  Oligomer
acauaacauuguacuguaaugga

SEQ ID NO: 81290 - RNA, 23 nt, Artificial Sequence
  Oligomer
aaauaccuucugaacuacacugc

SEQ ID NO: 81291 - RNA, 23 nt, Artificial Sequence
  Oligomer
aaaauaccuucugaacuacacug

SEQ ID NO: 81292 - RNA, 23 nt, Artificial Sequence
  Oligomer
cauucuuguucagauuaagaguu

SEQ ID NO: 81293 - RNA, 23 nt, Artificial Sequence
  Oligomer
ucaaugccaacuuuuuguuacag

SEQ ID NO: 81294 - RNA, 23 nt, Artificial Sequence
  Oligomer
cucaaugccaacuuuuuguuaca

SEQ ID NO: 81295 - RNA, 23 nt, Artificial Sequence
  Oligomer
acucaaugccaacuuuuuguuac

SEQ ID NO: 81296 - RNA, 23 nt, Artificial Sequence
  Oligomer
gcgaggccucaagacaguguuug

SEQ ID NO: 81297 - RNA, 23 nt, Artificial Sequence
  Oligomer
agcgaggccucaagacaguguuu

SEQ ID NO: 81298 - RNA, 23 nt, Artificial Sequence
  Oligomer
cagcgaggccucaagacaguguu

SEQ ID NO: 81299 - RNA, 23 nt, Artificial Sequence
  Oligomer
auuaccgacacugucacuugacc

SEQ ID NO: 81300 - RNA, 23 nt, Artificial Sequence
  Oligomer
gauuaccgacacugucacuugac

SEQ ID NO: 81301 - RNA, 23 nt, Artificial Sequence
  Oligomer
gcuuuccauguuacuuuauucag

SEQ ID NO: 81302 - RNA, 23 nt, Artificial Sequence
  Oligomer
gcuaacuuaguaagugcuuuucu

SEQ ID NO: 81303 - RNA, 23 nt, Artificial Sequence
  Oligomer
cgcuaacuuaguaagugcuuuuc

SEQ ID NO: 81304 - RNA, 23 nt, Artificial Sequence
  Oligomer
ucgcuaacuuaguaagugcuuuu

SEQ ID NO: 81305 - RNA, 23 nt, Artificial Sequence
  Oligomer
gucgcuaacuuaguaagugcuuu

SEQ ID NO: 81306 - RNA, 23 nt, Artificial Sequence
  Oligomer
guuaggaggugcagacacuugcu

SEQ ID NO: 81307 - RNA, 23 nt, Artificial Sequence
  Oligomer
aguuaggaggugcagacacuugc

SEQ ID NO: 81308 - RNA, 23 nt, Artificial Sequence
  Oligomer
cccccccauucuuguucagauua

SEQ ID NO: 81309 - RNA, 23 nt, Artificial Sequence
  Oligomer
gaaacugaaggagaagaagcuga

SEQ ID NO: 81310 - RNA, 23 nt, Artificial Sequence
  Oligomer
gaaaauguccgugcaaaguggua

SEQ ID NO: 81311 - RNA, 23 nt, Artificial Sequence
  Oligomer
gauguguucuuaauuugcuuuuc

SEQ ID NO: 81312 - RNA, 23 nt, Artificial Sequence
  Oligomer
agauguguucuuaauuugcuuuu

SEQ ID NO: 81313 - RNA, 23 nt, Artificial Sequence
  Oligomer
cagauguguucuuaauuugcuuu

SEQ ID NO: 81314 - RNA, 23 nt, Artificial Sequence
  Oligomer
acagauguguucuuaauuugcuu

SEQ ID NO: 81315 - RNA, 23 nt, Artificial Sequence
  Oligomer
aacagauguguucuuaauuugcu

SEQ ID NO: 81316 - RNA, 23 nt, Artificial Sequence
  Oligomer
uuaugguagauggaaaaccggug

SEQ ID NO: 81317 - RNA, 23 nt, Artificial Sequence
  Oligomer
acaaccaaugcauuuccuggaga

SEQ ID NO: 81318 - RNA, 23 nt, Artificial Sequence
  Oligomer
agcuguagguaaaacuugccuac

SEQ ID NO: 81319 - RNA, 23 nt, Artificial Sequence
  Oligomer
gagcuguagguaaaacuugccua

SEQ ID NO: 81320 - RNA, 23 nt, Artificial Sequence
  Oligomer
agagcuguagguaaaacuugccu

SEQ ID NO: 81321 - RNA, 23 nt, Artificial Sequence
  Oligomer
uagagcuguagguaaaacuugcc

SEQ ID NO: 81322 - RNA, 23 nt, Artificial Sequence
  Oligomer
auagagcuguagguaaaacuugc

SEQ ID NO: 81323 - RNA, 23 nt, Artificial Sequence
  Oligomer
agauuuugaacagaacugcuauu

SEQ ID NO: 81324 - RNA, 23 nt, Artificial Sequence
  Oligomer
uaguucucagaugcguaaagcag

SEQ ID NO: 81325 - RNA, 23 nt, Artificial Sequence
  Oligomer
gagaagacgguagcuucugcagu

SEQ ID NO: 81326 - RNA, 23 nt, Artificial Sequence
  Oligomer
ugagaagacgguagcuucugcag

SEQ ID NO: 81327 - RNA, 23 nt, Artificial Sequence
  Oligomer
uugagaagacgguagcuucugca

SEQ ID NO: 81328 - RNA, 23 nt, Artificial Sequence
  Oligomer
caaagugguauccugaggugcgg

SEQ ID NO: 81329 - RNA, 23 nt, Artificial Sequence
  Oligomer
gcaaagugguauccugaggugcg

SEQ ID NO: 81330 - RNA, 23 nt, Artificial Sequence
  Oligomer
ugcaaagugguauccugaggugc

SEQ ID NO: 81331 - RNA, 23 nt, Artificial Sequence
  Oligomer
auguccgugcaaagugguauccu

SEQ ID NO: 81332 - RNA, 23 nt, Artificial Sequence
  Oligomer
aauguccgugcaaagugguaucc

SEQ ID NO: 81333 - RNA, 23 nt, Artificial Sequence
  Oligomer
aaauguccgugcaaagugguauc

SEQ ID NO: 81334 - RNA, 23 nt, Artificial Sequence
  Oligomer
aaaauguccgugcaaagugguau

SEQ ID NO: 81335 - RNA, 23 nt, Artificial Sequence
  Oligomer
auuugcuuuucccuugugagucc

SEQ ID NO: 81336 - RNA, 23 nt, Artificial Sequence
  Oligomer
aauuugcuuuucccuugugaguc

SEQ ID NO: 81337 - RNA, 23 nt, Artificial Sequence
  Oligomer
guaagugcuuuucuuauagaacc

SEQ ID NO: 81338 - RNA, 23 nt, Artificial Sequence
  Oligomer
aguaagugcuuuucuuauagaac

SEQ ID NO: 81339 - RNA, 23 nt, Artificial Sequence
  Oligomer
uaguaagugcuuuucuuauagaa

SEQ ID NO: 81340 - RNA, 23 nt, Artificial Sequence
  Oligomer
uuaguaagugcuuuucuuauaga

SEQ ID NO: 81341 - RNA, 23 nt, Artificial Sequence
  Oligomer
cuuucucuuacaccugccaugcc

SEQ ID NO: 81342 - RNA, 23 nt, Artificial Sequence
  Oligomer
ccuuucucuuacaccugccaugc

SEQ ID NO: 81343 - RNA, 23 nt, Artificial Sequence
  Oligomer
uccuuucucuuacaccugccaug

SEQ ID NO: 81344 - RNA, 23 nt, Artificial Sequence
  Oligomer
uuccuuucucuuacaccugccau

SEQ ID NO: 81345 - RNA, 23 nt, Artificial Sequence
  Oligomer
uuuccuuucucuuacaccugcca

SEQ ID NO: 81346 - RNA, 23 nt, Artificial Sequence
  Oligomer
guggagcggccauuuccuguuuc

SEQ ID NO: 81347 - RNA, 23 nt, Artificial Sequence
  Oligomer
aguggagcggccauuuccuguuu

SEQ ID NO: 81348 - RNA, 23 nt, Artificial Sequence
  Oligomer
gcguaaagcagaacagccucccg

SEQ ID NO: 81349 - RNA, 23 nt, Artificial Sequence
  Oligomer
ugcguaaagcagaacagccuccc

SEQ ID NO: 81350 - RNA, 23 nt, Artificial Sequence
  Oligomer
augcguaaagcagaacagccucc

SEQ ID NO: 81351 - RNA, 23 nt, Artificial Sequence
  Oligomer
gaugcguaaagcagaacagccuc

SEQ ID NO: 81352 - RNA, 23 nt, Artificial Sequence
  Oligomer
gccauuuccuguuucucugcagu

SEQ ID NO: 81353 - RNA, 23 nt, Artificial Sequence
  Oligomer
gcaguuuuccucagcuuugggug

SEQ ID NO: 81354 - RNA, 23 nt, Artificial Sequence
  Oligomer
ugcaguuuuccucagcuuugggu

SEQ ID NO: 81355 - RNA, 23 nt, Artificial Sequence
  Oligomer
cugcaguuuuccucagcuuuggg

SEQ ID NO: 81356 - RNA, 23 nt, Artificial Sequence
  Oligomer
ucugcaguuuuccucagcuuugg

SEQ ID NO: 81357 - RNA, 23 nt, Artificial Sequence
  Oligomer
cucugcaguuuuccucagcuuug

SEQ ID NO: 81358 - RNA, 23 nt, Artificial Sequence
  Oligomer
uaucccuacugucuuugacaauu

SEQ ID NO: 81359 - RNA, 23 nt, Artificial Sequence
  Oligomer
auaucccuacugucuuugacaau

SEQ ID NO: 81360 - RNA, 23 nt, Artificial Sequence
  Oligomer
uauaucccuacugucuuugacaa

SEQ ID NO: 81361 - RNA, 23 nt, Artificial Sequence
  Oligomer
cacugucuugccagauuaccgac

SEQ ID NO: 81362 - RNA, 23 nt, Artificial Sequence
  Oligomer
agucgcuaacuuaguaagugcuu

SEQ ID NO: 81363 - RNA, 23 nt, Artificial Sequence
  Oligomer
uaaauguaagaguucagacucac

SEQ ID NO: 81364 - RNA, 23 nt, Artificial Sequence
  Oligomer
guuugacgaagcgauccgagcag

SEQ ID NO: 81365 - RNA, 23 nt, Artificial Sequence
  Oligomer
uguuugacgaagcgauccgagca

SEQ ID NO: 81366 - RNA, 23 nt, Artificial Sequence
  Oligomer
guguuugacgaagcgauccgagc

SEQ ID NO: 81367 - RNA, 23 nt, Artificial Sequence
  Oligomer
aguguuugacgaagcgauccgag

SEQ ID NO: 81368 - RNA, 23 nt, Artificial Sequence
  Oligomer
cuggagaauauaucccuacuguc

SEQ ID NO: 81369 - RNA, 23 nt, Artificial Sequence
  Oligomer
uacugacccucuuuaccucgccc

SEQ ID NO: 81370 - RNA, 23 nt, Artificial Sequence
  Oligomer
auacugacccucuuuaccucgcc

SEQ ID NO: 81371 - RNA, 23 nt, Artificial Sequence
  Oligomer
aauacugacccucuuuaccucgc

SEQ ID NO: 81372 - RNA, 23 nt, Artificial Sequence
  Oligomer
cgagguaaagagggucaguauug

SEQ ID NO: 81373 - RNA, 23 nt, Artificial Sequence
  Oligomer
ccuucaguuucucgaucgugucu

SEQ ID NO: 81374 - RNA, 23 nt, Artificial Sequence
  Oligomer
cuucaguuucucgaucgugucuu

SEQ ID NO: 81375 - RNA, 23 nt, Artificial Sequence
  Oligomer
uucaguuucucgaucgugucuuu

SEQ ID NO: 81376 - RNA, 23 nt, Artificial Sequence
  Oligomer
uuucucuuccucuucuucacggg

SEQ ID NO: 81377 - RNA, 23 nt, Artificial Sequence
  Oligomer
aaucuucuuguccagcuguaucc

SEQ ID NO: 81378 - RNA, 23 nt, Artificial Sequence
  Oligomer
aucuucuuguccagcuguauccc

SEQ ID NO: 81379 - RNA, 23 nt, Artificial Sequence
  Oligomer
ucuucuuguccagcuguauccca

SEQ ID NO: 81380 - RNA, 23 nt, Artificial Sequence
  Oligomer
cuucuuguccagcuguaucccau

SEQ ID NO: 81381 - RNA, 23 nt, Artificial Sequence
  Oligomer
uucuuguccagcuguaucccaua

SEQ ID NO: 81382 - RNA, 23 nt, Artificial Sequence
  Oligomer
uagcucugaauaaaguaacaugg

SEQ ID NO: 81383 - RNA, 23 nt, Artificial Sequence
  Oligomer
agcucugaauaaaguaacaugga

SEQ ID NO: 81384 - RNA, 23 nt, Artificial Sequence
  Oligomer
gcucugaauaaaguaacauggaa

SEQ ID NO: 81385 - RNA, 23 nt, Artificial Sequence
  Oligomer
cucugaauaaaguaacauggaaa

SEQ ID NO: 81386 - RNA, 23 nt, Artificial Sequence
  Oligomer
ucugaauaaaguaacauggaaag

SEQ ID NO: 81387 - RNA, 23 nt, Artificial Sequence
  Oligomer
cauuuacaacagcaggcauuuuc

SEQ ID NO: 81388 - RNA, 23 nt, Artificial Sequence
  Oligomer
auuuacaacagcaggcauuuucu

SEQ ID NO: 81389 - RNA, 23 nt, Artificial Sequence
  Oligomer
uuuacaacagcaggcauuuucuc

SEQ ID NO: 81390 - RNA, 23 nt, Artificial Sequence
  Oligomer
uauauucuccaggaaaugcauug

SEQ ID NO: 81391 - RNA, 23 nt, Artificial Sequence
  Oligomer
auauucuccaggaaaugcauugg

SEQ ID NO: 81392 - RNA, 23 nt, Artificial Sequence
  Oligomer
uauucuccaggaaaugcauuggu

SEQ ID NO: 81393 - RNA, 23 nt, Artificial Sequence
  Oligomer
auucuccaggaaaugcauugguu

SEQ ID NO: 81394 - RNA, 23 nt, Artificial Sequence
  Oligomer
uucuccaggaaaugcauugguug

SEQ ID NO: 81395 - RNA, 23 nt, Artificial Sequence
  Oligomer
accuuuuagaguuuuuacccgug

SEQ ID NO: 81396 - RNA, 23 nt, Artificial Sequence
  Oligomer
ccuuuuagaguuuuuacccguga

SEQ ID NO: 81397 - RNA, 23 nt, Artificial Sequence
  Oligomer
cuuuuagaguuuuuacccgugac

SEQ ID NO: 81398 - RNA, 23 nt, Artificial Sequence
  Oligomer
uuuuagaguuuuuacccgugaca

SEQ ID NO: 81399 - RNA, 23 nt, Artificial Sequence
  Oligomer
uuuagaguuuuuacccgugacac

SEQ ID NO: 81400 - RNA, 23 nt, Artificial Sequence
  Oligomer
guuuuccaucuaccauaacauug

SEQ ID NO: 81401 - RNA, 23 nt, Artificial Sequence
  Oligomer
uuuuccaucuaccauaacauugg

SEQ ID NO: 81402 - RNA, 23 nt, Artificial Sequence
  Oligomer
uuuccaucuaccauaacauuggc

SEQ ID NO: 81403 - RNA, 23 nt, Artificial Sequence
  Oligomer
uuccaucuaccauaacauuggca

SEQ ID NO: 81404 - RNA, 23 nt, Artificial Sequence
  Oligomer
uccaucuaccauaacauuggcag

SEQ ID NO: 81405 - RNA, 23 nt, Artificial Sequence
  Oligomer
aaucugucauaaucuucuugucc

SEQ ID NO: 81406 - RNA, 23 nt, Artificial Sequence
  Oligomer
aucugucauaaucuucuugucca

SEQ ID NO: 81407 - RNA, 23 nt, Artificial Sequence
  Oligomer
ucugucauaaucuucuuguccag

SEQ ID NO: 81408 - RNA, 23 nt, Artificial Sequence
  Oligomer
cugucauaaucuucuuguccagc

SEQ ID NO: 81409 - RNA, 23 nt, Artificial Sequence
  Oligomer
ugucauaaucuucuuguccagcu

SEQ ID NO: 81410 - RNA, 23 nt, Artificial Sequence
  Oligomer
acaguagggauauauucuccagg

SEQ ID NO: 81411 - RNA, 23 nt, Artificial Sequence
  Oligomer
caguagggauauauucuccagga

SEQ ID NO: 81412 - RNA, 23 nt, Artificial Sequence
  Oligomer
aguagggauauauucuccaggaa

SEQ ID NO: 81413 - RNA, 23 nt, Artificial Sequence
  Oligomer
guagggauauauucuccaggaaa

SEQ ID NO: 81414 - RNA, 23 nt, Artificial Sequence
  Oligomer
uagggauauauucuccaggaaau

SEQ ID NO: 81415 - RNA, 23 nt, Artificial Sequence
  Oligomer
ccgguuuuccaucuaccauaaca

SEQ ID NO: 81416 - RNA, 23 nt, Artificial Sequence
  Oligomer
cgguuuuccaucuaccauaacau

SEQ ID NO: 81417 - RNA, 23 nt, Artificial Sequence
  Oligomer
gguuuuccaucuaccauaacauu

SEQ ID NO: 81418 - RNA, 23 nt, Artificial Sequence
  Oligomer
gaguuuuuacccgugacacuuuc

SEQ ID NO: 81419 - RNA, 23 nt, Artificial Sequence
  Oligomer
aguuuuuacccgugacacuuuca

SEQ ID NO: 81420 - RNA, 23 nt, Artificial Sequence
  Oligomer
guuuuuacccgugacacuuucau

SEQ ID NO: 81421 - RNA, 23 nt, Artificial Sequence
  Oligomer
uuuuuacccgugacacuuucauu

SEQ ID NO: 81422 - RNA, 23 nt, Artificial Sequence
  Oligomer
uuuuacccgugacacuuucauuc

SEQ ID NO: 81423 - RNA, 23 nt, Artificial Sequence
  Oligomer
uugcaaaguucagugcucggugu

SEQ ID NO: 81424 - RNA, 23 nt, Artificial Sequence
  Oligomer
guaaucugucauaaucuucuugu

SEQ ID NO: 81425 - RNA, 23 nt, Artificial Sequence
  Oligomer
uaaucugucauaaucuucuuguc

SEQ ID NO: 81426 - RNA, 23 nt, Artificial Sequence
  Oligomer
aaccuuuuagaguuuuuacccgu

SEQ ID NO: 81427 - RNA, 23 nt, Artificial Sequence
  Oligomer
acucuuaaucugaacaagaaugg

SEQ ID NO: 81428 - RNA, 23 nt, Artificial Sequence
  Oligomer
cucuuaaucugaacaagaauggg

SEQ ID NO: 81429 - RNA, 23 nt, Artificial Sequence
  Oligomer
ucuuaaucugaacaagaaugggg

SEQ ID NO: 81430 - RNA, 23 nt, Artificial Sequence
  Oligomer
cuuaaucugaacaagaauggggg

SEQ ID NO: 81431 - RNA, 23 nt, Artificial Sequence
  Oligomer
uuaaucugaacaagaaugggggg

SEQ ID NO: 81432 - RNA, 23 nt, Artificial Sequence
  Oligomer
auuuugucaaaauacugucuuug

SEQ ID NO: 81433 - RNA, 23 nt, Artificial Sequence
  Oligomer
uuuugucaaaauacugucuuugu

SEQ ID NO: 81434 - RNA, 23 nt, Artificial Sequence
  Oligomer
uuugucaaaauacugucuuuguc

SEQ ID NO: 81435 - RNA, 23 nt, Artificial Sequence
  Oligomer
uugucaaaauacugucuuugucc

SEQ ID NO: 81436 - RNA, 23 nt, Artificial Sequence
  Oligomer
ugucaaaauacugucuuuguccu

SEQ ID NO: 81437 - RNA, 23 nt, Artificial Sequence
  Oligomer
aaaguucagugcucgguguucuc

SEQ ID NO: 81438 - RNA, 23 nt, Artificial Sequence
  Oligomer
aaguucagugcucgguguucucg

SEQ ID NO: 81439 - RNA, 23 nt, Artificial Sequence
  Oligomer
aguucagugcucgguguucucgg

SEQ ID NO: 81440 - RNA, 23 nt, Artificial Sequence
  Oligomer
guucagugcucgguguucucggc

SEQ ID NO: 81441 - RNA, 23 nt, Artificial Sequence
  Oligomer
uucagugcucgguguucucggca

SEQ ID NO: 81442 - RNA, 23 nt, Artificial Sequence
  Oligomer
ugauguuaagaagguucauaguu

SEQ ID NO: 81443 - RNA, 23 nt, Artificial Sequence
  Oligomer
gauguuaagaagguucauaguuu

SEQ ID NO: 81444 - RNA, 23 nt, Artificial Sequence
  Oligomer
auguuaagaagguucauaguuua

SEQ ID NO: 81445 - RNA, 23 nt, Artificial Sequence
  Oligomer
auacugucuuuguccuuugauca

SEQ ID NO: 81446 - RNA, 23 nt, Artificial Sequence
  Oligomer
uacugucuuuguccuuugaucac

SEQ ID NO: 81447 - RNA, 23 nt, Artificial Sequence
  Oligomer
acugucuuuguccuuugaucaca

SEQ ID NO: 81448 - RNA, 23 nt, Artificial Sequence
  Oligomer
cugucuuuguccuuugaucacac

SEQ ID NO: 81449 - RNA, 23 nt, Artificial Sequence
  Oligomer
ugcaguguaguucagaagguauu

SEQ ID NO: 81450 - RNA, 23 nt, Artificial Sequence
  Oligomer
aguuucucgaucgugucuuuauc

SEQ ID NO: 81451 - RNA, 23 nt, Artificial Sequence
  Oligomer
guuucucgaucgugucuuuauca

SEQ ID NO: 81452 - RNA, 23 nt, Artificial Sequence
  Oligomer
uuucucgaucgugucuuuaucau

SEQ ID NO: 81453 - RNA, 23 nt, Artificial Sequence
  Oligomer
uucucgaucgugucuuuaucauc

SEQ ID NO: 81454 - RNA, 23 nt, Artificial Sequence
  Oligomer
ucucgaucgugucuuuaucaucc

SEQ ID NO: 81455 - RNA, 23 nt, Artificial Sequence
  Oligomer
gggauauauucuccaggaaaugc

SEQ ID NO: 81456 - RNA, 23 nt, Artificial Sequence
  Oligomer
ggauauauucuccaggaaaugca

SEQ ID NO: 81457 - RNA, 23 nt, Artificial Sequence
  Oligomer
gauauauucuccaggaaaugcau

SEQ ID NO: 81458 - RNA, 23 nt, Artificial Sequence
  Oligomer
auauauucuccaggaaaugcauu

SEQ ID NO: 81459 - RNA, 23 nt, Artificial Sequence
  Oligomer
ucgguguucucggcacaacaaug

SEQ ID NO: 81460 - RNA, 23 nt, Artificial Sequence
  Oligomer
ucugcuuuacgcaucugagaacu

SEQ ID NO: 81461 - RNA, 23 nt, Artificial Sequence
  Oligomer
caccucaggauaccacuuugcac

SEQ ID NO: 81462 - RNA, 23 nt, Artificial Sequence
  Oligomer
accucaggauaccacuuugcacg

SEQ ID NO: 81463 - RNA, 23 nt, Artificial Sequence
  Oligomer
ccucaggauaccacuuugcacgg

SEQ ID NO: 81464 - RNA, 23 nt, Artificial Sequence
  Oligomer
cucaggauaccacuuugcacgga

SEQ ID NO: 81465 - RNA, 23 nt, Artificial Sequence
  Oligomer
ucaggauaccacuuugcacggac

SEQ ID NO: 81466 - RNA, 23 nt, Artificial Sequence
  Oligomer
aaacuauaaagcugcaacacaug

SEQ ID NO: 81467 - RNA, 23 nt, Artificial Sequence
  Oligomer
aguguaaaucuccacuucguauu

SEQ ID NO: 81468 - RNA, 23 nt, Artificial Sequence
  Oligomer
guguaaaucuccacuucguauuu

SEQ ID NO: 81469 - RNA, 23 nt, Artificial Sequence
  Oligomer
uguaaaucuccacuucguauuuu

SEQ ID NO: 81470 - RNA, 23 nt, Artificial Sequence
  Oligomer
guaaaucuccacuucguauuuug

SEQ ID NO: 81471 - RNA, 23 nt, Artificial Sequence
  Oligomer
uaaaucuccacuucguauuuugu

SEQ ID NO: 81472 - RNA, 23 nt, Artificial Sequence
  Oligomer
acucgcuaugaaaucacaaagac

SEQ ID NO: 81473 - RNA, 23 nt, Artificial Sequence
  Oligomer
cucgcuaugaaaucacaaagacu

SEQ ID NO: 81474 - RNA, 23 nt, Artificial Sequence
  Oligomer
gagcacuccagguauuuuacagc

SEQ ID NO: 81475 - RNA, 23 nt, Artificial Sequence
  Oligomer
auuaaccuuuuagaguuuuuacc

SEQ ID NO: 81476 - RNA, 23 nt, Artificial Sequence
  Oligomer
uuaaccuuuuagaguuuuuaccc

SEQ ID NO: 81477 - RNA, 23 nt, Artificial Sequence
  Oligomer
uaaccuuuuagaguuuuuacccg

SEQ ID NO: 81478 - RNA, 23 nt, Artificial Sequence
  Oligomer
ucaguuucucgaucgugucuuua

SEQ ID NO: 81479 - RNA, 23 nt, Artificial Sequence
  Oligomer
caguuucucgaucgugucuuuau

SEQ ID NO: 81480 - RNA, 23 nt, Artificial Sequence
  Oligomer
aacuaaggaaagcacuuauuagc

SEQ ID NO: 81481 - RNA, 23 nt, Artificial Sequence
  Oligomer
acuaaggaaagcacuuauuagcu

SEQ ID NO: 81482 - RNA, 23 nt, Artificial Sequence
  Oligomer
cuaaggaaagcacuuauuagcuc

SEQ ID NO: 81483 - RNA, 23 nt, Artificial Sequence
  Oligomer
uaaggaaagcacuuauuagcucu

SEQ ID NO: 81484 - RNA, 23 nt, Artificial Sequence
  Oligomer
aaggaaagcacuuauuagcucug

SEQ ID NO: 81485 - RNA, 23 nt, Artificial Sequence
  Oligomer
ugaauaaaguaacauggaaagca

SEQ ID NO: 81486 - RNA, 23 nt, Artificial Sequence
  Oligomer
gaauaaaguaacauggaaagcac

SEQ ID NO: 81487 - RNA, 23 nt, Artificial Sequence
  Oligomer
aauaaaguaacauggaaagcacu

SEQ ID NO: 81488 - RNA, 23 nt, Artificial Sequence
  Oligomer
auaaaguaacauggaaagcacuu

SEQ ID NO: 81489 - RNA, 23 nt, Artificial Sequence
  Oligomer
uaaaguaacauggaaagcacuuu

SEQ ID NO: 81490 - RNA, 23 nt, Artificial Sequence
  Oligomer
uuagaguuuuuacccgugacacu

SEQ ID NO: 81491 - RNA, 23 nt, Artificial Sequence
  Oligomer
uuuacccgugacacuuucauucc

SEQ ID NO: 81492 - RNA, 23 nt, Artificial Sequence
  Oligomer
uuacccgugacacuuucauuccu

SEQ ID NO: 81493 - RNA, 23 nt, Artificial Sequence
  Oligomer
uacccgugacacuuucauuccuu

SEQ ID NO: 81494 - RNA, 23 nt, Artificial Sequence
  Oligomer
cgucaaacacugucuugaggccu

SEQ ID NO: 81495 - RNA, 23 nt, Artificial Sequence
  Oligomer
gucaaacacugucuugaggccuc

SEQ ID NO: 81496 - RNA, 23 nt, Artificial Sequence
  Oligomer
ucaaacacugucuugaggccucg

SEQ ID NO: 81497 - RNA, 23 nt, Artificial Sequence
  Oligomer
caggauaccacuuugcacggaca

SEQ ID NO: 81498 - RNA, 23 nt, Artificial Sequence
  Oligomer
gucauaaucuucuuguccagcug

SEQ ID NO: 81499 - RNA, 23 nt, Artificial Sequence
  Oligomer
ucauaaucuucuuguccagcugu

SEQ ID NO: 81500 - RNA, 23 nt, Artificial Sequence
  Oligomer
cauaaucuucuuguccagcugua

SEQ ID NO: 81501 - RNA, 23 nt, Artificial Sequence
  Oligomer
auaaucuucuuguccagcuguau

SEQ ID NO: 81502 - RNA, 23 nt, Artificial Sequence
  Oligomer
uaacauggaaagcacuuuuacua

SEQ ID NO: 81503 - RNA, 23 nt, Artificial Sequence
  Oligomer
aacauggaaagcacuuuuacuaa

SEQ ID NO: 81504 - RNA, 23 nt, Artificial Sequence
  Oligomer
acauggaaagcacuuuuacuaau

SEQ ID NO: 81505 - RNA, 23 nt, Artificial Sequence
  Oligomer
cauggaaagcacuuuuacuaauc

SEQ ID NO: 81506 - RNA, 23 nt, Artificial Sequence
  Oligomer
agaguuuuuacccgugacacuuu

SEQ ID NO: 81507 - RNA, 23 nt, Artificial Sequence
  Oligomer
acgcuucauucgggaggcuguuc

SEQ ID NO: 81508 - RNA, 23 nt, Artificial Sequence
  Oligomer
cgcuucauucgggaggcuguucu

SEQ ID NO: 81509 - RNA, 23 nt, Artificial Sequence
  Oligomer
gcuucauucgggaggcuguucug

SEQ ID NO: 81510 - RNA, 23 nt, Artificial Sequence
  Oligomer
cuucauucgggaggcuguucugc

SEQ ID NO: 81511 - RNA, 23 nt, Artificial Sequence
  Oligomer
uucauucgggaggcuguucugcu

SEQ ID NO: 81512 - RNA, 23 nt, Artificial Sequence
  Oligomer
ugugagucugaacucuuacauuu

SEQ ID NO: 81513 - RNA, 23 nt, Artificial Sequence
  Oligomer
uucucuuccucuucuucacggga

SEQ ID NO: 81514 - RNA, 23 nt, Artificial Sequence
  Oligomer
ucucuuccucuucuucacgggag

SEQ ID NO: 81515 - RNA, 23 nt, Artificial Sequence
  Oligomer
cuguaucccauaagcccagauuc

SEQ ID NO: 81516 - RNA, 23 nt, Artificial Sequence
  Oligomer
uguaucccauaagcccagauuca

SEQ ID NO: 81517 - RNA, 23 nt, Artificial Sequence
  Oligomer
guaucccauaagcccagauucac

SEQ ID NO: 81518 - RNA, 23 nt, Artificial Sequence
  Oligomer
uaucccauaagcccagauucacc

SEQ ID NO: 81519 - RNA, 23 nt, Artificial Sequence
  Oligomer
aucccauaagcccagauucaccg

SEQ ID NO: 81520 - RNA, 23 nt, Artificial Sequence
  Oligomer
uuauuagcucugaauaaaguaac

SEQ ID NO: 81521 - RNA, 23 nt, Artificial Sequence
  Oligomer
uauuagcucugaauaaaguaaca

SEQ ID NO: 81522 - RNA, 23 nt, Artificial Sequence
  Oligomer
auuagcucugaauaaaguaacau

SEQ ID NO: 81523 - RNA, 23 nt, Artificial Sequence
  Oligomer
uuagcucugaauaaaguaacaug

SEQ ID NO: 81524 - RNA, 23 nt, Artificial Sequence
  Oligomer
aaaguaacauggaaagcacuuuu

SEQ ID NO: 81525 - RNA, 23 nt, Artificial Sequence
  Oligomer
aaguaacauggaaagcacuuuua

SEQ ID NO: 81526 - RNA, 23 nt, Artificial Sequence
  Oligomer
aguaacauggaaagcacuuuuac

SEQ ID NO: 81527 - RNA, 23 nt, Artificial Sequence
  Oligomer
guaacauggaaagcacuuuuacu

SEQ ID NO: 81528 - RNA, 23 nt, Artificial Sequence
  Oligomer
gucaaaauacugucuuuguccuu

SEQ ID NO: 81529 - RNA, 23 nt, Artificial Sequence
  Oligomer
ucaaaauacugucuuuguccuuu

SEQ ID NO: 81530 - RNA, 23 nt, Artificial Sequence
  Oligomer
caaaauacugucuuuguccuuug

SEQ ID NO: 81531 - RNA, 23 nt, Artificial Sequence
  Oligomer
aaaauacugucuuuguccuuuga

SEQ ID NO: 81532 - RNA, 23 nt, Artificial Sequence
  Oligomer
aaauacugucuuuguccuuugau

SEQ ID NO: 81533 - RNA, 23 nt, Artificial Sequence
  Oligomer
aauacugucuuuguccuuugauc

SEQ ID NO: 81534 - RNA, 23 nt, Artificial Sequence
  Oligomer
auuaaucuguaacaaaaaguugg

SEQ ID NO: 81535 - RNA, 23 nt, Artificial Sequence
  Oligomer
uuaaucuguaacaaaaaguuggc

SEQ ID NO: 81536 - RNA, 23 nt, Artificial Sequence
  Oligomer
uaaucuguaacaaaaaguuggca

SEQ ID NO: 81537 - RNA, 23 nt, Artificial Sequence
  Oligomer
aaucuguaacaaaaaguuggcau

SEQ ID NO: 81538 - RNA, 23 nt, Artificial Sequence
  Oligomer
aucuguaacaaaaaguuggcauu

SEQ ID NO: 81539 - RNA, 23 nt, Artificial Sequence
  Oligomer
uaacaaaaaguuggcauugagug

SEQ ID NO: 81540 - RNA, 23 nt, Artificial Sequence
  Oligomer
aacaaaaaguuggcauugagugc

SEQ ID NO: 81541 - RNA, 23 nt, Artificial Sequence
  Oligomer
cuauaagaaaagcacuuacuaag

SEQ ID NO: 81542 - RNA, 23 nt, Artificial Sequence
  Oligomer
uauaagaaaagcacuuacuaagu

SEQ ID NO: 81543 - RNA, 23 nt, Artificial Sequence
  Oligomer
auaagaaaagcacuuacuaaguu

SEQ ID NO: 81544 - RNA, 23 nt, Artificial Sequence
  Oligomer
uaagaaaagcacuuacuaaguua

SEQ ID NO: 81545 - RNA, 23 nt, Artificial Sequence
  Oligomer
aagaaaagcacuuacuaaguuag

SEQ ID NO: 81546 - RNA, 23 nt, Artificial Sequence
  Oligomer
acaauguaguguaaaucuccacu

SEQ ID NO: 81547 - RNA, 23 nt, Artificial Sequence
  Oligomer
caauguaguguaaaucuccacuu

SEQ ID NO: 81548 - RNA, 23 nt, Artificial Sequence
  Oligomer
aauguaguguaaaucuccacuuc

SEQ ID NO: 81549 - RNA, 23 nt, Artificial Sequence
  Oligomer
auguaguguaaaucuccacuucg

SEQ ID NO: 81550 - RNA, 23 nt, Artificial Sequence
  Oligomer
uguaguguaaaucuccacuucgu

SEQ ID NO: 81551 - RNA, 23 nt, Artificial Sequence
  Oligomer
ucccauaagcccagauucaccgg

SEQ ID NO: 81552 - RNA, 23 nt, Artificial Sequence
  Oligomer
cccauaagcccagauucaccggu

SEQ ID NO: 81553 - RNA, 23 nt, Artificial Sequence
  Oligomer
ccauaagcccagauucaccgguu

SEQ ID NO: 81554 - RNA, 23 nt, Artificial Sequence
  Oligomer
cauaagcccagauucaccgguuu

SEQ ID NO: 81555 - RNA, 23 nt, Artificial Sequence
  Oligomer
caagugucugcaccuccuaacug

SEQ ID NO: 81556 - RNA, 23 nt, Artificial Sequence
  Oligomer
aagugucugcaccuccuaacugc

SEQ ID NO: 81557 - RNA, 23 nt, Artificial Sequence
  Oligomer
agugucugcaccuccuaacugca

SEQ ID NO: 81558 - RNA, 23 nt, Artificial Sequence
  Oligomer
gugucugcaccuccuaacugcag

SEQ ID NO: 81559 - RNA, 23 nt, Artificial Sequence
  Oligomer
ugucugcaccuccuaacugcaga

SEQ ID NO: 81560 - RNA, 23 nt, Artificial Sequence
  Oligomer
cguaaucugucauaaucuucuug

SEQ ID NO: 81561 - RNA, 23 nt, Artificial Sequence
  Oligomer
aaaucuccacuucguauuuuguc

SEQ ID NO: 81562 - RNA, 23 nt, Artificial Sequence
  Oligomer
aaucuccacuucguauuuuguca

SEQ ID NO: 81563 - RNA, 23 nt, Artificial Sequence
  Oligomer
aucuccacuucguauuuugucaa

SEQ ID NO: 81564 - RNA, 23 nt, Artificial Sequence
  Oligomer
ucuccacuucguauuuugucaaa

SEQ ID NO: 81565 - RNA, 23 nt, Artificial Sequence
  Oligomer
cuccacuucguauuuugucaaaa

SEQ ID NO: 81566 - RNA, 23 nt, Artificial Sequence
  Oligomer
uccacuucguauuuugucaaaau

SEQ ID NO: 81567 - RNA, 23 nt, Artificial Sequence
  Oligomer
cagcuucuucuccuucaguuucu

SEQ ID NO: 81568 - RNA, 23 nt, Artificial Sequence
  Oligomer
agcuucuucuccuucaguuucuc

SEQ ID NO: 81569 - RNA, 23 nt, Artificial Sequence
  Oligomer
ccacuaggaugaugggaguguug

SEQ ID NO: 81570 - RNA, 23 nt, Artificial Sequence
  Oligomer
cacuaggaugaugggaguguugg

SEQ ID NO: 81571 - RNA, 23 nt, Artificial Sequence
  Oligomer
acuaggaugaugggaguguuggg

SEQ ID NO: 81572 - RNA, 23 nt, Artificial Sequence
  Oligomer
cuaggaugaugggaguguuggga

SEQ ID NO: 81573 - RNA, 23 nt, Artificial Sequence
  Oligomer
uaggaugaugggaguguugggac

SEQ ID NO: 81574 - RNA, 23 nt, Artificial Sequence
  Oligomer
cuuguccagcuguaucccauaag

SEQ ID NO: 81575 - RNA, 23 nt, Artificial Sequence
  Oligomer
uuguccagcuguaucccauaagc

SEQ ID NO: 81576 - RNA, 23 nt, Artificial Sequence
  Oligomer
uguccagcuguaucccauaagcc

SEQ ID NO: 81577 - RNA, 23 nt, Artificial Sequence
  Oligomer
guccagcuguaucccauaagccc

SEQ ID NO: 81578 - RNA, 23 nt, Artificial Sequence
  Oligomer
uccagcuguaucccauaagccca

SEQ ID NO: 81579 - RNA, 23 nt, Artificial Sequence
  Oligomer
ccaucuaccauaacauuggcaga

SEQ ID NO: 81580 - RNA, 23 nt, Artificial Sequence
  Oligomer
caucuaccauaacauuggcagaa

SEQ ID NO: 81581 - RNA, 23 nt, Artificial Sequence
  Oligomer
aucuaccauaacauuggcagaau

SEQ ID NO: 81582 - RNA, 23 nt, Artificial Sequence
  Oligomer
ucuaccauaacauuggcagaaua

SEQ ID NO: 81583 - RNA, 23 nt, Artificial Sequence
  Oligomer
ccauaacauuggcagaauaauug

SEQ ID NO: 81584 - RNA, 23 nt, Artificial Sequence
  Oligomer
cauaacauuggcagaauaauugu

SEQ ID NO: 81585 - RNA, 23 nt, Artificial Sequence
  Oligomer
auaacauuggcagaauaauuguc

SEQ ID NO: 81586 - RNA, 23 nt, Artificial Sequence
  Oligomer
uaacauuggcagaauaauuguca

SEQ ID NO: 81587 - RNA, 23 nt, Artificial Sequence
  Oligomer
aacauuggcagaauaauugucaa

SEQ ID NO: 81588 - RNA, 23 nt, Artificial Sequence
  Oligomer
ugcauugguuguguaacugauca

SEQ ID NO: 81589 - RNA, 23 nt, Artificial Sequence
  Oligomer
gcauugguuguguaacugaucag

SEQ ID NO: 81590 - RNA, 23 nt, Artificial Sequence
  Oligomer
cauugguuguguaacugaucagu

SEQ ID NO: 81591 - RNA, 23 nt, Artificial Sequence
  Oligomer
auugguuguguaacugaucagua

SEQ ID NO: 81592 - RNA, 23 nt, Artificial Sequence
  Oligomer
cucuuccucuucuucacgggagg

SEQ ID NO: 81593 - RNA, 23 nt, Artificial Sequence
  Oligomer
ucuuccucuucuucacgggaggc

SEQ ID NO: 81594 - RNA, 23 nt, Artificial Sequence
  Oligomer
ucuuguccagcuguaucccauaa

SEQ ID NO: 81595 - RNA, 23 nt, Artificial Sequence
  Oligomer
uuuaaaaacuauaaagcugcaac

SEQ ID NO: 81596 - RNA, 23 nt, Artificial Sequence
  Oligomer
uuaaaaacuauaaagcugcaaca

SEQ ID NO: 81597 - RNA, 23 nt, Artificial Sequence
  Oligomer
uaaaaacuauaaagcugcaacac

SEQ ID NO: 81598 - RNA, 23 nt, Artificial Sequence
  Oligomer
aaaaacuauaaagcugcaacaca

SEQ ID NO: 81599 - RNA, 23 nt, Artificial Sequence
  Oligomer
aaaacuauaaagcugcaacacau

SEQ ID NO: 81600 - RNA, 23 nt, Artificial Sequence
  Oligomer
ucauucgggaggcuguucugcuu

SEQ ID NO: 81601 - RNA, 23 nt, Artificial Sequence
  Oligomer
uccuaacugcagaagcuaccguc

SEQ ID NO: 81602 - RNA, 23 nt, Artificial Sequence
  Oligomer
ccuaacugcagaagcuaccgucu

SEQ ID NO: 81603 - RNA, 23 nt, Artificial Sequence
  Oligomer
cuaacugcagaagcuaccgucuu

SEQ ID NO: 81604 - RNA, 23 nt, Artificial Sequence
  Oligomer
uaacugcagaagcuaccgucuuc

SEQ ID NO: 81605 - RNA, 23 nt, Artificial Sequence
  Oligomer
aacugcagaagcuaccgucuucu

SEQ ID NO: 81606 - RNA, 23 nt, Artificial Sequence
  Oligomer
gcaggcauuuucucuuccucuuc

SEQ ID NO: 81607 - RNA, 23 nt, Artificial Sequence
  Oligomer
agaauaauugucaaagacaguag

SEQ ID NO: 81608 - RNA, 23 nt, Artificial Sequence
  Oligomer
gaauaauugucaaagacaguagg

SEQ ID NO: 81609 - RNA, 23 nt, Artificial Sequence
  Oligomer
aauaauugucaaagacaguaggg

SEQ ID NO: 81610 - RNA, 23 nt, Artificial Sequence
  Oligomer
auaauugucaaagacaguaggga

SEQ ID NO: 81611 - RNA, 23 nt, Artificial Sequence
  Oligomer
uaauugucaaagacaguagggau

SEQ ID NO: 81612 - RNA, 23 nt, Artificial Sequence
  Oligomer
uagaguuuuuacccgugacacuu

SEQ ID NO: 81613 - RNA, 23 nt, Artificial Sequence
  Oligomer
uacaauguaguguaaaucuccac

SEQ ID NO: 81614 - RNA, 23 nt, Artificial Sequence
  Oligomer
ucgugucuuuaucaucccuaaga

SEQ ID NO: 81615 - RNA, 23 nt, Artificial Sequence
  Oligomer
cgugucuuuaucaucccuaagau

SEQ ID NO: 81616 - RNA, 23 nt, Artificial Sequence
  Oligomer
gugucuuuaucaucccuaagauc

SEQ ID NO: 81617 - RNA, 23 nt, Artificial Sequence
  Oligomer
ccacuuugcacggacauuuucaa

SEQ ID NO: 81618 - RNA, 23 nt, Artificial Sequence
  Oligomer
cacuuugcacggacauuuucaaa

SEQ ID NO: 81619 - RNA, 23 nt, Artificial Sequence
  Oligomer
acuuugcacggacauuuucaaau

SEQ ID NO: 81620 - RNA, 23 nt, Artificial Sequence
  Oligomer
cuuugcacggacauuuucaaaug

SEQ ID NO: 81621 - RNA, 23 nt, Artificial Sequence
  Oligomer
uuugcacggacauuuucaaauga

SEQ ID NO: 81622 - RNA, 23 nt, Artificial Sequence
  Oligomer
acacuccacaauucugcaacugu

SEQ ID NO: 81623 - RNA, 23 nt, Artificial Sequence
  Oligomer
cacuccacaauucugcaacuguc

SEQ ID NO: 81624 - RNA, 23 nt, Artificial Sequence
  Oligomer
acuccacaauucugcaacuguca

SEQ ID NO: 81625 - RNA, 23 nt, Artificial Sequence
  Oligomer
cuccacaauucugcaacugucaa

SEQ ID NO: 81626 - RNA, 23 nt, Artificial Sequence
  Oligomer
uccacaauucugcaacugucaau

SEQ ID NO: 81627 - RNA, 23 nt, Artificial Sequence
  Oligomer
acuaaucgacaaaaaaaccuucu

SEQ ID NO: 81628 - RNA, 23 nt, Artificial Sequence
  Oligomer
cuaaucgacaaaaaaaccuucua

SEQ ID NO: 81629 - RNA, 23 nt, Artificial Sequence
  Oligomer
uaaucgacaaaaaaaccuucuaa

SEQ ID NO: 81630 - RNA, 23 nt, Artificial Sequence
  Oligomer
aaucgacaaaaaaaccuucuaau

SEQ ID NO: 81631 - RNA, 23 nt, Artificial Sequence
  Oligomer
aucgacaaaaaaaccuucuaaug

SEQ ID NO: 81632 - RNA, 23 nt, Artificial Sequence
  Oligomer
uuacuaaguuagcgacuaacaga

SEQ ID NO: 81633 - RNA, 23 nt, Artificial Sequence
  Oligomer
uacuaaguuagcgacuaacagaa

SEQ ID NO: 81634 - RNA, 23 nt, Artificial Sequence
  Oligomer
acuaaguuagcgacuaacagaac

SEQ ID NO: 81635 - RNA, 23 nt, Artificial Sequence
  Oligomer
cuaaguuagcgacuaacagaaca

SEQ ID NO: 81636 - RNA, 23 nt, Artificial Sequence
  Oligomer
uaaguuagcgacuaacagaacaa

SEQ ID NO: 81637 - RNA, 23 nt, Artificial Sequence
  Oligomer
ucuguaacaaaaaguuggcauug

SEQ ID NO: 81638 - RNA, 23 nt, Artificial Sequence
  Oligomer
cuuccucuucuucacgggaggcg

SEQ ID NO: 81639 - RNA, 23 nt, Artificial Sequence
  Oligomer
uuccucuucuucacgggaggcgg

SEQ ID NO: 81640 - RNA, 23 nt, Artificial Sequence
  Oligomer
gcuguaucccauaagcccagauu

SEQ ID NO: 81641 - RNA, 23 nt, Artificial Sequence
  Oligomer
acauuggcagaauaauugucaaa

SEQ ID NO: 81642 - RNA, 23 nt, Artificial Sequence
  Oligomer
cauuggcagaauaauugucaaag

SEQ ID NO: 81643 - RNA, 23 nt, Artificial Sequence
  Oligomer
auuggcagaauaauugucaaaga

SEQ ID NO: 81644 - RNA, 23 nt, Artificial Sequence
  Oligomer
aguuagcgacuaacagaacaacc

SEQ ID NO: 81645 - RNA, 23 nt, Artificial Sequence
  Oligomer
guuagcgacuaacagaacaacca

SEQ ID NO: 81646 - RNA, 23 nt, Artificial Sequence
  Oligomer
uuagcgacuaacagaacaaccag

SEQ ID NO: 81647 - RNA, 23 nt, Artificial Sequence
  Oligomer
uagcgacuaacagaacaaccagu

SEQ ID NO: 81648 - RNA, 23 nt, Artificial Sequence
  Oligomer
agcgacuaacagaacaaccaguu

SEQ ID NO: 81649 - RNA, 23 nt, Artificial Sequence
  Oligomer
aggaugaugggaguguugggaca

SEQ ID NO: 81650 - RNA, 23 nt, Artificial Sequence
  Oligomer
ggaugaugggaguguugggacag

SEQ ID NO: 81651 - RNA, 23 nt, Artificial Sequence
  Oligomer
gaugaugggaguguugggacagu

SEQ ID NO: 81652 - RNA, 23 nt, Artificial Sequence
  Oligomer
augaugggaguguugggacagug

SEQ ID NO: 81653 - RNA, 23 nt, Artificial Sequence
  Oligomer
accacuuugcacggacauuuuca

SEQ ID NO: 81654 - RNA, 23 nt, Artificial Sequence
  Oligomer
ucaaaugaugcaggacucacaag

SEQ ID NO: 81655 - RNA, 23 nt, Artificial Sequence
  Oligomer
augcauugguuguguaacugauc

SEQ ID NO: 81656 - RNA, 23 nt, Artificial Sequence
  Oligomer
uguacaauguaguguaaaucucc

SEQ ID NO: 81657 - RNA, 23 nt, Artificial Sequence
  Oligomer
guacaauguaguguaaaucucca

SEQ ID NO: 81658 - RNA, 23 nt, Artificial Sequence
  Oligomer
uaggugaugggagucagcuucuu

SEQ ID NO: 81659 - RNA, 23 nt, Artificial Sequence
  Oligomer
ugagucugaacucuuacauuuag

SEQ ID NO: 81660 - RNA, 23 nt, Artificial Sequence
  Oligomer
gagucugaacucuuacauuuaga

SEQ ID NO: 81661 - RNA, 23 nt, Artificial Sequence
  Oligomer
agucugaacucuuacauuuagaa

SEQ ID NO: 81662 - RNA, 23 nt, Artificial Sequence
  Oligomer
gucugaacucuuacauuuagaac

SEQ ID NO: 81663 - RNA, 23 nt, Artificial Sequence
  Oligomer
ucugaacucuuacauuuagaaca

SEQ ID NO: 81664 - RNA, 23 nt, Artificial Sequence
  Oligomer
ugggagucagcuucuucuccuuc

SEQ ID NO: 81665 - RNA, 23 nt, Artificial Sequence
  Oligomer
uugcacggacauuuucaaaugau

SEQ ID NO: 81666 - RNA, 23 nt, Artificial Sequence
  Oligomer
ugcacggacauuuucaaaugaug

SEQ ID NO: 81667 - RNA, 23 nt, Artificial Sequence
  Oligomer
auaagcccagauucaccgguuuu

SEQ ID NO: 81668 - RNA, 23 nt, Artificial Sequence
  Oligomer
uaagcccagauucaccgguuuuc

SEQ ID NO: 81669 - RNA, 23 nt, Artificial Sequence
  Oligomer
cacuuacuaaguuagcgacuaac

SEQ ID NO: 81670 - RNA, 23 nt, Artificial Sequence
  Oligomer
acuuacuaaguuagcgacuaaca

SEQ ID NO: 81671 - RNA, 23 nt, Artificial Sequence
  Oligomer
cuuacuaaguuagcgacuaacag

SEQ ID NO: 81672 - RNA, 23 nt, Artificial Sequence
  Oligomer
uccugauaauaccaaccuuucuu

SEQ ID NO: 81673 - RNA, 23 nt, Artificial Sequence
  Oligomer
ccugauaauaccaaccuuucuuu

SEQ ID NO: 81674 - RNA, 23 nt, Artificial Sequence
  Oligomer
guaguguaaaucuccacuucgua

SEQ ID NO: 81675 - RNA, 23 nt, Artificial Sequence
  Oligomer
uaguguaaaucuccacuucguau

SEQ ID NO: 81676 - RNA, 23 nt, Artificial Sequence
  Oligomer
uaaucuucuuguccagcuguauc

SEQ ID NO: 81677 - RNA, 23 nt, Artificial Sequence
  Oligomer
uuauuaagucauacaugcaaaac

SEQ ID NO: 81678 - RNA, 23 nt, Artificial Sequence
  Oligomer
ccacaauucugcaacugucaauu

SEQ ID NO: 81679 - RNA, 23 nt, Artificial Sequence
  Oligomer
cacaauucugcaacugucaauuu

SEQ ID NO: 81680 - RNA, 23 nt, Artificial Sequence
  Oligomer
agggucaguauuggucaagugac

SEQ ID NO: 81681 - RNA, 23 nt, Artificial Sequence
  Oligomer
gggucaguauuggucaagugaca

SEQ ID NO: 81682 - RNA, 23 nt, Artificial Sequence
  Oligomer
ggucaguauuggucaagugacag

SEQ ID NO: 81683 - RNA, 23 nt, Artificial Sequence
  Oligomer
uacuaaucgacaaaaaaaccuuc

SEQ ID NO: 81684 - RNA, 23 nt, Artificial Sequence
  Oligomer
aaguuagcgacuaacagaacaac

SEQ ID NO: 81685 - RNA, 23 nt, Artificial Sequence
  Oligomer
caccuccuaacugcagaagcuac

SEQ ID NO: 81686 - RNA, 23 nt, Artificial Sequence
  Oligomer
accuccuaacugcagaagcuacc

SEQ ID NO: 81687 - RNA, 23 nt, Artificial Sequence
  Oligomer
ccuccuaacugcagaagcuaccg

SEQ ID NO: 81688 - RNA, 23 nt, Artificial Sequence
  Oligomer
cuccuaacugcagaagcuaccgu

SEQ ID NO: 81689 - RNA, 23 nt, Artificial Sequence
  Oligomer
cugcagagaaacaggaaauggcc

SEQ ID NO: 81690 - RNA, 23 nt, Artificial Sequence
  Oligomer
ugcagagaaacaggaaauggccg

SEQ ID NO: 81691 - RNA, 23 nt, Artificial Sequence
  Oligomer
gcagagaaacaggaaauggccgc

SEQ ID NO: 81692 - RNA, 23 nt, Artificial Sequence
  Oligomer
cagagaaacaggaaauggccgcu

SEQ ID NO: 81693 - RNA, 23 nt, Artificial Sequence
  Oligomer
agagaaacaggaaauggccgcuc

SEQ ID NO: 81694 - RNA, 23 nt, Artificial Sequence
  Oligomer
gggcguaaucugucauaaucuuc

SEQ ID NO: 81695 - RNA, 23 nt, Artificial Sequence
  Oligomer
ggcguaaucugucauaaucuucu

SEQ ID NO: 81696 - RNA, 23 nt, Artificial Sequence
  Oligomer
gcguaaucugucauaaucuucuu

SEQ ID NO: 81697 - RNA, 23 nt, Artificial Sequence
  Oligomer
ucugcaacugucaauuuaaaaaa

SEQ ID NO: 81698 - RNA, 23 nt, Artificial Sequence
  Oligomer
guuaagaagguucauaguuuaag

SEQ ID NO: 81699 - RNA, 23 nt, Artificial Sequence
  Oligomer
uuaagaagguucauaguuuaaga

SEQ ID NO: 81700 - RNA, 23 nt, Artificial Sequence
  Oligomer
uaagaagguucauaguuuaagaa

SEQ ID NO: 81701 - RNA, 23 nt, Artificial Sequence
  Oligomer
aagaagguucauaguuuaagaau

SEQ ID NO: 81702 - RNA, 23 nt, Artificial Sequence
  Oligomer
agaagguucauaguuuaagaauu

SEQ ID NO: 81703 - RNA, 23 nt, Artificial Sequence
  Oligomer
acugcauuugacagaaauuaacc

SEQ ID NO: 81704 - RNA, 23 nt, Artificial Sequence
  Oligomer
cugcauuugacagaaauuaaccu

SEQ ID NO: 81705 - RNA, 23 nt, Artificial Sequence
  Oligomer
ugcauuugacagaaauuaaccuu

SEQ ID NO: 81706 - RNA, 23 nt, Artificial Sequence
  Oligomer
gcauuugacagaaauuaaccuuu

SEQ ID NO: 81707 - RNA, 23 nt, Artificial Sequence
  Oligomer
cauuugacagaaauuaaccuuuu

SEQ ID NO: 81708 - RNA, 23 nt, Artificial Sequence
  Oligomer
ccuuguacaauguaguguaaauc

SEQ ID NO: 81709 - RNA, 23 nt, Artificial Sequence
  Oligomer
cuuguacaauguaguguaaaucu

SEQ ID NO: 81710 - RNA, 23 nt, Artificial Sequence
  Oligomer
uuguacaauguaguguaaaucuc

SEQ ID NO: 81711 - RNA, 23 nt, Artificial Sequence
  Oligomer
aggaaaugcauugguuguguaac

SEQ ID NO: 81712 - RNA, 23 nt, Artificial Sequence
  Oligomer
ggaaaugcauugguuguguaacu

SEQ ID NO: 81713 - RNA, 23 nt, Artificial Sequence
  Oligomer
gaaaugcauugguuguguaacug

SEQ ID NO: 81714 - RNA, 23 nt, Artificial Sequence
  Oligomer
aaaugcauugguuguguaacuga

SEQ ID NO: 81715 - RNA, 23 nt, Artificial Sequence
  Oligomer
aaugcauugguuguguaacugau

SEQ ID NO: 81716 - RNA, 23 nt, Artificial Sequence
  Oligomer
gagcugcuacgcucacuccauua

SEQ ID NO: 81717 - RNA, 23 nt, Artificial Sequence
  Oligomer
agcugcuacgcucacuccauuac

SEQ ID NO: 81718 - RNA, 23 nt, Artificial Sequence
  Oligomer
gcugcuacgcucacuccauuaca

SEQ ID NO: 81719 - RNA, 23 nt, Artificial Sequence
  Oligomer
cugcaccuccuaacugcagaagc

SEQ ID NO: 81720 - RNA, 23 nt, Artificial Sequence
  Oligomer
ugcaccuccuaacugcagaagcu

SEQ ID NO: 81721 - RNA, 23 nt, Artificial Sequence
  Oligomer
gcaccuccuaacugcagaagcua

SEQ ID NO: 81722 - RNA, 23 nt, Artificial Sequence
  Oligomer
ugcaaaguucagugcucgguguu

SEQ ID NO: 81723 - RNA, 23 nt, Artificial Sequence
  Oligomer
gcaaaguucagugcucgguguuc

SEQ ID NO: 81724 - RNA, 23 nt, Artificial Sequence
  Oligomer
caaaguucagugcucgguguucu

SEQ ID NO: 81725 - RNA, 23 nt, Artificial Sequence
  Oligomer
uuuuacuaaucgacaaaaaaacc

SEQ ID NO: 81726 - RNA, 23 nt, Artificial Sequence
  Oligomer
uuuacuaaucgacaaaaaaaccu

SEQ ID NO: 81727 - RNA, 23 nt, Artificial Sequence
  Oligomer
uuacuaaucgacaaaaaaaccuu

SEQ ID NO: 81728 - RNA, 23 nt, Artificial Sequence
  Oligomer
ucgacaaaaaaaccuucuaaugc

SEQ ID NO: 81729 - RNA, 23 nt, Artificial Sequence
  Oligomer
cgacaaaaaaaccuucuaaugca

SEQ ID NO: 81730 - RNA, 23 nt, Artificial Sequence
  Oligomer
gacaaaaaaaccuucuaaugcau

SEQ ID NO: 81731 - RNA, 23 nt, Artificial Sequence
  Oligomer
acaaaaaaaccuucuaaugcauu

SEQ ID NO: 81732 - RNA, 23 nt, Artificial Sequence
  Oligomer
caaaaaaaccuucuaaugcauua

SEQ ID NO: 81733 - RNA, 23 nt, Artificial Sequence
  Oligomer
aacugaucaguaggcaaguuuua

SEQ ID NO: 81734 - RNA, 23 nt, Artificial Sequence
  Oligomer
aggcuguucugcuuuacgcaucu

SEQ ID NO: 81735 - RNA, 23 nt, Artificial Sequence
  Oligomer
ggcuguucugcuuuacgcaucug

SEQ ID NO: 81736 - RNA, 23 nt, Artificial Sequence
  Oligomer
ccagcuguaucccauaagcccag

SEQ ID NO: 81737 - RNA, 23 nt, Artificial Sequence
  Oligomer
cagcuguaucccauaagcccaga

SEQ ID NO: 81738 - RNA, 23 nt, Artificial Sequence
  Oligomer
agcuguaucccauaagcccagau

SEQ ID NO: 81739 - RNA, 23 nt, Artificial Sequence
  Oligomer
ucaaagacaguagggauauauuc

SEQ ID NO: 81740 - RNA, 23 nt, Artificial Sequence
  Oligomer
caaagacaguagggauauauucu

SEQ ID NO: 81741 - RNA, 23 nt, Artificial Sequence
  Oligomer
aaagacaguagggauauauucuc

SEQ ID NO: 81742 - RNA, 23 nt, Artificial Sequence
  Oligomer
aagacaguagggauauauucucc

SEQ ID NO: 81743 - RNA, 23 nt, Artificial Sequence
  Oligomer
agacaguagggauauauucucca

SEQ ID NO: 81744 - RNA, 23 nt, Artificial Sequence
  Oligomer
agggauauauucuccaggaaaug

SEQ ID NO: 81745 - RNA, 23 nt, Artificial Sequence
  Oligomer
accucacagacccaaaggaacau

SEQ ID NO: 81746 - RNA, 23 nt, Artificial Sequence
  Oligomer
ccucacagacccaaaggaacauc

SEQ ID NO: 81747 - RNA, 23 nt, Artificial Sequence
  Oligomer
agagggucaguauuggucaagug

SEQ ID NO: 81748 - RNA, 23 nt, Artificial Sequence
  Oligomer
gagaaacaggaaauggccgcucc

SEQ ID NO: 81749 - RNA, 23 nt, Artificial Sequence
  Oligomer
agaaacaggaaauggccgcucca

SEQ ID NO: 81750 - RNA, 23 nt, Artificial Sequence
  Oligomer
aagcccagauucaccgguuuucc

SEQ ID NO: 81751 - RNA, 23 nt, Artificial Sequence
  Oligomer
agcccagauucaccgguuuucca

SEQ ID NO: 81752 - RNA, 23 nt, Artificial Sequence
  Oligomer
gcccagauucaccgguuuuccau

SEQ ID NO: 81753 - RNA, 23 nt, Artificial Sequence
  Oligomer
cccagauucaccgguuuuccauc

SEQ ID NO: 81754 - RNA, 23 nt, Artificial Sequence
  Oligomer
gagggucaguauuggucaaguga

SEQ ID NO: 81755 - RNA, 23 nt, Artificial Sequence
  Oligomer
aaaaaaccuucuaaugcauuauc

SEQ ID NO: 81756 - RNA, 23 nt, Artificial Sequence
  Oligomer
aaaaaccuucuaaugcauuauca

SEQ ID NO: 81757 - RNA, 23 nt, Artificial Sequence
  Oligomer
aaaaccuucuaaugcauuaucag

SEQ ID NO: 81758 - RNA, 23 nt, Artificial Sequence
  Oligomer
aaaccuucuaaugcauuaucaga

SEQ ID NO: 81759 - RNA, 23 nt, Artificial Sequence
  Oligomer
aaccuucuaaugcauuaucagaa

SEQ ID NO: 81760 - RNA, 23 nt, Artificial Sequence
  Oligomer
gcgacuaacagaacaaccaguuu

SEQ ID NO: 81761 - RNA, 23 nt, Artificial Sequence
  Oligomer
cgacuaacagaacaaccaguuua

SEQ ID NO: 81762 - RNA, 23 nt, Artificial Sequence
  Oligomer
gacuaacagaacaaccaguuuaa

SEQ ID NO: 81763 - RNA, 23 nt, Artificial Sequence
  Oligomer
acuaacagaacaaccaguuuaaa

SEQ ID NO: 81764 - RNA, 23 nt, Artificial Sequence
  Oligomer
cuaacagaacaaccaguuuaaag

SEQ ID NO: 81765 - RNA, 23 nt, Artificial Sequence
  Oligomer
uaacagaacaaccaguuuaaaga

SEQ ID NO: 81766 - RNA, 23 nt, Artificial Sequence
  Oligomer
uccauuacaguacaauguuaugu

SEQ ID NO: 81767 - RNA, 23 nt, Artificial Sequence
  Oligomer
gcaguguaguucagaagguauuu

SEQ ID NO: 81768 - RNA, 23 nt, Artificial Sequence
  Oligomer
caguguaguucagaagguauuuu

SEQ ID NO: 81769 - RNA, 23 nt, Artificial Sequence
  Oligomer
aacucuuaaucugaacaagaaug

SEQ ID NO: 81770 - RNA, 23 nt, Artificial Sequence
  Oligomer
cuguaacaaaaaguuggcauuga

SEQ ID NO: 81771 - RNA, 23 nt, Artificial Sequence
  Oligomer
uguaacaaaaaguuggcauugag

SEQ ID NO: 81772 - RNA, 23 nt, Artificial Sequence
  Oligomer
guaacaaaaaguuggcauugagu

SEQ ID NO: 81773 - RNA, 23 nt, Artificial Sequence
  Oligomer
caaacacugucuugaggccucgc

SEQ ID NO: 81774 - RNA, 23 nt, Artificial Sequence
  Oligomer
aaacacugucuugaggccucgcu

SEQ ID NO: 81775 - RNA, 23 nt, Artificial Sequence
  Oligomer
aacacugucuugaggccucgcug

SEQ ID NO: 81776 - RNA, 23 nt, Artificial Sequence
  Oligomer
ggucaagugacagugucgguaau

SEQ ID NO: 81777 - RNA, 23 nt, Artificial Sequence
  Oligomer
gucaagugacagugucgguaauc

SEQ ID NO: 81778 - RNA, 23 nt, Artificial Sequence
  Oligomer
cugaauaaaguaacauggaaagc

SEQ ID NO: 81779 - RNA, 23 nt, Artificial Sequence
  Oligomer
agaaaagcacuuacuaaguuagc

SEQ ID NO: 81780 - RNA, 23 nt, Artificial Sequence
  Oligomer
gaaaagcacuuacuaaguuagcg

SEQ ID NO: 81781 - RNA, 23 nt, Artificial Sequence
  Oligomer
aaaagcacuuacuaaguuagcga

SEQ ID NO: 81782 - RNA, 23 nt, Artificial Sequence
  Oligomer
aaagcacuuacuaaguuagcgac

SEQ ID NO: 81783 - RNA, 23 nt, Artificial Sequence
  Oligomer
agcaagugucugcaccuccuaac

SEQ ID NO: 81784 - RNA, 23 nt, Artificial Sequence
  Oligomer
gcaagugucugcaccuccuaacu

SEQ ID NO: 81785 - RNA, 23 nt, Artificial Sequence
  Oligomer
uaaucugaacaagaauggggggg

SEQ ID NO: 81786 - RNA, 23 nt, Artificial Sequence
  Oligomer
ucagcuucuucuccuucaguuuc

SEQ ID NO: 81787 - RNA, 23 nt, Artificial Sequence
  Oligomer
uaccacuuugcacggacauuuuc

SEQ ID NO: 81788 - RNA, 23 nt, Artificial Sequence
  Oligomer
gaaaagcaaauuaagaacacauc

SEQ ID NO: 81789 - RNA, 23 nt, Artificial Sequence
  Oligomer
aaaagcaaauuaagaacacaucu

SEQ ID NO: 81790 - RNA, 23 nt, Artificial Sequence
  Oligomer
aaagcaaauuaagaacacaucug

SEQ ID NO: 81791 - RNA, 23 nt, Artificial Sequence
  Oligomer
aagcaaauuaagaacacaucugu

SEQ ID NO: 81792 - RNA, 23 nt, Artificial Sequence
  Oligomer
agcaaauuaagaacacaucuguu

SEQ ID NO: 81793 - RNA, 23 nt, Artificial Sequence
  Oligomer
caccgguuuuccaucuaccauaa

SEQ ID NO: 81794 - RNA, 23 nt, Artificial Sequence
  Oligomer
ucuccaggaaaugcauugguugu

SEQ ID NO: 81795 - RNA, 23 nt, Artificial Sequence
  Oligomer
guaggcaaguuuuaccuacagcu

SEQ ID NO: 81796 - RNA, 23 nt, Artificial Sequence
  Oligomer
uaggcaaguuuuaccuacagcuc

SEQ ID NO: 81797 - RNA, 23 nt, Artificial Sequence
  Oligomer
aggcaaguuuuaccuacagcucu

SEQ ID NO: 81798 - RNA, 23 nt, Artificial Sequence
  Oligomer
ggcaaguuuuaccuacagcucua

SEQ ID NO: 81799 - RNA, 23 nt, Artificial Sequence
  Oligomer
gcaaguuuuaccuacagcucuau

SEQ ID NO: 81800 - RNA, 23 nt, Artificial Sequence
  Oligomer
aauagcaguucuguucaaaaucu

SEQ ID NO: 81801 - RNA, 23 nt, Artificial Sequence
  Oligomer
cugcuuuacgcaucugagaacua

SEQ ID NO: 81802 - RNA, 23 nt, Artificial Sequence
  Oligomer
acugcagaagcuaccgucuucuc

SEQ ID NO: 81803 - RNA, 23 nt, Artificial Sequence
  Oligomer
cugcagaagcuaccgucuucuca

SEQ ID NO: 81804 - RNA, 23 nt, Artificial Sequence
  Oligomer
ugcagaagcuaccgucuucucaa

SEQ ID NO: 81805 - RNA, 23 nt, Artificial Sequence
  Oligomer
ccgcaccucaggauaccacuuug

SEQ ID NO: 81806 - RNA, 23 nt, Artificial Sequence
  Oligomer
cgcaccucaggauaccacuuugc

SEQ ID NO: 81807 - RNA, 23 nt, Artificial Sequence
  Oligomer
gcaccucaggauaccacuuugca

SEQ ID NO: 81808 - RNA, 23 nt, Artificial Sequence
  Oligomer
aggauaccacuuugcacggacau

SEQ ID NO: 81809 - RNA, 23 nt, Artificial Sequence
  Oligomer
ggauaccacuuugcacggacauu

SEQ ID NO: 81810 - RNA, 23 nt, Artificial Sequence
  Oligomer
gauaccacuuugcacggacauuu

SEQ ID NO: 81811 - RNA, 23 nt, Artificial Sequence
  Oligomer
auaccacuuugcacggacauuuu

SEQ ID NO: 81812 - RNA, 23 nt, Artificial Sequence
  Oligomer
ggacucacaagggaaaagcaaau

SEQ ID NO: 81813 - RNA, 23 nt, Artificial Sequence
  Oligomer
gacucacaagggaaaagcaaauu

SEQ ID NO: 81814 - RNA, 23 nt, Artificial Sequence
  Oligomer
gguucuauaagaaaagcacuuac

SEQ ID NO: 81815 - RNA, 23 nt, Artificial Sequence
  Oligomer
guucuauaagaaaagcacuuacu

SEQ ID NO: 81816 - RNA, 23 nt, Artificial Sequence
  Oligomer
uucuauaagaaaagcacuuacua

SEQ ID NO: 81817 - RNA, 23 nt, Artificial Sequence
  Oligomer
ucuauaagaaaagcacuuacuaa

SEQ ID NO: 81818 - RNA, 23 nt, Artificial Sequence
  Oligomer
ggcauggcagguguaagagaaag

SEQ ID NO: 81819 - RNA, 23 nt, Artificial Sequence
  Oligomer
gcauggcagguguaagagaaagg

SEQ ID NO: 81820 - RNA, 23 nt, Artificial Sequence
  Oligomer
cauggcagguguaagagaaagga

SEQ ID NO: 81821 - RNA, 23 nt, Artificial Sequence
  Oligomer
auggcagguguaagagaaaggaa

SEQ ID NO: 81822 - RNA, 23 nt, Artificial Sequence
  Oligomer
uggcagguguaagagaaaggaaa

SEQ ID NO: 81823 - RNA, 23 nt, Artificial Sequence
  Oligomer
gaaacaggaaauggccgcuccac

SEQ ID NO: 81824 - RNA, 23 nt, Artificial Sequence
  Oligomer
aaacaggaaauggccgcuccacu

SEQ ID NO: 81825 - RNA, 23 nt, Artificial Sequence
  Oligomer
cgggaggcuguucugcuuuacgc

SEQ ID NO: 81826 - RNA, 23 nt, Artificial Sequence
  Oligomer
gggaggcuguucugcuuuacgca

SEQ ID NO: 81827 - RNA, 23 nt, Artificial Sequence
  Oligomer
ggaggcuguucugcuuuacgcau

SEQ ID NO: 81828 - RNA, 23 nt, Artificial Sequence
  Oligomer
gaggcuguucugcuuuacgcauc

SEQ ID NO: 81829 - RNA, 23 nt, Artificial Sequence
  Oligomer
acugcagagaaacaggaaauggc

SEQ ID NO: 81830 - RNA, 23 nt, Artificial Sequence
  Oligomer
cacccaaagcugaggaaaacugc

SEQ ID NO: 81831 - RNA, 23 nt, Artificial Sequence
  Oligomer
acccaaagcugaggaaaacugca

SEQ ID NO: 81832 - RNA, 23 nt, Artificial Sequence
  Oligomer
cccaaagcugaggaaaacugcag

SEQ ID NO: 81833 - RNA, 23 nt, Artificial Sequence
  Oligomer
ccaaagcugaggaaaacugcaga

SEQ ID NO: 81834 - RNA, 23 nt, Artificial Sequence
  Oligomer
caaagcugaggaaaacugcagag

SEQ ID NO: 81835 - RNA, 23 nt, Artificial Sequence
  Oligomer
aauugucaaagacaguagggaua

SEQ ID NO: 81836 - RNA, 23 nt, Artificial Sequence
  Oligomer
auugucaaagacaguagggauau

SEQ ID NO: 81837 - RNA, 23 nt, Artificial Sequence
  Oligomer
uugucaaagacaguagggauaua

SEQ ID NO: 81838 - RNA, 23 nt, Artificial Sequence
  Oligomer
gucgguaaucuggcaagacagug

SEQ ID NO: 81839 - RNA, 23 nt, Artificial Sequence
  Oligomer
aagcacuuacuaaguuagcgacu

SEQ ID NO: 81840 - RNA, 23 nt, Artificial Sequence
  Oligomer
gugagucugaacucuuacauuua

SEQ ID NO: 81841 - RNA, 23 nt, Artificial Sequence
  Oligomer
cugcucggaucgcuucgucaaac

SEQ ID NO: 81842 - RNA, 23 nt, Artificial Sequence
  Oligomer
ugcucggaucgcuucgucaaaca

SEQ ID NO: 81843 - RNA, 23 nt, Artificial Sequence
  Oligomer
gcucggaucgcuucgucaaacac

SEQ ID NO: 81844 - RNA, 23 nt, Artificial Sequence
  Oligomer
cucggaucgcuucgucaaacacu

SEQ ID NO: 81845 - RNA, 23 nt, Artificial Sequence
  Oligomer
gacaguagggauauauucuccag

SEQ ID NO: 81846 - RNA, 23 nt, Artificial Sequence
  Oligomer
gggcgagguaaagagggucagua

SEQ ID NO: 81847 - RNA, 23 nt, Artificial Sequence
  Oligomer
ggcgagguaaagagggucaguau

SEQ ID NO: 81848 - RNA, 23 nt, Artificial Sequence
  Oligomer
gcgagguaaagagggucaguauu

SEQ ID NO: 81849 - RNA, 19 nt, Artificial Sequence
  Oligomer
cccagauaccgauguuaua

SEQ ID NO: 81850 - RNA, 19 nt, Artificial Sequence
  Oligomer
gauuauuaacgauguccaa

SEQ ID NO: 81851 - RNA, 19 nt, Artificial Sequence
  Oligomer
caaagauggagugagagag

SEQ ID NO: 81852 - RNA, 19 nt, Artificial Sequence
  Oligomer
ugggcuaaguaaauaggaa

SEQ ID NO: 81853 - RNA, 19 nt, Artificial Sequence
  Oligomer
gugagagagguuuuugaaa

SEQ ID NO: 81854 - RNA, 19 nt, Artificial Sequence
  Oligomer
cauggagcugggcuaagua

SEQ ID NO: 81855 - RNA, 19 nt, Artificial Sequence
  Oligomer
ggaaagacaugcuugcuca

SEQ ID NO: 81856 - RNA, 19 nt, Artificial Sequence
  Oligomer
gccggugaaaccugaagaa

SEQ ID NO: 81857 - RNA, 19 nt, Artificial Sequence
  Oligomer
uggagcugggcuaaguaaa

SEQ ID NO: 81858 - RNA, 19 nt, Artificial Sequence
  Oligomer
auaucgagguggauggaaa

SEQ ID NO: 81859 - RNA, 19 nt, Artificial Sequence
  Oligomer
aaagauggagugagagagg

SEQ ID NO: 81860 - RNA, 19 nt, Artificial Sequence
  Oligomer
agugagagagguuuuugaa

SEQ ID NO: 81861 - RNA, 19 nt, Artificial Sequence
  Oligomer
gaaaaugggcucaaccaga

SEQ ID NO: 81862 - RNA, 19 nt, Artificial Sequence
  Oligomer
ggagccuguggaaagacau

SEQ ID NO: 81863 - RNA, 19 nt, Artificial Sequence
  Oligomer
agcugggcaggaagauuau

SEQ ID NO: 81864 - RNA, 19 nt, Artificial Sequence
  Oligomer
ggcagauaucgagguggau

SEQ ID NO: 81865 - RNA, 19 nt, Artificial Sequence
  Oligomer
gaaagacaugcuugcucau

SEQ ID NO: 81866 - RNA, 19 nt, Artificial Sequence
  Oligomer
cagcuguggcagaguuaca

SEQ ID NO: 81867 - RNA, 19 nt, Artificial Sequence
  Oligomer
cacgccugaggcaauuaga

SEQ ID NO: 81868 - RNA, 19 nt, Artificial Sequence
  Oligomer
gguggauggaaagcaggua

SEQ ID NO: 81869 - RNA, 19 nt, Artificial Sequence
  Oligomer
aaaugggcucaaccagaaa

SEQ ID NO: 81870 - RNA, 19 nt, Artificial Sequence
  Oligomer
gauggagugagagagguuu

SEQ ID NO: 81871 - RNA, 19 nt, Artificial Sequence
  Oligomer
aagucagauggaaaauuca

SEQ ID NO: 81872 - RNA, 19 nt, Artificial Sequence
  Oligomer
ccugguugggaauaagaag

SEQ ID NO: 81873 - RNA, 19 nt, Artificial Sequence
  Oligomer
ggaagauggcauaaccugu

SEQ ID NO: 81874 - RNA, 19 nt, Artificial Sequence
  Oligomer
aaaccuugcugcaagcaca

SEQ ID NO: 81875 - RNA, 19 nt, Artificial Sequence
  Oligomer
ugcccacaguguuugagaa

SEQ ID NO: 81876 - RNA, 19 nt, Artificial Sequence
  Oligomer
ugggcaggaagauuaugau

SEQ ID NO: 81877 - RNA, 19 nt, Artificial Sequence
  Oligomer
ccuaagauuacaaaucaga

SEQ ID NO: 81878 - RNA, 19 nt, Artificial Sequence
  Oligomer
cuucuugcuucuuucuaga

SEQ ID NO: 81879 - RNA, 19 nt, Artificial Sequence
  Oligomer
gaagauuaugaucgccuga

SEQ ID NO: 81880 - RNA, 19 nt, Artificial Sequence
  Oligomer
caucgacagcccugauagu

SEQ ID NO: 81881 - RNA, 19 nt, Artificial Sequence
  Oligomer
gaguuggcuuugugggaca

SEQ ID NO: 81882 - RNA, 19 nt, Artificial Sequence
  Oligomer
ggaagauuaugaucgccug

SEQ ID NO: 81883 - RNA, 19 nt, Artificial Sequence
  Oligomer
guuugagaacuauguggca

SEQ ID NO: 81884 - RNA, 19 nt, Artificial Sequence
  Oligomer
ggauucguugccugagcaa

SEQ ID NO: 81885 - RNA, 19 nt, Artificial Sequence
  Oligomer
gaaaccugaagaaggcaga

SEQ ID NO: 81886 - RNA, 19 nt, Artificial Sequence
  Oligomer
ccaaguucaugcagcugug

SEQ ID NO: 81887 - RNA, 19 nt, Artificial Sequence
  Oligomer
uuuugaaauggcuacgaga

SEQ ID NO: 81888 - RNA, 19 nt, Artificial Sequence
  Oligomer
ccuaauacugucauccuca

SEQ ID NO: 81889 - RNA, 19 nt, Artificial Sequence
  Oligomer
gcaucuggcucuaauucac

SEQ ID NO: 81890 - RNA, 19 nt, Artificial Sequence
  Oligomer
caguguuugagaacuaugu

SEQ ID NO: 81891 - RNA, 19 nt, Artificial Sequence
  Oligomer
uggcagauaucgaggugga

SEQ ID NO: 81892 - RNA, 19 nt, Artificial Sequence
  Oligomer
uagacgugggaagaaaaaa

SEQ ID NO: 81893 - RNA, 19 nt, Artificial Sequence
  Oligomer
cugggcuaaguaaauagga

SEQ ID NO: 81894 - RNA, 19 nt, Artificial Sequence
  Oligomer
auguguuuuuccaucgaca

SEQ ID NO: 81895 - RNA, 19 nt, Artificial Sequence
  Oligomer
gaaugaugagcacacaagg

SEQ ID NO: 81896 - RNA, 19 nt, Artificial Sequence
  Oligomer
cuauuaucugucagcugca

SEQ ID NO: 81897 - RNA, 19 nt, Artificial Sequence
  Oligomer
uacugucauccucaaagaa

SEQ ID NO: 81898 - RNA, 19 nt, Artificial Sequence
  Oligomer
caucuggcucuaauucaca

SEQ ID NO: 81899 - RNA, 19 nt, Artificial Sequence
  Oligomer
auggagcugggcuaaguaa

SEQ ID NO: 81900 - RNA, 19 nt, Artificial Sequence
  Oligomer
ugcagcuguggcagaguua

SEQ ID NO: 81901 - RNA, 19 nt, Artificial Sequence
  Oligomer
guuucacgccugaggcaau

SEQ ID NO: 81902 - RNA, 19 nt, Artificial Sequence
  Oligomer
gauuacuggccuuuuucau

SEQ ID NO: 81903 - RNA, 19 nt, Artificial Sequence
  Oligomer
guuucauguuaguuaccuu

SEQ ID NO: 81904 - RNA, 19 nt, Artificial Sequence
  Oligomer
uuuugacacugcucuaaca

SEQ ID NO: 81905 - RNA, 19 nt, Artificial Sequence
  Oligomer
cugucagcugcaagguacu

SEQ ID NO: 81906 - RNA, 19 nt, Artificial Sequence
  Oligomer
caucauccugguugggaau

SEQ ID NO: 81907 - RNA, 19 nt, Artificial Sequence
  Oligomer
acugucauccucaaagaaa

SEQ ID NO: 81908 - RNA, 19 nt, Artificial Sequence
  Oligomer
agucagauggaaaauucau

SEQ ID NO: 81909 - RNA, 19 nt, Artificial Sequence
  Oligomer
uguuggugauggagccugu

SEQ ID NO: 81910 - RNA, 19 nt, Artificial Sequence
  Oligomer
ugauuacuggccuuuuuca

SEQ ID NO: 81911 - RNA, 19 nt, Artificial Sequence
  Oligomer
uaauacugucauccucaaa

SEQ ID NO: 81912 - RNA, 19 nt, Artificial Sequence
  Oligomer
cuauguggcagauaucgag

SEQ ID NO: 81913 - RNA, 19 nt, Artificial Sequence
  Oligomer
uagccaagaugaagcagga

SEQ ID NO: 81914 - RNA, 19 nt, Artificial Sequence
  Oligomer
uggauggaaagcagguaga

SEQ ID NO: 81915 - RNA, 19 nt, Artificial Sequence
  Oligomer
gcucuuuucuccucacugu

SEQ ID NO: 81916 - RNA, 19 nt, Artificial Sequence
  Oligomer
ugugguuucauguuaguua

SEQ ID NO: 81917 - RNA, 19 nt, Artificial Sequence
  Oligomer
gugauggagccuguggaaa

SEQ ID NO: 81918 - RNA, 19 nt, Artificial Sequence
  Oligomer
auggagugagagagguuuu

SEQ ID NO: 81919 - RNA, 19 nt, Artificial Sequence
  Oligomer
ggauggaaagcagguagag

SEQ ID NO: 81920 - RNA, 19 nt, Artificial Sequence
  Oligomer
gucagauggaaaauucauu

SEQ ID NO: 81921 - RNA, 19 nt, Artificial Sequence
  Oligomer
cuuaugcgguuaauuuuga

SEQ ID NO: 81922 - RNA, 19 nt, Artificial Sequence
  Oligomer
cugggcaggaagauuauga

SEQ ID NO: 81923 - RNA, 19 nt, Artificial Sequence
  Oligomer
gauuacaaaucagaaguca

SEQ ID NO: 81924 - RNA, 19 nt, Artificial Sequence
  Oligomer
aggaucuucggaaugauga

SEQ ID NO: 81925 - RNA, 19 nt, Artificial Sequence
  Oligomer
uauuaucugucagcugcaa

SEQ ID NO: 81926 - RNA, 19 nt, Artificial Sequence
  Oligomer
cauccugguugggaauaag

SEQ ID NO: 81927 - RNA, 19 nt, Artificial Sequence
  Oligomer
aagcuagacgugggaagaa

SEQ ID NO: 81928 - RNA, 19 nt, Artificial Sequence
  Oligomer
agauaucgagguggaugga

SEQ ID NO: 81929 - RNA, 19 nt, Artificial Sequence
  Oligomer
gcucaaccagaaaagccca

SEQ ID NO: 81930 - RNA, 19 nt, Artificial Sequence
  Oligomer
aaugggcucaaccagaaaa

SEQ ID NO: 81931 - RNA, 19 nt, Artificial Sequence
  Oligomer
cacaguguuugagaacuau

SEQ ID NO: 81932 - RNA, 19 nt, Artificial Sequence
  Oligomer
guggcagaguuacaguucu

SEQ ID NO: 81933 - RNA, 19 nt, Artificial Sequence
  Oligomer
gauaucgagguggauggaa

SEQ ID NO: 81934 - RNA, 19 nt, Artificial Sequence
  Oligomer
gcaggaagauuaugaucgc

SEQ ID NO: 81935 - RNA, 19 nt, Artificial Sequence
  Oligomer
gauggaaagcagguagagu

SEQ ID NO: 81936 - RNA, 19 nt, Artificial Sequence
  Oligomer
uacgagagcugcucugcaa

SEQ ID NO: 81937 - RNA, 19 nt, Artificial Sequence
  Oligomer
cgauguuauacugaugugu

SEQ ID NO: 81938 - RNA, 19 nt, Artificial Sequence
  Oligomer
agguggauggaaagcaggu

SEQ ID NO: 81939 - RNA, 19 nt, Artificial Sequence
  Oligomer
aagguacucuggugaguca

SEQ ID NO: 81940 - RNA, 19 nt, Artificial Sequence
  Oligomer
uagaguuggcuuuguggga

SEQ ID NO: 81941 - RNA, 19 nt, Artificial Sequence
  Oligomer
gaguuacaguucugugguu

SEQ ID NO: 81942 - RNA, 19 nt, Artificial Sequence
  Oligomer
acucggauucguugccuga

SEQ ID NO: 81943 - RNA, 19 nt, Artificial Sequence
  Oligomer
acuauguggcagauaucga

SEQ ID NO: 81944 - RNA, 19 nt, Artificial Sequence
  Oligomer
cugcaagguacucugguga

SEQ ID NO: 81945 - RNA, 19 nt, Artificial Sequence
  Oligomer
gguagaguuggcuuugugg

SEQ ID NO: 81946 - RNA, 19 nt, Artificial Sequence
  Oligomer
agccggugaaaccugaaga

SEQ ID NO: 81947 - RNA, 19 nt, Artificial Sequence
  Oligomer
uaucgagguggauggaaag

SEQ ID NO: 81948 - RNA, 19 nt, Artificial Sequence
  Oligomer
gauggcauaaccugucuca

SEQ ID NO: 81949 - RNA, 19 nt, Artificial Sequence
  Oligomer
guuuugucacuuuuucuga

SEQ ID NO: 81950 - RNA, 19 nt, Artificial Sequence
  Oligomer
cuugugaaaccuugcugca

SEQ ID NO: 81951 - RNA, 19 nt, Artificial Sequence
  Oligomer
gagaacuauguggcagaua

SEQ ID NO: 81952 - RNA, 19 nt, Artificial Sequence
  Oligomer
auaccgauguuauacugau

SEQ ID NO: 81953 - RNA, 19 nt, Artificial Sequence
  Oligomer
gacacuuuggaagauggca

SEQ ID NO: 81954 - RNA, 19 nt, Artificial Sequence
  Oligomer
aagauggagugagagaggu

SEQ ID NO: 81955 - RNA, 19 nt, Artificial Sequence
  Oligomer
gauaccgauguuauacuga

SEQ ID NO: 81956 - RNA, 19 nt, Artificial Sequence
  Oligomer
ccuguggaaagacaugcuu

SEQ ID NO: 81957 - RNA, 19 nt, Artificial Sequence
  Oligomer
ugacacaccaggcgcuaau

SEQ ID NO: 81958 - RNA, 19 nt, Artificial Sequence
  Oligomer
cacaccaggcgcuaauuca

SEQ ID NO: 81959 - RNA, 19 nt, Artificial Sequence
  Oligomer
ucuccuacccagauaccga

SEQ ID NO: 81960 - RNA, 19 nt, Artificial Sequence
  Oligomer
acuuuggaagauggcauaa

SEQ ID NO: 81961 - RNA, 19 nt, Artificial Sequence
  Oligomer
gugguuucauguuaguuac

SEQ ID NO: 81962 - RNA, 19 nt, Artificial Sequence
  Oligomer
ggcucuaauucacagugcu

SEQ ID NO: 81963 - RNA, 19 nt, Artificial Sequence
  Oligomer
agcaaagaccaaagaugga

SEQ ID NO: 81964 - RNA, 19 nt, Artificial Sequence
  Oligomer
uaugauuacuggccuuuuu

SEQ ID NO: 81965 - RNA, 19 nt, Artificial Sequence
  Oligomer
uacugauguguuuuuccau

SEQ ID NO: 81966 - RNA, 19 nt, Artificial Sequence
  Oligomer
acccagauaccgauguuau

SEQ ID NO: 81967 - RNA, 19 nt, Artificial Sequence
  Oligomer
uggagccuguggaaagaca

SEQ ID NO: 81968 - RNA, 19 nt, Artificial Sequence
  Oligomer
accaguucccagaggugua

SEQ ID NO: 81969 - RNA, 19 nt, Artificial Sequence
  Oligomer
auuuagaagccaacuauga

SEQ ID NO: 81970 - RNA, 19 nt, Artificial Sequence
  Oligomer
aaaucugggugccuugucu

SEQ ID NO: 81971 - RNA, 19 nt, Artificial Sequence
  Oligomer
caccaggcgcuaauucaag

SEQ ID NO: 81972 - RNA, 19 nt, Artificial Sequence
  Oligomer
aguucaugcagcuguggca

SEQ ID NO: 81973 - RNA, 19 nt, Artificial Sequence
  Oligomer
uuuagaagccaacuaugau

SEQ ID NO: 81974 - RNA, 19 nt, Artificial Sequence
  Oligomer
cucucuucucuccagcuga

SEQ ID NO: 81975 - RNA, 19 nt, Artificial Sequence
  Oligomer
cuucucuccagcugacuaa

SEQ ID NO: 81976 - RNA, 19 nt, Artificial Sequence
  Oligomer
aauuagacacuuuggaaga

SEQ ID NO: 81977 - RNA, 19 nt, Artificial Sequence
  Oligomer
cugccauccggaagaaacu

SEQ ID NO: 81978 - RNA, 19 nt, Artificial Sequence
  Oligomer
acgugggaagaaaaaaucu

SEQ ID NO: 81979 - RNA, 19 nt, Artificial Sequence
  Oligomer
ccggaagaaacuggugauu

SEQ ID NO: 81980 - RNA, 19 nt, Artificial Sequence
  Oligomer
uugugaaaccuugcugcaa

SEQ ID NO: 81981 - RNA, 19 nt, Artificial Sequence
  Oligomer
uguccugccuauuaucugu

SEQ ID NO: 81982 - RNA, 19 nt, Artificial Sequence
  Oligomer
cagguagaguuggcuuugu

SEQ ID NO: 81983 - RNA, 19 nt, Artificial Sequence
  Oligomer
ucuucucuccagcugacua

SEQ ID NO: 81984 - RNA, 19 nt, Artificial Sequence
  Oligomer
uuaagcaucuggcucuaau

SEQ ID NO: 81985 - RNA, 19 nt, Artificial Sequence
  Oligomer
cggugaaaccugaagaagg

SEQ ID NO: 81986 - RNA, 19 nt, Artificial Sequence
  Oligomer
caguauuuagaagccaacu

SEQ ID NO: 81987 - RNA, 19 nt, Artificial Sequence
  Oligomer
gaauaagaaggaucuucgg

SEQ ID NO: 81988 - RNA, 19 nt, Artificial Sequence
  Oligomer
accuaagauuacaaaucag

SEQ ID NO: 81989 - RNA, 19 nt, Artificial Sequence
  Oligomer
uugagaacuauguggcaga

SEQ ID NO: 81990 - RNA, 19 nt, Artificial Sequence
  Oligomer
caguucugugguuucaugu

SEQ ID NO: 81991 - RNA, 19 nt, Artificial Sequence
  Oligomer
ugauguguuuuuccaucga

SEQ ID NO: 81992 - RNA, 19 nt, Artificial Sequence
  Oligomer
aucugucagcugcaaggua

SEQ ID NO: 81993 - RNA, 19 nt, Artificial Sequence
  Oligomer
acuucuugcuucuuucuag

SEQ ID NO: 81994 - RNA, 19 nt, Artificial Sequence
  Oligomer
acagcugggcaggaagauu

SEQ ID NO: 81995 - RNA, 19 nt, Artificial Sequence
  Oligomer
cuucggaaugaugagcaca

SEQ ID NO: 81996 - RNA, 19 nt, Artificial Sequence
  Oligomer
acuaacauguccugccuau

SEQ ID NO: 81997 - RNA, 19 nt, Artificial Sequence
  Oligomer
agauuaugaucgccugagg

SEQ ID NO: 81998 - RNA, 19 nt, Artificial Sequence
  Oligomer
guguaugugcccacagugu

SEQ ID NO: 81999 - RNA, 19 nt, Artificial Sequence
  Oligomer
caccaggguccuuuugaca

SEQ ID NO: 82000 - RNA, 19 nt, Artificial Sequence
  Oligomer
uggagugagagagguuuuu

SEQ ID NO: 82001 - RNA, 19 nt, Artificial Sequence
  Oligomer
cuuaagcaucuggcucuaa

SEQ ID NO: 82002 - RNA, 19 nt, Artificial Sequence
  Oligomer
gagccuguggaaagacaug

SEQ ID NO: 82003 - RNA, 19 nt, Artificial Sequence
  Oligomer
cacagugcucuuuucuccu

SEQ ID NO: 82004 - RNA, 19 nt, Artificial Sequence
  Oligomer
cagauaccgauguuauacu

SEQ ID NO: 82005 - RNA, 19 nt, Artificial Sequence
  Oligomer
cuaacauguccugccuauu

SEQ ID NO: 82006 - RNA, 19 nt, Artificial Sequence
  Oligomer
uuaaauucccguuuuguca

SEQ ID NO: 82007 - RNA, 19 nt, Artificial Sequence
  Oligomer
ucugugguuucauguuagu

SEQ ID NO: 82008 - RNA, 19 nt, Artificial Sequence
  Oligomer
gggcaggaagauuaugauc

SEQ ID NO: 82009 - RNA, 19 nt, Artificial Sequence
  Oligomer
aagaccaaagauggaguga

SEQ ID NO: 82010 - RNA, 19 nt, Artificial Sequence
  Oligomer
aguucugugguuucauguu

SEQ ID NO: 82011 - RNA, 19 nt, Artificial Sequence
  Oligomer
ucaccacuucagggcuuua

SEQ ID NO: 82012 - RNA, 19 nt, Artificial Sequence
  Oligomer
auacugauguguuuuucca

SEQ ID NO: 82013 - RNA, 19 nt, Artificial Sequence
  Oligomer
cucuccagcugacuaaacu

SEQ ID NO: 82014 - RNA, 19 nt, Artificial Sequence
  Oligomer
gauucguugccugagcaau

SEQ ID NO: 82015 - RNA, 19 nt, Artificial Sequence
  Oligomer
gugcccacaguguuugaga

SEQ ID NO: 82016 - RNA, 19 nt, Artificial Sequence
  Oligomer
cuggugagucaccacuuca

SEQ ID NO: 82017 - RNA, 19 nt, Artificial Sequence
  Oligomer
uaagcaucuggcucuaauu

SEQ ID NO: 82018 - RNA, 19 nt, Artificial Sequence
  Oligomer
agguagaguuggcuuugug

SEQ ID NO: 82019 - RNA, 19 nt, Artificial Sequence
  Oligomer
gugggaagaaaaaaucugg

SEQ ID NO: 82020 - RNA, 19 nt, Artificial Sequence
  Oligomer
ugcaagcuagacgugggaa

SEQ ID NO: 82021 - RNA, 19 nt, Artificial Sequence
  Oligomer
cuccuacccagauaccgau

SEQ ID NO: 82022 - RNA, 19 nt, Artificial Sequence
  Oligomer
ggugaaaccugaagaaggc

SEQ ID NO: 82023 - RNA, 19 nt, Artificial Sequence
  Oligomer
ccgauguuauacugaugug

SEQ ID NO: 82024 - RNA, 19 nt, Artificial Sequence
  Oligomer
caagcauuucugucccaac

SEQ ID NO: 82025 - RNA, 19 nt, Artificial Sequence
  Oligomer
ucuucggaaugaugagcac

SEQ ID NO: 82026 - RNA, 19 nt, Artificial Sequence
  Oligomer
aggagccaccaguucucau

SEQ ID NO: 82027 - RNA, 19 nt, Artificial Sequence
  Oligomer
ucucguuaguccacggucu

SEQ ID NO: 82028 - RNA, 19 nt, Artificial Sequence
  Oligomer
agcugggcuaaguaaauag

SEQ ID NO: 82029 - RNA, 19 nt, Artificial Sequence
  Oligomer
gcaagguacucuggugagu

SEQ ID NO: 82030 - RNA, 19 nt, Artificial Sequence
  Oligomer
auggaaagcagguagaguu

SEQ ID NO: 82031 - RNA, 19 nt, Artificial Sequence
  Oligomer
acauguccugccuauuauc

SEQ ID NO: 82032 - RNA, 19 nt, Artificial Sequence
  Oligomer
aguucucauggguggcacu

SEQ ID NO: 82033 - RNA, 19 nt, Artificial Sequence
  Oligomer
gcuguggcagaguuacagu

SEQ ID NO: 82034 - RNA, 19 nt, Artificial Sequence
  Oligomer
ucuuuucuccucacuguau

SEQ ID NO: 82035 - RNA, 19 nt, Artificial Sequence
  Oligomer
ucuccagcugacuaaacuu

SEQ ID NO: 82036 - RNA, 19 nt, Artificial Sequence
  Oligomer
cuuuacuccguaacagauu

SEQ ID NO: 82037 - RNA, 19 nt, Artificial Sequence
  Oligomer
uucagggcuuuacuccgua

SEQ ID NO: 82038 - RNA, 19 nt, Artificial Sequence
  Oligomer
auaaccugucucaccugga

SEQ ID NO: 82039 - RNA, 19 nt, Artificial Sequence
  Oligomer
guggauggaaagcagguag

SEQ ID NO: 82040 - RNA, 19 nt, Artificial Sequence
  Oligomer
uucugauaaaagauggcca

SEQ ID NO: 82041 - RNA, 19 nt, Artificial Sequence
  Oligomer
aucagaagucaucuugcua

SEQ ID NO: 82042 - RNA, 19 nt, Artificial Sequence
  Oligomer
agaagucaucuugcuacca

SEQ ID NO: 82043 - RNA, 19 nt, Artificial Sequence
  Oligomer
cuugcuucuuucuagaaag

SEQ ID NO: 82044 - RNA, 19 nt, Artificial Sequence
  Oligomer
gguucucucguuaguccac

SEQ ID NO: 82045 - RNA, 19 nt, Artificial Sequence
  Oligomer
gcugggcaggaagauuaug

SEQ ID NO: 82046 - RNA, 19 nt, Artificial Sequence
  Oligomer
gagagguuuuugaaauggc

SEQ ID NO: 82047 - RNA, 19 nt, Artificial Sequence
  Oligomer
gcugggcuaaguaaauagg

SEQ ID NO: 82048 - RNA, 19 nt, Artificial Sequence
  Oligomer
gccuguggaaagacaugcu

SEQ ID NO: 82049 - RNA, 19 nt, Artificial Sequence
  Oligomer
agcugcaagguacucuggu

SEQ ID NO: 82050 - RNA, 19 nt, Artificial Sequence
  Oligomer
uguaugugcccacaguguu

SEQ ID NO: 82051 - RNA, 19 nt, Artificial Sequence
  Oligomer
aaaagcccaaguucaugca

SEQ ID NO: 82052 - RNA, 19 nt, Artificial Sequence
  Oligomer
acaguucugugguuucaug

SEQ ID NO: 82053 - RNA, 19 nt, Artificial Sequence
  Oligomer
gaaagcagguagaguuggc

SEQ ID NO: 82054 - RNA, 19 nt, Artificial Sequence
  Oligomer
aaaaaaucugggugccuug

SEQ ID NO: 82055 - RNA, 19 nt, Artificial Sequence
  Oligomer
guuuuugaaauggcuacga

SEQ ID NO: 82056 - RNA, 19 nt, Artificial Sequence
  Oligomer
cagauaucgagguggaugg

SEQ ID NO: 82057 - RNA, 19 nt, Artificial Sequence
  Oligomer
cuguggaaagacaugcuug

SEQ ID NO: 82058 - RNA, 19 nt, Artificial Sequence
  Oligomer
gaagucaucuugcuaccag

SEQ ID NO: 82059 - RNA, 19 nt, Artificial Sequence
  Oligomer
acuccguaacagauuuugu

SEQ ID NO: 82060 - RNA, 19 nt, Artificial Sequence
  Oligomer
agaaaacaucccagaaaag

SEQ ID NO: 82061 - RNA, 19 nt, Artificial Sequence
  Oligomer
uauuuagaagccaacuaug

SEQ ID NO: 82062 - RNA, 19 nt, Artificial Sequence
  Oligomer
uucucuccagcugacuaaa

SEQ ID NO: 82063 - RNA, 19 nt, Artificial Sequence
  Oligomer
uguguuuuuccaucgacag

SEQ ID NO: 82064 - RNA, 19 nt, Artificial Sequence
  Oligomer
acgccugaggcaauuagac

SEQ ID NO: 82065 - RNA, 19 nt, Artificial Sequence
  Oligomer
ccggugaaaccugaagaag

SEQ ID NO: 82066 - RNA, 19 nt, Artificial Sequence
  Oligomer
cuuuugacacugcucuaac

SEQ ID NO: 82067 - RNA, 19 nt, Artificial Sequence
  Oligomer
uggaaagcagguagaguug

SEQ ID NO: 82068 - RNA, 19 nt, Artificial Sequence
  Oligomer
ucgagguggauggaaagca

SEQ ID NO: 82069 - RNA, 19 nt, Artificial Sequence
  Oligomer
ccagauaccgauguuauac

SEQ ID NO: 82070 - RNA, 19 nt, Artificial Sequence
  Oligomer
cccaaguucaugcagcugu

SEQ ID NO: 82071 - RNA, 19 nt, Artificial Sequence
  Oligomer
gacacaccaggcgcuaauu

SEQ ID NO: 82072 - RNA, 19 nt, Artificial Sequence
  Oligomer
aggcaauuagacacuuugg

SEQ ID NO: 82073 - RNA, 19 nt, Artificial Sequence
  Oligomer
cagcaaagaccaaagaugg

SEQ ID NO: 82074 - RNA, 19 nt, Artificial Sequence
  Oligomer
gacagcccugauaguuuag

SEQ ID NO: 82075 - RNA, 19 nt, Artificial Sequence
  Oligomer
aaaacaucccagaaaagug

SEQ ID NO: 82076 - RNA, 19 nt, Artificial Sequence
  Oligomer
cacuguauccagguucccu

SEQ ID NO: 82077 - RNA, 19 nt, Artificial Sequence
  Oligomer
aaucugggugccuugucuu

SEQ ID NO: 82078 - RNA, 19 nt, Artificial Sequence
  Oligomer
gauuguuggugauggagcc

SEQ ID NO: 82079 - RNA, 19 nt, Artificial Sequence
  Oligomer
uugggaauaagaaggaucu

SEQ ID NO: 82080 - RNA, 19 nt, Artificial Sequence
  Oligomer
aauaagaaggaucuucgga

SEQ ID NO: 82081 - RNA, 19 nt, Artificial Sequence
  Oligomer
cugugguuucauguuaguu

SEQ ID NO: 82082 - RNA, 19 nt, Artificial Sequence
  Oligomer
aauucacagugcucuuuuc

SEQ ID NO: 82083 - RNA, 19 nt, Artificial Sequence
  Oligomer
uggugagucaccacuucag

SEQ ID NO: 82084 - RNA, 19 nt, Artificial Sequence
  Oligomer
uucugugguuucauguuag

SEQ ID NO: 82085 - RNA, 19 nt, Artificial Sequence
  Oligomer
cuguggcagaguuacaguu

SEQ ID NO: 82086 - RNA, 19 nt, Artificial Sequence
  Oligomer
aaggaucuucggaaugaug

SEQ ID NO: 82087 - RNA, 19 nt, Artificial Sequence
  Oligomer
gauuuuguuggcauagcuc

SEQ ID NO: 82088 - RNA, 19 nt, Artificial Sequence
  Oligomer
auuacuggccuuuuucauu

SEQ ID NO: 82089 - RNA, 19 nt, Artificial Sequence
  Oligomer
gcagauaucgagguggaug

SEQ ID NO: 82090 - RNA, 19 nt, Artificial Sequence
  Oligomer
ggcagaguuacaguucugu

SEQ ID NO: 82091 - RNA, 19 nt, Artificial Sequence
  Oligomer
aacuucuugcuucuuucua

SEQ ID NO: 82092 - RNA, 19 nt, Artificial Sequence
  Oligomer
ugugaaaccuugcugcaag

SEQ ID NO: 82093 - RNA, 19 nt, Artificial Sequence
  Oligomer
caguuuuuugaaaaugggc

SEQ ID NO: 82094 - RNA, 19 nt, Artificial Sequence
  Oligomer
augugcccacaguguuuga

SEQ ID NO: 82095 - RNA, 19 nt, Artificial Sequence
  Oligomer
cccagaagucaagcauuuc

SEQ ID NO: 82096 - RNA, 19 nt, Artificial Sequence
  Oligomer
gugcucuuuucuccucacu

SEQ ID NO: 82097 - RNA, 19 nt, Artificial Sequence
  Oligomer
uguggaaagacaugcuugc

SEQ ID NO: 82098 - RNA, 19 nt, Artificial Sequence
  Oligomer
agaaaagcccaaguucaug

SEQ ID NO: 82099 - RNA, 19 nt, Artificial Sequence
  Oligomer
guggaaagacaugcuugcu

SEQ ID NO: 82100 - RNA, 19 nt, Artificial Sequence
  Oligomer
auccugguugggaauaaga

SEQ ID NO: 82101 - RNA, 19 nt, Artificial Sequence
  Oligomer
uaccgauguuauacugaug

SEQ ID NO: 82102 - RNA, 19 nt, Artificial Sequence
  Oligomer
aguguuugagaacuaugug

SEQ ID NO: 82103 - RNA, 19 nt, Artificial Sequence
  Oligomer
aauaggaauugguuucacg

SEQ ID NO: 82104 - RNA, 19 nt, Artificial Sequence
  Oligomer
agcaucuggcucuaauuca

SEQ ID NO: 82105 - RNA, 19 nt, Artificial Sequence
  Oligomer
auuagacacuuuggaagau

SEQ ID NO: 82106 - RNA, 19 nt, Artificial Sequence
  Oligomer
acagcccugauaguuuaga

SEQ ID NO: 82107 - RNA, 19 nt, Artificial Sequence
  Oligomer
uucucauggguggcacuca

SEQ ID NO: 82108 - RNA, 19 nt, Artificial Sequence
  Oligomer
gucaagcauuucuguccca

SEQ ID NO: 82109 - RNA, 19 nt, Artificial Sequence
  Oligomer
ccuauuaucugucagcugc

SEQ ID NO: 82110 - RNA, 19 nt, Artificial Sequence
  Oligomer
accacuucagggcuuuacu

SEQ ID NO: 82111 - RNA, 19 nt, Artificial Sequence
  Oligomer
cuugucuugugaaaccuug

SEQ ID NO: 82112 - RNA, 19 nt, Artificial Sequence
  Oligomer
gugaaaccugaagaaggca

SEQ ID NO: 82113 - RNA, 19 nt, Artificial Sequence
  Oligomer
aagauggcauaaccugucu

SEQ ID NO: 82114 - RNA, 19 nt, Artificial Sequence
  Oligomer
aguuuuuugaaaaugggcu

SEQ ID NO: 82115 - RNA, 19 nt, Artificial Sequence
  Oligomer
gucucucuucucuccagcu

SEQ ID NO: 82116 - RNA, 19 nt, Artificial Sequence
  Oligomer
uugaaaaugggcucaacca

SEQ ID NO: 82117 - RNA, 19 nt, Artificial Sequence
  Oligomer
ugucauccucaaagaaagu

SEQ ID NO: 82118 - RNA, 19 nt, Artificial Sequence
  Oligomer
cauccggaagaaacuggug

SEQ ID NO: 82119 - RNA, 19 nt, Artificial Sequence
  Oligomer
aguucccagagguguaugu

SEQ ID NO: 82120 - RNA, 19 nt, Artificial Sequence
  Oligomer
ugaaaaugggcucaaccag

SEQ ID NO: 82121 - RNA, 19 nt, Artificial Sequence
  Oligomer
accaggcgcuaauucaagg

SEQ ID NO: 82122 - RNA, 19 nt, Artificial Sequence
  Oligomer
uggacuuaagcaucuggcu

SEQ ID NO: 82123 - RNA, 19 nt, Artificial Sequence
  Oligomer
ucuaauucacagugcucuu

SEQ ID NO: 82124 - RNA, 19 nt, Artificial Sequence
  Oligomer
acuaauagaauaaaggcag

SEQ ID NO: 82125 - RNA, 19 nt, Artificial Sequence
  Oligomer
ugggaagaaaaaaucuggg

SEQ ID NO: 82126 - RNA, 19 nt, Artificial Sequence
  Oligomer
gaagauggcauaaccuguc

SEQ ID NO: 82127 - RNA, 19 nt, Artificial Sequence
  Oligomer
ucugucagcugcaagguac

SEQ ID NO: 82128 - RNA, 19 nt, Artificial Sequence
  Oligomer
auccggaagaaacugguga

SEQ ID NO: 82129 - RNA, 19 nt, Artificial Sequence
  Oligomer
uugcuucuuucuagaaaga

SEQ ID NO: 82130 - RNA, 19 nt, Artificial Sequence
  Oligomer
agaaaaaaucugggugccu

SEQ ID NO: 82131 - RNA, 19 nt, Artificial Sequence
  Oligomer
ugcucugcaagcuagacgu

SEQ ID NO: 82132 - RNA, 19 nt, Artificial Sequence
  Oligomer
uuacaguucugugguuuca

SEQ ID NO: 82133 - RNA, 19 nt, Artificial Sequence
  Oligomer
guuaauuuugaagugcugu

SEQ ID NO: 82134 - RNA, 19 nt, Artificial Sequence
  Oligomer
acuuuuuuucuguaccagu

SEQ ID NO: 82135 - RNA, 19 nt, Artificial Sequence
  Oligomer
cauguccugccuauuaucu

SEQ ID NO: 82136 - RNA, 19 nt, Artificial Sequence
  Oligomer
uaauucacagugcucuuuu

SEQ ID NO: 82137 - RNA, 19 nt, Artificial Sequence
  Oligomer
agucaccacuucagggcuu

SEQ ID NO: 82138 - RNA, 19 nt, Artificial Sequence
  Oligomer
ccuuaugcgguuaauuuug

SEQ ID NO: 82139 - RNA, 19 nt, Artificial Sequence
  Oligomer
cuuuucuccucacuguauc

SEQ ID NO: 82140 - RNA, 19 nt, Artificial Sequence
  Oligomer
uagacacuuuggaagaugg

SEQ ID NO: 82141 - RNA, 19 nt, Artificial Sequence
  Oligomer
uaaaagauggccauauuac

SEQ ID NO: 82142 - RNA, 19 nt, Artificial Sequence
  Oligomer
accagaaaagcccaaguuc

SEQ ID NO: 82143 - RNA, 19 nt, Artificial Sequence
  Oligomer
uucuuaacuucuugcuucu

SEQ ID NO: 82144 - RNA, 19 nt, Artificial Sequence
  Oligomer
ccuacccagauaccgaugu

SEQ ID NO: 82145 - RNA, 19 nt, Artificial Sequence
  Oligomer
ucuggugagucaccacuuc

SEQ ID NO: 82146 - RNA, 19 nt, Artificial Sequence
  Oligomer
guuggcuuugugggacaca

SEQ ID NO: 82147 - RNA, 19 nt, Artificial Sequence
  Oligomer
ggaaagcagguagaguugg

SEQ ID NO: 82148 - RNA, 19 nt, Artificial Sequence
  Oligomer
cuacuaauagaauaaaggc

SEQ ID NO: 82149 - RNA, 19 nt, Artificial Sequence
  Oligomer
uuuacuccguaacagauuu

SEQ ID NO: 82150 - RNA, 19 nt, Artificial Sequence
  Oligomer
aaagcagguagaguuggcu

SEQ ID NO: 82151 - RNA, 19 nt, Artificial Sequence
  Oligomer
uuaacuucuugcuucuuuc

SEQ ID NO: 82152 - RNA, 19 nt, Artificial Sequence
  Oligomer
guugggaauaagaaggauc

SEQ ID NO: 82153 - RNA, 19 nt, Artificial Sequence
  Oligomer
cuuuggaagauggcauaac

SEQ ID NO: 82154 - RNA, 19 nt, Artificial Sequence
  Oligomer
gucaccacuucagggcuuu

SEQ ID NO: 82155 - RNA, 19 nt, Artificial Sequence
  Oligomer
uuuuugaaauggcuacgag

SEQ ID NO: 82156 - RNA, 19 nt, Artificial Sequence
  Oligomer
cccacaguguuugagaacu

SEQ ID NO: 82157 - RNA, 19 nt, Artificial Sequence
  Oligomer
gguuuuugaaauggcuacg

SEQ ID NO: 82158 - RNA, 19 nt, Artificial Sequence
  Oligomer
uggaagauggcauaaccug

SEQ ID NO: 82159 - RNA, 19 nt, Artificial Sequence
  Oligomer
auuuuguuggcauagcucu

SEQ ID NO: 82160 - RNA, 19 nt, Artificial Sequence
  Oligomer
aaaagauggccauauuacc

SEQ ID NO: 82161 - RNA, 19 nt, Artificial Sequence
  Oligomer
aauacugucauccucaaag

SEQ ID NO: 82162 - RNA, 19 nt, Artificial Sequence
  Oligomer
auucguugccugagcaaug

SEQ ID NO: 82163 - RNA, 19 nt, Artificial Sequence
  Oligomer
uuuccaucgacagcccuga

SEQ ID NO: 82164 - RNA, 19 nt, Artificial Sequence
  Oligomer
cugguugggaauaagaagg

SEQ ID NO: 82165 - RNA, 19 nt, Artificial Sequence
  Oligomer
auccucaaagaaaguguau

SEQ ID NO: 82166 - RNA, 19 nt, Artificial Sequence
  Oligomer
guguuugagaacuaugugg

SEQ ID NO: 82167 - RNA, 19 nt, Artificial Sequence
  Oligomer
uuggauuuccuaauacugu

SEQ ID NO: 82168 - RNA, 19 nt, Artificial Sequence
  Oligomer
gugaaaccuugcugcaagc

SEQ ID NO: 82169 - RNA, 19 nt, Artificial Sequence
  Oligomer
uuccaucgacagcccugau

SEQ ID NO: 82170 - RNA, 19 nt, Artificial Sequence
  Oligomer
ucugggugccuugucuugu

SEQ ID NO: 82171 - RNA, 19 nt, Artificial Sequence
  Oligomer
uacccagauaccgauguua

SEQ ID NO: 82172 - RNA, 19 nt, Artificial Sequence
  Oligomer
cuucagggcuuuacuccgu

SEQ ID NO: 82173 - RNA, 19 nt, Artificial Sequence
  Oligomer
aaaaaucugggugccuugu

SEQ ID NO: 82174 - RNA, 19 nt, Artificial Sequence
  Oligomer
gguccuuuugacacugcuc

SEQ ID NO: 82175 - RNA, 19 nt, Artificial Sequence
  Oligomer
guagaguuggcuuuguggg

SEQ ID NO: 82176 - RNA, 19 nt, Artificial Sequence
  Oligomer
aagaggcuggacucggauu

SEQ ID NO: 82177 - RNA, 19 nt, Artificial Sequence
  Oligomer
uauaacaucgguaucuggg

SEQ ID NO: 82178 - RNA, 19 nt, Artificial Sequence
  Oligomer
uuggacaucguuaauaauc

SEQ ID NO: 82179 - RNA, 19 nt, Artificial Sequence
  Oligomer
cucucucacuccaucuuug

SEQ ID NO: 82180 - RNA, 19 nt, Artificial Sequence
  Oligomer
uuccuauuuacuuagccca

SEQ ID NO: 82181 - RNA, 19 nt, Artificial Sequence
  Oligomer
uuucaaaaaccucucucac

SEQ ID NO: 82182 - RNA, 19 nt, Artificial Sequence
  Oligomer
uacuuagcccagcuccaug

SEQ ID NO: 82183 - RNA, 19 nt, Artificial Sequence
  Oligomer
ugagcaagcaugucuuucc

SEQ ID NO: 82184 - RNA, 19 nt, Artificial Sequence
  Oligomer
uucuucagguuucaccggc

SEQ ID NO: 82185 - RNA, 19 nt, Artificial Sequence
  Oligomer
uuuacuuagcccagcucca

SEQ ID NO: 82186 - RNA, 19 nt, Artificial Sequence
  Oligomer
uuuccauccaccucgauau

SEQ ID NO: 82187 - RNA, 19 nt, Artificial Sequence
  Oligomer
ccucucucacuccaucuuu

SEQ ID NO: 82188 - RNA, 19 nt, Artificial Sequence
  Oligomer
uucaaaaaccucucucacu

SEQ ID NO: 82189 - RNA, 19 nt, Artificial Sequence
  Oligomer
ucugguugagcccauuuuc

SEQ ID NO: 82190 - RNA, 19 nt, Artificial Sequence
  Oligomer
augucuuuccacaggcucc

SEQ ID NO: 82191 - RNA, 19 nt, Artificial Sequence
  Oligomer
auaaucuuccugcccagcu

SEQ ID NO: 82192 - RNA, 19 nt, Artificial Sequence
  Oligomer
auccaccucgauaucugcc

SEQ ID NO: 82193 - RNA, 19 nt, Artificial Sequence
  Oligomer
augagcaagcaugucuuuc

SEQ ID NO: 82194 - RNA, 19 nt, Artificial Sequence
  Oligomer
uguaacucugccacagcug

SEQ ID NO: 82195 - RNA, 19 nt, Artificial Sequence
  Oligomer
ucuaauugccucaggcgug

SEQ ID NO: 82196 - RNA, 19 nt, Artificial Sequence
  Oligomer
uaccugcuuuccauccacc

SEQ ID NO: 82197 - RNA, 19 nt, Artificial Sequence
  Oligomer
uuucugguugagcccauuu

SEQ ID NO: 82198 - RNA, 19 nt, Artificial Sequence
  Oligomer
aaaccucucucacuccauc

SEQ ID NO: 82199 - RNA, 19 nt, Artificial Sequence
  Oligomer
ugaauuuuccaucugacuu

SEQ ID NO: 82200 - RNA, 19 nt, Artificial Sequence
  Oligomer
cuucuuauucccaaccagg

SEQ ID NO: 82201 - RNA, 19 nt, Artificial Sequence
  Oligomer
acagguuaugccaucuucc

SEQ ID NO: 82202 - RNA, 19 nt, Artificial Sequence
  Oligomer
ugugcuugcagcaagguuu

SEQ ID NO: 82203 - RNA, 19 nt, Artificial Sequence
  Oligomer
uucucaaacacugugggca

SEQ ID NO: 82204 - RNA, 19 nt, Artificial Sequence
  Oligomer
aucauaaucuuccugccca

SEQ ID NO: 82205 - RNA, 19 nt, Artificial Sequence
  Oligomer
ucugauuuguaaucuuagg

SEQ ID NO: 82206 - RNA, 19 nt, Artificial Sequence
  Oligomer
ucuagaaagaagcaagaag

SEQ ID NO: 82207 - RNA, 19 nt, Artificial Sequence
  Oligomer
ucaggcgaucauaaucuuc

SEQ ID NO: 82208 - RNA, 19 nt, Artificial Sequence
  Oligomer
acuaucagggcugucgaug

SEQ ID NO: 82209 - RNA, 19 nt, Artificial Sequence
  Oligomer
ugucccacaaagccaacuc

SEQ ID NO: 82210 - RNA, 19 nt, Artificial Sequence
  Oligomer
caggcgaucauaaucuucc

SEQ ID NO: 82211 - RNA, 19 nt, Artificial Sequence
  Oligomer
ugccacauaguucucaaac

SEQ ID NO: 82212 - RNA, 19 nt, Artificial Sequence
  Oligomer
uugcucaggcaacgaaucc

SEQ ID NO: 82213 - RNA, 19 nt, Artificial Sequence
  Oligomer
ucugccuucuucagguuuc

SEQ ID NO: 82214 - RNA, 19 nt, Artificial Sequence
  Oligomer
cacagcugcaugaacuugg

SEQ ID NO: 82215 - RNA, 19 nt, Artificial Sequence
  Oligomer
ucucguagccauuucaaaa

SEQ ID NO: 82216 - RNA, 19 nt, Artificial Sequence
  Oligomer
ugaggaugacaguauuagg

SEQ ID NO: 82217 - RNA, 19 nt, Artificial Sequence
  Oligomer
gugaauuagagccagaugc

SEQ ID NO: 82218 - RNA, 19 nt, Artificial Sequence
  Oligomer
acauaguucucaaacacug

SEQ ID NO: 82219 - RNA, 19 nt, Artificial Sequence
  Oligomer
uccaccucgauaucugcca

SEQ ID NO: 82220 - RNA, 19 nt, Artificial Sequence
  Oligomer
uuuuuucuucccacgucua

SEQ ID NO: 82221 - RNA, 19 nt, Artificial Sequence
  Oligomer
uccuauuuacuuagcccag

SEQ ID NO: 82222 - RNA, 19 nt, Artificial Sequence
  Oligomer
ugucgauggaaaaacacau

SEQ ID NO: 82223 - RNA, 19 nt, Artificial Sequence
  Oligomer
ccuugugugcucaucauuc

SEQ ID NO: 82224 - RNA, 19 nt, Artificial Sequence
  Oligomer
ugcagcugacagauaauag

SEQ ID NO: 82225 - RNA, 19 nt, Artificial Sequence
  Oligomer
uucuuugaggaugacagua

SEQ ID NO: 82226 - RNA, 19 nt, Artificial Sequence
  Oligomer
ugugaauuagagccagaug

SEQ ID NO: 82227 - RNA, 19 nt, Artificial Sequence
  Oligomer
uuacuuagcccagcuccau

SEQ ID NO: 82228 - RNA, 19 nt, Artificial Sequence
  Oligomer
uaacucugccacagcugca

SEQ ID NO: 82229 - RNA, 19 nt, Artificial Sequence
  Oligomer
auugccucaggcgugaaac

SEQ ID NO: 82230 - RNA, 19 nt, Artificial Sequence
  Oligomer
augaaaaaggccaguaauc

SEQ ID NO: 82231 - RNA, 19 nt, Artificial Sequence
  Oligomer
aagguaacuaacaugaaac

SEQ ID NO: 82232 - RNA, 19 nt, Artificial Sequence
  Oligomer
uguuagagcagugucaaaa

SEQ ID NO: 82233 - RNA, 19 nt, Artificial Sequence
  Oligomer
aguaccuugcagcugacag

SEQ ID NO: 82234 - RNA, 19 nt, Artificial Sequence
  Oligomer
auucccaaccaggaugaug

SEQ ID NO: 82235 - RNA, 19 nt, Artificial Sequence
  Oligomer
uuucuuugaggaugacagu

SEQ ID NO: 82236 - RNA, 19 nt, Artificial Sequence
  Oligomer
augaauuuuccaucugacu

SEQ ID NO: 82237 - RNA, 19 nt, Artificial Sequence
  Oligomer
acaggcuccaucaccaaca

SEQ ID NO: 82238 - RNA, 19 nt, Artificial Sequence
  Oligomer
ugaaaaaggccaguaauca

SEQ ID NO: 82239 - RNA, 19 nt, Artificial Sequence
  Oligomer
uuugaggaugacaguauua

SEQ ID NO: 82240 - RNA, 19 nt, Artificial Sequence
  Oligomer
cucgauaucugccacauag

SEQ ID NO: 82241 - RNA, 19 nt, Artificial Sequence
  Oligomer
uccugcuucaucuuggcua

SEQ ID NO: 82242 - RNA, 19 nt, Artificial Sequence
  Oligomer
ucuaccugcuuuccaucca

SEQ ID NO: 82243 - RNA, 19 nt, Artificial Sequence
  Oligomer
acagugaggagaaaagagc

SEQ ID NO: 82244 - RNA, 19 nt, Artificial Sequence
  Oligomer
uaacuaacaugaaaccaca

SEQ ID NO: 82245 - RNA, 19 nt, Artificial Sequence
  Oligomer
uuuccacaggcuccaucac

SEQ ID NO: 82246 - RNA, 19 nt, Artificial Sequence
  Oligomer
aaaaccucucucacuccau

SEQ ID NO: 82247 - RNA, 19 nt, Artificial Sequence
  Oligomer
cucuaccugcuuuccaucc

SEQ ID NO: 82248 - RNA, 19 nt, Artificial Sequence
  Oligomer
aaugaauuuuccaucugac

SEQ ID NO: 82249 - RNA, 19 nt, Artificial Sequence
  Oligomer
ucaaaauuaaccgcauaag

SEQ ID NO: 82250 - RNA, 19 nt, Artificial Sequence
  Oligomer
ucauaaucuuccugcccag

SEQ ID NO: 82251 - RNA, 19 nt, Artificial Sequence
  Oligomer
ugacuucugauuuguaauc

SEQ ID NO: 82252 - RNA, 19 nt, Artificial Sequence
  Oligomer
ucaucauuccgaagauccu

SEQ ID NO: 82253 - RNA, 19 nt, Artificial Sequence
  Oligomer
uugcagcugacagauaaua

SEQ ID NO: 82254 - RNA, 19 nt, Artificial Sequence
  Oligomer
cuuauucccaaccaggaug

SEQ ID NO: 82255 - RNA, 19 nt, Artificial Sequence
  Oligomer
uucuucccacgucuagcuu

SEQ ID NO: 82256 - RNA, 19 nt, Artificial Sequence
  Oligomer
uccauccaccucgauaucu

SEQ ID NO: 82257 - RNA, 19 nt, Artificial Sequence
  Oligomer
ugggcuuuucugguugagc

SEQ ID NO: 82258 - RNA, 19 nt, Artificial Sequence
  Oligomer
uuuucugguugagcccauu

SEQ ID NO: 82259 - RNA, 19 nt, Artificial Sequence
  Oligomer
auaguucucaaacacugug

SEQ ID NO: 82260 - RNA, 19 nt, Artificial Sequence
  Oligomer
agaacuguaacucugccac

SEQ ID NO: 82261 - RNA, 19 nt, Artificial Sequence
  Oligomer
uuccauccaccucgauauc

SEQ ID NO: 82262 - RNA, 19 nt, Artificial Sequence
  Oligomer
gcgaucauaaucuuccugc

SEQ ID NO: 82263 - RNA, 19 nt, Artificial Sequence
  Oligomer
acucuaccugcuuuccauc

SEQ ID NO: 82264 - RNA, 19 nt, Artificial Sequence
  Oligomer
uugcagagcagcucucgua

SEQ ID NO: 82265 - RNA, 19 nt, Artificial Sequence
  Oligomer
acacaucaguauaacaucg

SEQ ID NO: 82266 - RNA, 19 nt, Artificial Sequence
  Oligomer
accugcuuuccauccaccu

SEQ ID NO: 82267 - RNA, 19 nt, Artificial Sequence
  Oligomer
ugacucaccagaguaccuu

SEQ ID NO: 82268 - RNA, 19 nt, Artificial Sequence
  Oligomer
ucccacaaagccaacucua

SEQ ID NO: 82269 - RNA, 19 nt, Artificial Sequence
  Oligomer
aaccacagaacuguaacuc

SEQ ID NO: 82270 - RNA, 19 nt, Artificial Sequence
  Oligomer
ucaggcaacgaauccgagu

SEQ ID NO: 82271 - RNA, 19 nt, Artificial Sequence
  Oligomer
ucgauaucugccacauagu

SEQ ID NO: 82272 - RNA, 19 nt, Artificial Sequence
  Oligomer
ucaccagaguaccuugcag

SEQ ID NO: 82273 - RNA, 19 nt, Artificial Sequence
  Oligomer
ccacaaagccaacucuacc

SEQ ID NO: 82274 - RNA, 19 nt, Artificial Sequence
  Oligomer
ucuucagguuucaccggcu

SEQ ID NO: 82275 - RNA, 19 nt, Artificial Sequence
  Oligomer
cuuuccauccaccucgaua

SEQ ID NO: 82276 - RNA, 19 nt, Artificial Sequence
  Oligomer
ugagacagguuaugccauc

SEQ ID NO: 82277 - RNA, 19 nt, Artificial Sequence
  Oligomer
ucagaaaaagugacaaaac

SEQ ID NO: 82278 - RNA, 19 nt, Artificial Sequence
  Oligomer
ugcagcaagguuucacaag

SEQ ID NO: 82279 - RNA, 19 nt, Artificial Sequence
  Oligomer
uaucugccacauaguucuc

SEQ ID NO: 82280 - RNA, 19 nt, Artificial Sequence
  Oligomer
aucaguauaacaucgguau

SEQ ID NO: 82281 - RNA, 19 nt, Artificial Sequence
  Oligomer
ugccaucuuccaaaguguc

SEQ ID NO: 82282 - RNA, 19 nt, Artificial Sequence
  Oligomer
accucucucacuccaucuu

SEQ ID NO: 82283 - RNA, 19 nt, Artificial Sequence
  Oligomer
ucaguauaacaucgguauc

SEQ ID NO: 82284 - RNA, 19 nt, Artificial Sequence
  Oligomer
aagcaugucuuuccacagg

SEQ ID NO: 82285 - RNA, 19 nt, Artificial Sequence
  Oligomer
auuagcgccugguguguca

SEQ ID NO: 82286 - RNA, 19 nt, Artificial Sequence
  Oligomer
ugaauuagcgccuggugug

SEQ ID NO: 82287 - RNA, 19 nt, Artificial Sequence
  Oligomer
ucgguaucuggguaggaga

SEQ ID NO: 82288 - RNA, 19 nt, Artificial Sequence
  Oligomer
uuaugccaucuuccaaagu

SEQ ID NO: 82289 - RNA, 19 nt, Artificial Sequence
  Oligomer
guaacuaacaugaaaccac

SEQ ID NO: 82290 - RNA, 19 nt, Artificial Sequence
  Oligomer
agcacugugaauuagagcc

SEQ ID NO: 82291 - RNA, 19 nt, Artificial Sequence
  Oligomer
uccaucuuuggucuuugcu

SEQ ID NO: 82292 - RNA, 19 nt, Artificial Sequence
  Oligomer
aaaaaggccaguaaucaua

SEQ ID NO: 82293 - RNA, 19 nt, Artificial Sequence
  Oligomer
auggaaaaacacaucagua

SEQ ID NO: 82294 - RNA, 19 nt, Artificial Sequence
  Oligomer
auaacaucgguaucugggu

SEQ ID NO: 82295 - RNA, 19 nt, Artificial Sequence
  Oligomer
ugucuuuccacaggcucca

SEQ ID NO: 82296 - RNA, 19 nt, Artificial Sequence
  Oligomer
uacaccucugggaacuggu

SEQ ID NO: 82297 - RNA, 19 nt, Artificial Sequence
  Oligomer
ucauaguuggcuucuaaau

SEQ ID NO: 82298 - RNA, 19 nt, Artificial Sequence
  Oligomer
agacaaggcacccagauuu

SEQ ID NO: 82299 - RNA, 19 nt, Artificial Sequence
  Oligomer
cuugaauuagcgccuggug

SEQ ID NO: 82300 - RNA, 19 nt, Artificial Sequence
  Oligomer
ugccacagcugcaugaacu

SEQ ID NO: 82301 - RNA, 19 nt, Artificial Sequence
  Oligomer
aucauaguuggcuucuaaa

SEQ ID NO: 82302 - RNA, 19 nt, Artificial Sequence
  Oligomer
ucagcuggagagaagagag

SEQ ID NO: 82303 - RNA, 19 nt, Artificial Sequence
  Oligomer
uuagucagcuggagagaag

SEQ ID NO: 82304 - RNA, 19 nt, Artificial Sequence
  Oligomer
ucuuccaaagugucuaauu

SEQ ID NO: 82305 - RNA, 19 nt, Artificial Sequence
  Oligomer
aguuucuuccggauggcag

SEQ ID NO: 82306 - RNA, 19 nt, Artificial Sequence
  Oligomer
agauuuuuucuucccacgu

SEQ ID NO: 82307 - RNA, 19 nt, Artificial Sequence
  Oligomer
aaucaccaguuucuuccgg

SEQ ID NO: 82308 - RNA, 19 nt, Artificial Sequence
  Oligomer
uugcagcaagguuucacaa

SEQ ID NO: 82309 - RNA, 19 nt, Artificial Sequence
  Oligomer
acagauaauaggcaggaca

SEQ ID NO: 82310 - RNA, 19 nt, Artificial Sequence
  Oligomer
acaaagccaacucuaccug

SEQ ID NO: 82311 - RNA, 19 nt, Artificial Sequence
  Oligomer
uagucagcuggagagaaga

SEQ ID NO: 82312 - RNA, 19 nt, Artificial Sequence
  Oligomer
auuagagccagaugcuuaa

SEQ ID NO: 82313 - RNA, 19 nt, Artificial Sequence
  Oligomer
ccuucuucagguuucaccg

SEQ ID NO: 82314 - RNA, 19 nt, Artificial Sequence
  Oligomer
aguuggcuucuaaauacug

SEQ ID NO: 82315 - RNA, 19 nt, Artificial Sequence
  Oligomer
ccgaagauccuucuuauuc

SEQ ID NO: 82316 - RNA, 19 nt, Artificial Sequence
  Oligomer
cugauuuguaaucuuaggu

SEQ ID NO: 82317 - RNA, 19 nt, Artificial Sequence
  Oligomer
ucugccacauaguucucaa

SEQ ID NO: 82318 - RNA, 19 nt, Artificial Sequence
  Oligomer
acaugaaaccacagaacug

SEQ ID NO: 82319 - RNA, 19 nt, Artificial Sequence
  Oligomer
ucgauggaaaaacacauca

SEQ ID NO: 82320 - RNA, 19 nt, Artificial Sequence
  Oligomer
uaccuugcagcugacagau

SEQ ID NO: 82321 - RNA, 19 nt, Artificial Sequence
  Oligomer
cuagaaagaagcaagaagu

SEQ ID NO: 82322 - RNA, 19 nt, Artificial Sequence
  Oligomer
aaucuuccugcccagcugu

SEQ ID NO: 82323 - RNA, 19 nt, Artificial Sequence
  Oligomer
ugugcucaucauuccgaag

SEQ ID NO: 82324 - RNA, 19 nt, Artificial Sequence
  Oligomer
auaggcaggacauguuagu

SEQ ID NO: 82325 - RNA, 19 nt, Artificial Sequence
  Oligomer
ccucaggcgaucauaaucu

SEQ ID NO: 82326 - RNA, 19 nt, Artificial Sequence
  Oligomer
acacugugggcacauacac

SEQ ID NO: 82327 - RNA, 19 nt, Artificial Sequence
  Oligomer
ugucaaaaggacccuggug

SEQ ID NO: 82328 - RNA, 19 nt, Artificial Sequence
  Oligomer
aaaaaccucucucacucca

SEQ ID NO: 82329 - RNA, 19 nt, Artificial Sequence
  Oligomer
uuagagccagaugcuuaag

SEQ ID NO: 82330 - RNA, 19 nt, Artificial Sequence
  Oligomer
caugucuuuccacaggcuc

SEQ ID NO: 82331 - RNA, 19 nt, Artificial Sequence
  Oligomer
aggagaaaagagcacugug

SEQ ID NO: 82332 - RNA, 19 nt, Artificial Sequence
  Oligomer
aguauaacaucgguaucug

SEQ ID NO: 82333 - RNA, 19 nt, Artificial Sequence
  Oligomer
aauaggcaggacauguuag

SEQ ID NO: 82334 - RNA, 19 nt, Artificial Sequence
  Oligomer
ugacaaaacgggaauuuaa

SEQ ID NO: 82335 - RNA, 19 nt, Artificial Sequence
  Oligomer
acuaacaugaaaccacaga

SEQ ID NO: 82336 - RNA, 19 nt, Artificial Sequence
  Oligomer
gaucauaaucuuccugccc

SEQ ID NO: 82337 - RNA, 19 nt, Artificial Sequence
  Oligomer
ucacuccaucuuuggucuu

SEQ ID NO: 82338 - RNA, 19 nt, Artificial Sequence
  Oligomer
aacaugaaaccacagaacu

SEQ ID NO: 82339 - RNA, 19 nt, Artificial Sequence
  Oligomer
uaaagcccugaagugguga

SEQ ID NO: 82340 - RNA, 19 nt, Artificial Sequence
  Oligomer
uggaaaaacacaucaguau

SEQ ID NO: 82341 - RNA, 19 nt, Artificial Sequence
  Oligomer
aguuuagucagcuggagag

SEQ ID NO: 82342 - RNA, 19 nt, Artificial Sequence
  Oligomer
auugcucaggcaacgaauc

SEQ ID NO: 82343 - RNA, 19 nt, Artificial Sequence
  Oligomer
ucucaaacacugugggcac

SEQ ID NO: 82344 - RNA, 19 nt, Artificial Sequence
  Oligomer
ugaaguggugacucaccag

SEQ ID NO: 82345 - RNA, 19 nt, Artificial Sequence
  Oligomer
aauuagagccagaugcuua

SEQ ID NO: 82346 - RNA, 19 nt, Artificial Sequence
  Oligomer
cacaaagccaacucuaccu

SEQ ID NO: 82347 - RNA, 19 nt, Artificial Sequence
  Oligomer
ccagauuuuuucuucccac

SEQ ID NO: 82348 - RNA, 19 nt, Artificial Sequence
  Oligomer
uucccacgucuagcuugca

SEQ ID NO: 82349 - RNA, 19 nt, Artificial Sequence
  Oligomer
aucgguaucuggguaggag

SEQ ID NO: 82350 - RNA, 19 nt, Artificial Sequence
  Oligomer
gccuucuucagguuucacc

SEQ ID NO: 82351 - RNA, 19 nt, Artificial Sequence
  Oligomer
cacaucaguauaacaucgg

SEQ ID NO: 82352 - RNA, 19 nt, Artificial Sequence
  Oligomer
guugggacagaaaugcuug

SEQ ID NO: 82353 - RNA, 19 nt, Artificial Sequence
  Oligomer
gugcucaucauuccgaaga

SEQ ID NO: 82354 - RNA, 19 nt, Artificial Sequence
  Oligomer
augagaacugguggcuccu

SEQ ID NO: 82355 - RNA, 19 nt, Artificial Sequence
  Oligomer
agaccguggacuaacgaga

SEQ ID NO: 82356 - RNA, 19 nt, Artificial Sequence
  Oligomer
cuauuuacuuagcccagcu

SEQ ID NO: 82357 - RNA, 19 nt, Artificial Sequence
  Oligomer
acucaccagaguaccuugc

SEQ ID NO: 82358 - RNA, 19 nt, Artificial Sequence
  Oligomer
aacucuaccugcuuuccau

SEQ ID NO: 82359 - RNA, 19 nt, Artificial Sequence
  Oligomer
gauaauaggcaggacaugu

SEQ ID NO: 82360 - RNA, 19 nt, Artificial Sequence
  Oligomer
agugccacccaugagaacu

SEQ ID NO: 82361 - RNA, 19 nt, Artificial Sequence
  Oligomer
acuguaacucugccacagc

SEQ ID NO: 82362 - RNA, 19 nt, Artificial Sequence
  Oligomer
auacagugaggagaaaaga

SEQ ID NO: 82363 - RNA, 19 nt, Artificial Sequence
  Oligomer
aaguuuagucagcuggaga

SEQ ID NO: 82364 - RNA, 19 nt, Artificial Sequence
  Oligomer
aaucuguuacggaguaaag

SEQ ID NO: 82365 - RNA, 19 nt, Artificial Sequence
  Oligomer
uacggaguaaagcccugaa

SEQ ID NO: 82366 - RNA, 19 nt, Artificial Sequence
  Oligomer
uccaggugagacagguuau

SEQ ID NO: 82367 - RNA, 19 nt, Artificial Sequence
  Oligomer
cuaccugcuuuccauccac

SEQ ID NO: 82368 - RNA, 19 nt, Artificial Sequence
  Oligomer
uggccaucuuuuaucagaa

SEQ ID NO: 82369 - RNA, 19 nt, Artificial Sequence
  Oligomer
uagcaagaugacuucugau

SEQ ID NO: 82370 - RNA, 19 nt, Artificial Sequence
  Oligomer
ugguagcaagaugacuucu

SEQ ID NO: 82371 - RNA, 19 nt, Artificial Sequence
  Oligomer
cuuucuagaaagaagcaag

SEQ ID NO: 82372 - RNA, 19 nt, Artificial Sequence
  Oligomer
guggacuaacgagagaacc

SEQ ID NO: 82373 - RNA, 19 nt, Artificial Sequence
  Oligomer
cauaaucuuccugcccagc

SEQ ID NO: 82374 - RNA, 19 nt, Artificial Sequence
  Oligomer
gccauuucaaaaaccucuc

SEQ ID NO: 82375 - RNA, 19 nt, Artificial Sequence
  Oligomer
ccuauuuacuuagcccagc

SEQ ID NO: 82376 - RNA, 19 nt, Artificial Sequence
  Oligomer
agcaugucuuuccacaggc

SEQ ID NO: 82377 - RNA, 19 nt, Artificial Sequence
  Oligomer
accagaguaccuugcagcu

SEQ ID NO: 82378 - RNA, 19 nt, Artificial Sequence
  Oligomer
aacacugugggcacauaca

SEQ ID NO: 82379 - RNA, 19 nt, Artificial Sequence
  Oligomer
ugcaugaacuugggcuuuu

SEQ ID NO: 82380 - RNA, 19 nt, Artificial Sequence
  Oligomer
caugaaaccacagaacugu

SEQ ID NO: 82381 - RNA, 19 nt, Artificial Sequence
  Oligomer
gccaacucuaccugcuuuc

SEQ ID NO: 82382 - RNA, 19 nt, Artificial Sequence
  Oligomer
caaggcacccagauuuuuu

SEQ ID NO: 82383 - RNA, 19 nt, Artificial Sequence
  Oligomer
ucguagccauuucaaaaac

SEQ ID NO: 82384 - RNA, 19 nt, Artificial Sequence
  Oligomer
ccauccaccucgauaucug

SEQ ID NO: 82385 - RNA, 19 nt, Artificial Sequence
  Oligomer
caagcaugucuuuccacag

SEQ ID NO: 82386 - RNA, 19 nt, Artificial Sequence
  Oligomer
cugguagcaagaugacuuc

SEQ ID NO: 82387 - RNA, 19 nt, Artificial Sequence
  Oligomer
acaaaaucuguuacggagu

SEQ ID NO: 82388 - RNA, 19 nt, Artificial Sequence
  Oligomer
cuuuucugggauguuuucu

SEQ ID NO: 82389 - RNA, 19 nt, Artificial Sequence
  Oligomer
cauaguuggcuucuaaaua

SEQ ID NO: 82390 - RNA, 19 nt, Artificial Sequence
  Oligomer
uuuagucagcuggagagaa

SEQ ID NO: 82391 - RNA, 19 nt, Artificial Sequence
  Oligomer
cugucgauggaaaaacaca

SEQ ID NO: 82392 - RNA, 19 nt, Artificial Sequence
  Oligomer
gucuaauugccucaggcgu

SEQ ID NO: 82393 - RNA, 19 nt, Artificial Sequence
  Oligomer
cuucuucagguuucaccgg

SEQ ID NO: 82394 - RNA, 19 nt, Artificial Sequence
  Oligomer
guuagagcagugucaaaag

SEQ ID NO: 82395 - RNA, 19 nt, Artificial Sequence
  Oligomer
caacucuaccugcuuucca

SEQ ID NO: 82396 - RNA, 19 nt, Artificial Sequence
  Oligomer
ugcuuuccauccaccucga

SEQ ID NO: 82397 - RNA, 19 nt, Artificial Sequence
  Oligomer
guauaacaucgguaucugg

SEQ ID NO: 82398 - RNA, 19 nt, Artificial Sequence
  Oligomer
acagcugcaugaacuuggg

SEQ ID NO: 82399 - RNA, 19 nt, Artificial Sequence
  Oligomer
aauuagcgccugguguguc

SEQ ID NO: 82400 - RNA, 19 nt, Artificial Sequence
  Oligomer
ccaaagugucuaauugccu

SEQ ID NO: 82401 - RNA, 19 nt, Artificial Sequence
  Oligomer
ccaucuuuggucuuugcug

SEQ ID NO: 82402 - RNA, 19 nt, Artificial Sequence
  Oligomer
cuaaacuaucagggcuguc

SEQ ID NO: 82403 - RNA, 19 nt, Artificial Sequence
  Oligomer
cacuuuucugggauguuuu

SEQ ID NO: 82404 - RNA, 19 nt, Artificial Sequence
  Oligomer
agggaaccuggauacagug

SEQ ID NO: 82405 - RNA, 19 nt, Artificial Sequence
  Oligomer
aagacaaggcacccagauu

SEQ ID NO: 82406 - RNA, 19 nt, Artificial Sequence
  Oligomer
ggcuccaucaccaacaauc

SEQ ID NO: 82407 - RNA, 19 nt, Artificial Sequence
  Oligomer
agauccuucuuauucccaa

SEQ ID NO: 82408 - RNA, 19 nt, Artificial Sequence
  Oligomer
uccgaagauccuucuuauu

SEQ ID NO: 82409 - RNA, 19 nt, Artificial Sequence
  Oligomer
aacuaacaugaaaccacag

SEQ ID NO: 82410 - RNA, 19 nt, Artificial Sequence
  Oligomer
gaaaagagcacugugaauu

SEQ ID NO: 82411 - RNA, 19 nt, Artificial Sequence
  Oligomer
cugaaguggugacucacca

SEQ ID NO: 82412 - RNA, 19 nt, Artificial Sequence
  Oligomer
cuaacaugaaaccacagaa

SEQ ID NO: 82413 - RNA, 19 nt, Artificial Sequence
  Oligomer
aacuguaacucugccacag

SEQ ID NO: 82414 - RNA, 19 nt, Artificial Sequence
  Oligomer
caucauuccgaagauccuu

SEQ ID NO: 82415 - RNA, 19 nt, Artificial Sequence
  Oligomer
gagcuaugccaacaaaauc

SEQ ID NO: 82416 - RNA, 19 nt, Artificial Sequence
  Oligomer
aaugaaaaaggccaguaau

SEQ ID NO: 82417 - RNA, 19 nt, Artificial Sequence
  Oligomer
cauccaccucgauaucugc

SEQ ID NO: 82418 - RNA, 19 nt, Artificial Sequence
  Oligomer
acagaacuguaacucugcc

SEQ ID NO: 82419 - RNA, 19 nt, Artificial Sequence
  Oligomer
uagaaagaagcaagaaguu

SEQ ID NO: 82420 - RNA, 19 nt, Artificial Sequence
  Oligomer
cuugcagcaagguuucaca

SEQ ID NO: 82421 - RNA, 19 nt, Artificial Sequence
  Oligomer
gcccauuuucaaaaaacug

SEQ ID NO: 82422 - RNA, 19 nt, Artificial Sequence
  Oligomer
ucaaacacugugggcacau

SEQ ID NO: 82423 - RNA, 19 nt, Artificial Sequence
  Oligomer
gaaaugcuugacuucuggg

SEQ ID NO: 82424 - RNA, 19 nt, Artificial Sequence
  Oligomer
agugaggagaaaagagcac

SEQ ID NO: 82425 - RNA, 19 nt, Artificial Sequence
  Oligomer
gcaagcaugucuuuccaca

SEQ ID NO: 82426 - RNA, 19 nt, Artificial Sequence
  Oligomer
caugaacuugggcuuuucu

SEQ ID NO: 82427 - RNA, 19 nt, Artificial Sequence
  Oligomer
agcaagcaugucuuuccac

SEQ ID NO: 82428 - RNA, 19 nt, Artificial Sequence
  Oligomer
ucuuauucccaaccaggau

SEQ ID NO: 82429 - RNA, 19 nt, Artificial Sequence
  Oligomer
caucaguauaacaucggua

SEQ ID NO: 82430 - RNA, 19 nt, Artificial Sequence
  Oligomer
cacauaguucucaaacacu

SEQ ID NO: 82431 - RNA, 19 nt, Artificial Sequence
  Oligomer
cgugaaaccaauuccuauu

SEQ ID NO: 82432 - RNA, 19 nt, Artificial Sequence
  Oligomer
ugaauuagagccagaugcu

SEQ ID NO: 82433 - RNA, 19 nt, Artificial Sequence
  Oligomer
aucuuccaaagugucuaau

SEQ ID NO: 82434 - RNA, 19 nt, Artificial Sequence
  Oligomer
ucuaaacuaucagggcugu

SEQ ID NO: 82435 - RNA, 19 nt, Artificial Sequence
  Oligomer
ugagugccacccaugagaa

SEQ ID NO: 82436 - RNA, 19 nt, Artificial Sequence
  Oligomer
ugggacagaaaugcuugac

SEQ ID NO: 82437 - RNA, 19 nt, Artificial Sequence
  Oligomer
gcagcugacagauaauagg

SEQ ID NO: 82438 - RNA, 19 nt, Artificial Sequence
  Oligomer
aguaaagcccugaaguggu

SEQ ID NO: 82439 - RNA, 19 nt, Artificial Sequence
  Oligomer
caagguuucacaagacaag

SEQ ID NO: 82440 - RNA, 19 nt, Artificial Sequence
  Oligomer
ugccuucuucagguuucac

SEQ ID NO: 82441 - RNA, 19 nt, Artificial Sequence
  Oligomer
agacagguuaugccaucuu

SEQ ID NO: 82442 - RNA, 19 nt, Artificial Sequence
  Oligomer
agcccauuuucaaaaaacu

SEQ ID NO: 82443 - RNA, 19 nt, Artificial Sequence
  Oligomer
agcuggagagaagagagac

SEQ ID NO: 82444 - RNA, 19 nt, Artificial Sequence
  Oligomer
ugguugagcccauuuucaa

SEQ ID NO: 82445 - RNA, 19 nt, Artificial Sequence
  Oligomer
acuuucuuugaggaugaca

SEQ ID NO: 82446 - RNA, 19 nt, Artificial Sequence
  Oligomer
caccaguuucuuccggaug

SEQ ID NO: 82447 - RNA, 19 nt, Artificial Sequence
  Oligomer
acauacaccucugggaacu

SEQ ID NO: 82448 - RNA, 19 nt, Artificial Sequence
  Oligomer
cugguugagcccauuuuca

SEQ ID NO: 82449 - RNA, 19 nt, Artificial Sequence
  Oligomer
ccuugaauuagcgccuggu

SEQ ID NO: 82450 - RNA, 19 nt, Artificial Sequence
  Oligomer
agccagaugcuuaagucca

SEQ ID NO: 82451 - RNA, 19 nt, Artificial Sequence
  Oligomer
aagagcacugugaauuaga

SEQ ID NO: 82452 - RNA, 19 nt, Artificial Sequence
  Oligomer
cugccuuuauucuauuagu

SEQ ID NO: 82453 - RNA, 19 nt, Artificial Sequence
  Oligomer
cccagauuuuuucuuccca

SEQ ID NO: 82454 - RNA, 19 nt, Artificial Sequence
  Oligomer
gacagguuaugccaucuuc

SEQ ID NO: 82455 - RNA, 19 nt, Artificial Sequence
  Oligomer
guaccuugcagcugacaga

SEQ ID NO: 82456 - RNA, 19 nt, Artificial Sequence
  Oligomer
ucaccaguuucuuccggau

SEQ ID NO: 82457 - RNA, 19 nt, Artificial Sequence
  Oligomer
ucuuucuagaaagaagcaa

SEQ ID NO: 82458 - RNA, 19 nt, Artificial Sequence
  Oligomer
aggcacccagauuuuuucu

SEQ ID NO: 82459 - RNA, 19 nt, Artificial Sequence
  Oligomer
acgucuagcuugcagagca

SEQ ID NO: 82460 - RNA, 19 nt, Artificial Sequence
  Oligomer
ugaaaccacagaacuguaa

SEQ ID NO: 82461 - RNA, 19 nt, Artificial Sequence
  Oligomer
acagcacuucaaaauuaac

SEQ ID NO: 82462 - RNA, 19 nt, Artificial Sequence
  Oligomer
acugguacagaaaaaaagu

SEQ ID NO: 82463 - RNA, 19 nt, Artificial Sequence
  Oligomer
agauaauaggcaggacaug

SEQ ID NO: 82464 - RNA, 19 nt, Artificial Sequence
  Oligomer
aaaagagcacugugaauua

SEQ ID NO: 82465 - RNA, 19 nt, Artificial Sequence
  Oligomer
aagcccugaaguggugacu

SEQ ID NO: 82466 - RNA, 19 nt, Artificial Sequence
  Oligomer
caaaauuaaccgcauaagg

SEQ ID NO: 82467 - RNA, 19 nt, Artificial Sequence
  Oligomer
gauacagugaggagaaaag

SEQ ID NO: 82468 - RNA, 19 nt, Artificial Sequence
  Oligomer
ccaucuuccaaagugucua

SEQ ID NO: 82469 - RNA, 19 nt, Artificial Sequence
  Oligomer
guaauauggccaucuuuua

SEQ ID NO: 82470 - RNA, 19 nt, Artificial Sequence
  Oligomer
gaacuugggcuuuucuggu

SEQ ID NO: 82471 - RNA, 19 nt, Artificial Sequence
  Oligomer
agaagcaagaaguuaagaa

SEQ ID NO: 82472 - RNA, 19 nt, Artificial Sequence
  Oligomer
acaucgguaucuggguagg

SEQ ID NO: 82473 - RNA, 19 nt, Artificial Sequence
  Oligomer
gaaguggugacucaccaga

SEQ ID NO: 82474 - RNA, 19 nt, Artificial Sequence
  Oligomer
ugugucccacaaagccaac

SEQ ID NO: 82475 - RNA, 19 nt, Artificial Sequence
  Oligomer
ccaacucuaccugcuuucc

SEQ ID NO: 82476 - RNA, 19 nt, Artificial Sequence
  Oligomer
gccuuuauucuauuaguag

SEQ ID NO: 82477 - RNA, 19 nt, Artificial Sequence
  Oligomer
aaaucuguuacggaguaaa

SEQ ID NO: 82478 - RNA, 19 nt, Artificial Sequence
  Oligomer
agccaacucuaccugcuuu

SEQ ID NO: 82479 - RNA, 19 nt, Artificial Sequence
  Oligomer
gaaagaagcaagaaguuaa

SEQ ID NO: 82480 - RNA, 19 nt, Artificial Sequence
  Oligomer
gauccuucuuauucccaac

SEQ ID NO: 82481 - RNA, 19 nt, Artificial Sequence
  Oligomer
guuaugccaucuuccaaag

SEQ ID NO: 82482 - RNA, 19 nt, Artificial Sequence
  Oligomer
aaagcccugaaguggugac

SEQ ID NO: 82483 - RNA, 19 nt, Artificial Sequence
  Oligomer
cucguagccauuucaaaaa

SEQ ID NO: 82484 - RNA, 19 nt, Artificial Sequence
  Oligomer
aguucucaaacacuguggg

SEQ ID NO: 82485 - RNA, 19 nt, Artificial Sequence
  Oligomer
cguagccauuucaaaaacc

SEQ ID NO: 82486 - RNA, 19 nt, Artificial Sequence
  Oligomer
cagguuaugccaucuucca

SEQ ID NO: 82487 - RNA, 19 nt, Artificial Sequence
  Oligomer
agagcuaugccaacaaaau

SEQ ID NO: 82488 - RNA, 19 nt, Artificial Sequence
  Oligomer
gguaauauggccaucuuuu

SEQ ID NO: 82489 - RNA, 19 nt, Artificial Sequence
  Oligomer
cuuugaggaugacaguauu

SEQ ID NO: 82490 - RNA, 19 nt, Artificial Sequence
  Oligomer
cauugcucaggcaacgaau

SEQ ID NO: 82491 - RNA, 19 nt, Artificial Sequence
  Oligomer
ucagggcugucgauggaaa

SEQ ID NO: 82492 - RNA, 19 nt, Artificial Sequence
  Oligomer
ccuucuuauucccaaccag

SEQ ID NO: 82493 - RNA, 19 nt, Artificial Sequence
  Oligomer
auacacuuucuuugaggau

SEQ ID NO: 82494 - RNA, 19 nt, Artificial Sequence
  Oligomer
ccacauaguucucaaacac

SEQ ID NO: 82495 - RNA, 19 nt, Artificial Sequence
  Oligomer
acaguauuaggaaauccaa

SEQ ID NO: 82496 - RNA, 19 nt, Artificial Sequence
  Oligomer
gcuugcagcaagguuucac

SEQ ID NO: 82497 - RNA, 19 nt, Artificial Sequence
  Oligomer
aucagggcugucgauggaa

SEQ ID NO: 82498 - RNA, 19 nt, Artificial Sequence
  Oligomer
acaagacaaggcacccaga

SEQ ID NO: 82499 - RNA, 19 nt, Artificial Sequence
  Oligomer
uaacaucgguaucugggua

SEQ ID NO: 82500 - RNA, 19 nt, Artificial Sequence
  Oligomer
acggaguaaagcccugaag

SEQ ID NO: 82501 - RNA, 19 nt, Artificial Sequence
  Oligomer
acaaggcacccagauuuuu

SEQ ID NO: 82502 - RNA, 19 nt, Artificial Sequence
  Oligomer
gagcagugucaaaaggacc

SEQ ID NO: 82503 - RNA, 19 nt, Artificial Sequence
  Oligomer
cccacaaagccaacucuac

SEQ ID NO: 82504 - RNA, 19 nt, Artificial Sequence
  Oligomer
aauccgaguccagccucuu

SEQ ID NO: 82505 - RNA, 21 nt, Artificial Sequence
  Oligomer
gaccaaagauggagugagaga

SEQ ID NO: 82506 - RNA, 21 nt, Artificial Sequence
  Oligomer
gagugagagagguuuuugaaa

SEQ ID NO: 82507 - RNA, 21 nt, Artificial Sequence
  Oligomer
cauggagcugggcuaaguaaa

SEQ ID NO: 82508 - RNA, 21 nt, Artificial Sequence
  Oligomer
ggaaauaaagucagauggaaa

SEQ ID NO: 82509 - RNA, 21 nt, Artificial Sequence
  Oligomer
caaagauggagugagagaggu

SEQ ID NO: 82510 - RNA, 21 nt, Artificial Sequence
  Oligomer
guacauggaguguucagcaaa

SEQ ID NO: 82511 - RNA, 21 nt, Artificial Sequence
  Oligomer
ccacuuaauguauguuaccaa

SEQ ID NO: 82512 - RNA, 21 nt, Artificial Sequence
  Oligomer
gcuucuuucuagaaagagaaa

SEQ ID NO: 82513 - RNA, 21 nt, Artificial Sequence
  Oligomer
gaaggaucuucggaaugauga

SEQ ID NO: 82514 - RNA, 21 nt, Artificial Sequence
  Oligomer
gguggauggaaagcagguaga

SEQ ID NO: 82515 - RNA, 21 nt, Artificial Sequence
  Oligomer
ccauggagcugggcuaaguaa

SEQ ID NO: 82516 - RNA, 21 nt, Artificial Sequence
  Oligomer
gguacauggaguguucagcaa

SEQ ID NO: 82517 - RNA, 21 nt, Artificial Sequence
  Oligomer
cauccugguugggaauaagaa

SEQ ID NO: 82518 - RNA, 21 nt, Artificial Sequence
  Oligomer
cuaccaguauuuagaagccaa

SEQ ID NO: 82519 - RNA, 21 nt, Artificial Sequence
  Oligomer
cccugauaguuuagaaaacau

SEQ ID NO: 82520 - RNA, 21 nt, Artificial Sequence
  Oligomer
ggagugagagagguuuuugaa

SEQ ID NO: 82521 - RNA, 21 nt, Artificial Sequence
  Oligomer
guuugagaacuauguggcaga

SEQ ID NO: 82522 - RNA, 21 nt, Artificial Sequence
  Oligomer
caugcagcuguggcagaguua

SEQ ID NO: 82523 - RNA, 21 nt, Artificial Sequence
  Oligomer
agaaggcagagauauggcaaa

SEQ ID NO: 82524 - RNA, 21 nt, Artificial Sequence
  Oligomer
cagcccugauaguuuagaaaa

SEQ ID NO: 82525 - RNA, 21 nt, Artificial Sequence
  Oligomer
cagauaucgagguggauggaa

SEQ ID NO: 82526 - RNA, 21 nt, Artificial Sequence
  Oligomer
gcagagauauggcaaacagga

SEQ ID NO: 82527 - RNA, 21 nt, Artificial Sequence
  Oligomer
agauaucgagguggauggaaa

SEQ ID NO: 82528 - RNA, 21 nt, Artificial Sequence
  Oligomer
guuuuugaaauggcuacgaga

SEQ ID NO: 82529 - RNA, 21 nt, Artificial Sequence
  Oligomer
gcugggcuaaguaaauaggaa

SEQ ID NO: 82530 - RNA, 21 nt, Artificial Sequence
  Oligomer
cagagauauggcaaacaggau

SEQ ID NO: 82531 - RNA, 21 nt, Artificial Sequence
  Oligomer
gaacuauguggcagauaucga

SEQ ID NO: 82532 - RNA, 21 nt, Artificial Sequence
  Oligomer
gguagaguuggcuuuguggga

SEQ ID NO: 82533 - RNA, 21 nt, Artificial Sequence
  Oligomer
gaagaaggcagagauauggca

SEQ ID NO: 82534 - RNA, 21 nt, Artificial Sequence
  Oligomer
ggagcugggcuaaguaaauag

SEQ ID NO: 82535 - RNA, 21 nt, Artificial Sequence
  Oligomer
cgauguuauacugauguguuu

SEQ ID NO: 82536 - RNA, 21 nt, Artificial Sequence
  Oligomer
gauggagugagagagguuuuu

SEQ ID NO: 82537 - RNA, 21 nt, Artificial Sequence
  Oligomer
agagcugcucugcaagcuaga

SEQ ID NO: 82538 - RNA, 21 nt, Artificial Sequence
  Oligomer
gagccggugaaaccugaagaa

SEQ ID NO: 82539 - RNA, 21 nt, Artificial Sequence
  Oligomer
ggauggaaagcagguagaguu

SEQ ID NO: 82540 - RNA, 21 nt, Artificial Sequence
  Oligomer
caggauuggcgcuuuugggua

SEQ ID NO: 82541 - RNA, 21 nt, Artificial Sequence
  Oligomer
cggugaaaccugaagaaggca

SEQ ID NO: 82542 - RNA, 21 nt, Artificial Sequence
  Oligomer
cugggcuaaguaaauaggaau

SEQ ID NO: 82543 - RNA, 21 nt, Artificial Sequence
  Oligomer
ccaguauuuagaagccaacua

SEQ ID NO: 82544 - RNA, 21 nt, Artificial Sequence
  Oligomer
gaggcaauuagacacuuugga

SEQ ID NO: 82545 - RNA, 21 nt, Artificial Sequence
  Oligomer
gaguguucagcaaagaccaaa

SEQ ID NO: 82546 - RNA, 21 nt, Artificial Sequence
  Oligomer
uggaaagacaugcuugcucau

SEQ ID NO: 82547 - RNA, 21 nt, Artificial Sequence
  Oligomer
cacagcugggcaggaagauua

SEQ ID NO: 82548 - RNA, 21 nt, Artificial Sequence
  Oligomer
uggagugagagagguuuuuga

SEQ ID NO: 82549 - RNA, 21 nt, Artificial Sequence
  Oligomer
guguaauuagugccacuuaau

SEQ ID NO: 82550 - RNA, 21 nt, Artificial Sequence
  Oligomer
gagaaacaguugguaacuuuu

SEQ ID NO: 82551 - RNA, 21 nt, Artificial Sequence
  Oligomer
guuuagaaaacaucccagaaa

SEQ ID NO: 82552 - RNA, 21 nt, Artificial Sequence
  Oligomer
auacugucauccucaaagaaa

SEQ ID NO: 82553 - RNA, 21 nt, Artificial Sequence
  Oligomer
ggaguguucagcaaagaccaa

SEQ ID NO: 82554 - RNA, 21 nt, Artificial Sequence
  Oligomer
aauacugucauccucaaagaa

SEQ ID NO: 82555 - RNA, 21 nt, Artificial Sequence
  Oligomer
ggcagagauauggcaaacagg

SEQ ID NO: 82556 - RNA, 21 nt, Artificial Sequence
  Oligomer
acagcugggcaggaagauuau

SEQ ID NO: 82557 - RNA, 21 nt, Artificial Sequence
  Oligomer
gaagucaucuugcuaccagua

SEQ ID NO: 82558 - RNA, 21 nt, Artificial Sequence
  Oligomer
gcaagguacucuggugaguca

SEQ ID NO: 82559 - RNA, 21 nt, Artificial Sequence
  Oligomer
cuguguaauuagugccacuua

SEQ ID NO: 82560 - RNA, 21 nt, Artificial Sequence
  Oligomer
agcugggcaggaagauuauga

SEQ ID NO: 82561 - RNA, 21 nt, Artificial Sequence
  Oligomer
gauggagccuguggaaagaca

SEQ ID NO: 82562 - RNA, 21 nt, Artificial Sequence
  Oligomer
ggguacauggaguguucagca

SEQ ID NO: 82563 - RNA, 21 nt, Artificial Sequence
  Oligomer
agcugggcuaaguaaauagga

SEQ ID NO: 82564 - RNA, 21 nt, Artificial Sequence
  Oligomer
agaggagccaccaguucucau

SEQ ID NO: 82565 - RNA, 21 nt, Artificial Sequence
  Oligomer
cccagauaccgauguuauacu

SEQ ID NO: 82566 - RNA, 21 nt, Artificial Sequence
  Oligomer
ggaagaaacuggugauuguug

SEQ ID NO: 82567 - RNA, 21 nt, Artificial Sequence
  Oligomer
auggcugccauccggaagaaa

SEQ ID NO: 82568 - RNA, 21 nt, Artificial Sequence
  Oligomer
agagaaacaguugguaacuuu

SEQ ID NO: 82569 - RNA, 21 nt, Artificial Sequence
  Oligomer
caucgacagcccugauaguuu

SEQ ID NO: 82570 - RNA, 21 nt, Artificial Sequence
  Oligomer
acagcccugauaguuuagaaa

SEQ ID NO: 82571 - RNA, 21 nt, Artificial Sequence
  Oligomer
ccggaagaaacuggugauugu

SEQ ID NO: 82572 - RNA, 21 nt, Artificial Sequence
  Oligomer
uagaguuggcuuugugggaca

SEQ ID NO: 82573 - RNA, 21 nt, Artificial Sequence
  Oligomer
ggauuggcgcuuuuggguaca

SEQ ID NO: 82574 - RNA, 21 nt, Artificial Sequence
  Oligomer
gcugggcaggaagauuaugau

SEQ ID NO: 82575 - RNA, 21 nt, Artificial Sequence
  Oligomer
cuuuugugaauuaggcuguaa

SEQ ID NO: 82576 - RNA, 21 nt, Artificial Sequence
  Oligomer
caugcuugcucauagucuuca

SEQ ID NO: 82577 - RNA, 21 nt, Artificial Sequence
  Oligomer
uggugauggagccuguggaaa

SEQ ID NO: 82578 - RNA, 21 nt, Artificial Sequence
  Oligomer
aaaaugggcucaaccagaaaa

SEQ ID NO: 82579 - RNA, 21 nt, Artificial Sequence
  Oligomer
accugucucaccuggacuuaa

SEQ ID NO: 82580 - RNA, 21 nt, Artificial Sequence
  Oligomer
ggcuguaacuacuuuauaacu

SEQ ID NO: 82581 - RNA, 21 nt, Artificial Sequence
  Oligomer
acaguugguaacuuuugugaa

SEQ ID NO: 82582 - RNA, 21 nt, Artificial Sequence
  Oligomer
guggcagauaucgagguggau

SEQ ID NO: 82583 - RNA, 21 nt, Artificial Sequence
  Oligomer
aagucaucuugcuaccaguau

SEQ ID NO: 82584 - RNA, 21 nt, Artificial Sequence
  Oligomer
aguuuagaaaacaucccagaa

SEQ ID NO: 82585 - RNA, 21 nt, Artificial Sequence
  Oligomer
gcuaaguaaauaggaauuggu

SEQ ID NO: 82586 - RNA, 21 nt, Artificial Sequence
  Oligomer
cacgccugaggcaauuagaca

SEQ ID NO: 82587 - RNA, 21 nt, Artificial Sequence
  Oligomer
agaaagagaaacaguugguaa

SEQ ID NO: 82588 - RNA, 21 nt, Artificial Sequence
  Oligomer
caguugguaacuuuugugaau

SEQ ID NO: 82589 - RNA, 21 nt, Artificial Sequence
  Oligomer
gaauuaggcuguaacuacuuu

SEQ ID NO: 82590 - RNA, 21 nt, Artificial Sequence
  Oligomer
gacagcccugauaguuuagaa

SEQ ID NO: 82591 - RNA, 21 nt, Artificial Sequence
  Oligomer
agaagucaucuugcuaccagu

SEQ ID NO: 82592 - RNA, 21 nt, Artificial Sequence
  Oligomer
caucauccugguugggaauaa

SEQ ID NO: 82593 - RNA, 21 nt, Artificial Sequence
  Oligomer
ugcuucuuucuagaaagagaa

SEQ ID NO: 82594 - RNA, 21 nt, Artificial Sequence
  Oligomer
ucuugugaaaccuugcugcaa

SEQ ID NO: 82595 - RNA, 21 nt, Artificial Sequence
  Oligomer
cagauaccgauguuauacuga

SEQ ID NO: 82596 - RNA, 21 nt, Artificial Sequence
  Oligomer
cggaagaaacuggugauuguu

SEQ ID NO: 82597 - RNA, 21 nt, Artificial Sequence
  Oligomer
ugaauuaggcuguaacuacuu

SEQ ID NO: 82598 - RNA, 21 nt, Artificial Sequence
  Oligomer
acuuaagcaucuggcucuaau

SEQ ID NO: 82599 - RNA, 21 nt, Artificial Sequence
  Oligomer
gaaagagaaacaguugguaac

SEQ ID NO: 82600 - RNA, 21 nt, Artificial Sequence
  Oligomer
gauuggcgcuuuuggguacau

SEQ ID NO: 82601 - RNA, 21 nt, Artificial Sequence
  Oligomer
uugagaacuauguggcagaua

SEQ ID NO: 82602 - RNA, 21 nt, Artificial Sequence
  Oligomer
gguuucauguuaguuaccuua

SEQ ID NO: 82603 - RNA, 21 nt, Artificial Sequence
  Oligomer
aagaccaaagauggagugaga

SEQ ID NO: 82604 - RNA, 21 nt, Artificial Sequence
  Oligomer
ggugaaaccugaagaaggcag

SEQ ID NO: 82605 - RNA, 21 nt, Artificial Sequence
  Oligomer
aagaaggcagagauauggcaa

SEQ ID NO: 82606 - RNA, 21 nt, Artificial Sequence
  Oligomer
gauaaaagauggccauauuac

SEQ ID NO: 82607 - RNA, 21 nt, Artificial Sequence
  Oligomer
uguucagcaaagaccaaagau

SEQ ID NO: 82608 - RNA, 21 nt, Artificial Sequence
  Oligomer
uaugauuacuggccuuuuuca

SEQ ID NO: 82609 - RNA, 21 nt, Artificial Sequence
  Oligomer
agauaccgauguuauacugau

SEQ ID NO: 82610 - RNA, 21 nt, Artificial Sequence
  Oligomer
ggaagauuaugaucgccugag

SEQ ID NO: 82611 - RNA, 21 nt, Artificial Sequence
  Oligomer
uggaaauaaagucagauggaa

SEQ ID NO: 82612 - RNA, 21 nt, Artificial Sequence
  Oligomer
ccagacuagauguaguauuuu

SEQ ID NO: 82613 - RNA, 21 nt, Artificial Sequence
  Oligomer
caguucugugguuucauguua

SEQ ID NO: 82614 - RNA, 21 nt, Artificial Sequence
  Oligomer
gcaggaagauuaugaucgccu

SEQ ID NO: 82615 - RNA, 21 nt, Artificial Sequence
  Oligomer
cuauguggcagauaucgaggu

SEQ ID NO: 82616 - RNA, 21 nt, Artificial Sequence
  Oligomer
ucuugcuaccaguauuuagaa

SEQ ID NO: 82617 - RNA, 21 nt, Artificial Sequence
  Oligomer
gcagauaucgagguggaugga

SEQ ID NO: 82618 - RNA, 21 nt, Artificial Sequence
  Oligomer
guguuugagaacuauguggca

SEQ ID NO: 82619 - RNA, 21 nt, Artificial Sequence
  Oligomer
uggcgcuuuuggguacaugga

SEQ ID NO: 82620 - RNA, 21 nt, Artificial Sequence
  Oligomer
aaggcagagauauggcaaaca

SEQ ID NO: 82621 - RNA, 21 nt, Artificial Sequence
  Oligomer
agagauauggcaaacaggauu

SEQ ID NO: 82622 - RNA, 21 nt, Artificial Sequence
  Oligomer
ucugcaagcuagacgugggaa

SEQ ID NO: 82623 - RNA, 21 nt, Artificial Sequence
  Oligomer
uguguaauuagugccacuuaa

SEQ ID NO: 82624 - RNA, 21 nt, Artificial Sequence
  Oligomer
gacacaccaggcgcuaauuca

SEQ ID NO: 82625 - RNA, 21 nt, Artificial Sequence
  Oligomer
guggaaagacaugcuugcuca

SEQ ID NO: 82626 - RNA, 21 nt, Artificial Sequence
  Oligomer
gugaaaccugaagaaggcaga

SEQ ID NO: 82627 - RNA, 21 nt, Artificial Sequence
  Oligomer
gcccugauaguuuagaaaaca

SEQ ID NO: 82628 - RNA, 21 nt, Artificial Sequence
  Oligomer
agauuuuguuggcauagcucu

SEQ ID NO: 82629 - RNA, 21 nt, Artificial Sequence
  Oligomer
ggaaagacaugcuugcucaua

SEQ ID NO: 82630 - RNA, 21 nt, Artificial Sequence
  Oligomer
ugagaacuauguggcagauau

SEQ ID NO: 82631 - RNA, 21 nt, Artificial Sequence
  Oligomer
gcagguagaguuggcuuugug

SEQ ID NO: 82632 - RNA, 21 nt, Artificial Sequence
  Oligomer
uggagcugggcuaaguaaaua

SEQ ID NO: 82633 - RNA, 21 nt, Artificial Sequence
  Oligomer
ucagcaaagaccaaagaugga

SEQ ID NO: 82634 - RNA, 21 nt, Artificial Sequence
  Oligomer
agugagagagguuuuugaaau

SEQ ID NO: 82635 - RNA, 21 nt, Artificial Sequence
  Oligomer
aguucaugcagcuguggcaga

SEQ ID NO: 82636 - RNA, 21 nt, Artificial Sequence
  Oligomer
gaaacaguugguaacuuuugu

SEQ ID NO: 82637 - RNA, 21 nt, Artificial Sequence
  Oligomer
guuacaguucugugguuucau

SEQ ID NO: 82638 - RNA, 21 nt, Artificial Sequence
  Oligomer
auaacuaacauguccugccua

SEQ ID NO: 82639 - RNA, 21 nt, Artificial Sequence
  Oligomer
gcgcuuuuggguacauggagu

SEQ ID NO: 82640 - RNA, 21 nt, Artificial Sequence
  Oligomer
uugaaaaugggcucaaccaga

SEQ ID NO: 82641 - RNA, 21 nt, Artificial Sequence
  Oligomer
gagguggauggaaagcaggua

SEQ ID NO: 82642 - RNA, 21 nt, Artificial Sequence
  Oligomer
gauaucgagguggauggaaag

SEQ ID NO: 82643 - RNA, 21 nt, Artificial Sequence
  Oligomer
guucugugguuucauguuagu

SEQ ID NO: 82644 - RNA, 21 nt, Artificial Sequence
  Oligomer
uuaucugucagcugcaaggua

SEQ ID NO: 82645 - RNA, 21 nt, Artificial Sequence
  Oligomer
uacccagauaccgauguuaua

SEQ ID NO: 82646 - RNA, 21 nt, Artificial Sequence
  Oligomer
ucugggugccuugucuuguga

SEQ ID NO: 82647 - RNA, 21 nt, Artificial Sequence
  Oligomer
gaguuggcuuugugggacaca

SEQ ID NO: 82648 - RNA, 21 nt, Artificial Sequence
  Oligomer
agugccacuuaauguauguua

SEQ ID NO: 82649 - RNA, 21 nt, Artificial Sequence
  Oligomer
agcugcaagguacucugguga

SEQ ID NO: 82650 - RNA, 21 nt, Artificial Sequence
  Oligomer
cgcuuuuggguacauggagug

SEQ ID NO: 82651 - RNA, 21 nt, Artificial Sequence
  Oligomer
gcaaacaggauuggcgcuuuu

SEQ ID NO: 82652 - RNA, 21 nt, Artificial Sequence
  Oligomer
cucuccuacccagauaccgau

SEQ ID NO: 82653 - RNA, 21 nt, Artificial Sequence
  Oligomer
gaaacuggugauuguugguga

SEQ ID NO: 82654 - RNA, 21 nt, Artificial Sequence
  Oligomer
ccauccggaagaaacugguga

SEQ ID NO: 82655 - RNA, 21 nt, Artificial Sequence
  Oligomer
agguguaugugcccacagugu

SEQ ID NO: 82656 - RNA, 21 nt, Artificial Sequence
  Oligomer
gaaaccugaagaaggcagaga

SEQ ID NO: 82657 - RNA, 21 nt, Artificial Sequence
  Oligomer
gcuugcucauagucuucagca

SEQ ID NO: 82658 - RNA, 21 nt, Artificial Sequence
  Oligomer
guaugauuacuggccuuuuuc

SEQ ID NO: 82659 - RNA, 21 nt, Artificial Sequence
  Oligomer
acaggauuggcgcuuuugggu

SEQ ID NO: 82660 - RNA, 21 nt, Artificial Sequence
  Oligomer
uggaguguucagcaaagacca

SEQ ID NO: 82661 - RNA, 21 nt, Artificial Sequence
  Oligomer
gcccacaguguuugagaacua

SEQ ID NO: 82662 - RNA, 21 nt, Artificial Sequence
  Oligomer
cauggaguguucagcaaagac

SEQ ID NO: 82663 - RNA, 21 nt, Artificial Sequence
  Oligomer
cuucuugcuucuuucuagaaa

SEQ ID NO: 82664 - RNA, 21 nt, Artificial Sequence
  Oligomer
ccacaguguuugagaacuaug

SEQ ID NO: 82665 - RNA, 21 nt, Artificial Sequence
  Oligomer
ccuacccagauaccgauguua

SEQ ID NO: 82666 - RNA, 21 nt, Artificial Sequence
  Oligomer
aaaacaucccagaaaagugga

SEQ ID NO: 82667 - RNA, 21 nt, Artificial Sequence
  Oligomer
uaguuuagaaaacaucccaga

SEQ ID NO: 82668 - RNA, 21 nt, Artificial Sequence
  Oligomer
ggugauuguuggugauggagc

SEQ ID NO: 82669 - RNA, 21 nt, Artificial Sequence
  Oligomer
uucucauggguggcacucagu

SEQ ID NO: 82670 - RNA, 21 nt, Artificial Sequence
  Oligomer
acauggaguguucagcaaaga

SEQ ID NO: 82671 - RNA, 21 nt, Artificial Sequence
  Oligomer
cuguaccaguuaauuuuucca

SEQ ID NO: 82672 - RNA, 21 nt, Artificial Sequence
  Oligomer
uuuugaaaaugggcucaacca

SEQ ID NO: 82673 - RNA, 21 nt, Artificial Sequence
  Oligomer
agcuguggcagaguuacaguu

SEQ ID NO: 82674 - RNA, 21 nt, Artificial Sequence
  Oligomer
cagguagaguuggcuuugugg

SEQ ID NO: 82675 - RNA, 21 nt, Artificial Sequence
  Oligomer
gugaauuaggcuguaacuacu

SEQ ID NO: 82676 - RNA, 21 nt, Artificial Sequence
  Oligomer
ucggaaugaugagcacacaag

SEQ ID NO: 82677 - RNA, 21 nt, Artificial Sequence
  Oligomer
cccacaguguuugagaacuau

SEQ ID NO: 82678 - RNA, 21 nt, Artificial Sequence
  Oligomer
uaagcaucuggcucuaauuca

SEQ ID NO: 82679 - RNA, 21 nt, Artificial Sequence
  Oligomer
gucucaccuggacuuaagcau

SEQ ID NO: 82680 - RNA, 21 nt, Artificial Sequence
  Oligomer
gauaguuuagaaaacauccca

SEQ ID NO: 82681 - RNA, 21 nt, Artificial Sequence
  Oligomer
cuacccagauaccgauguuau

SEQ ID NO: 82682 - RNA, 21 nt, Artificial Sequence
  Oligomer
gagucaccacuucagggcuuu

SEQ ID NO: 82683 - RNA, 21 nt, Artificial Sequence
  Oligomer
gagagagguuuuugaaauggc

SEQ ID NO: 82684 - RNA, 21 nt, Artificial Sequence
  Oligomer
aguucugugguuucauguuag

SEQ ID NO: 82685 - RNA, 21 nt, Artificial Sequence
  Oligomer
auggagcugggcuaaguaaau

SEQ ID NO: 82686 - RNA, 21 nt, Artificial Sequence
  Oligomer
aagucaagcauuucuguccca

SEQ ID NO: 82687 - RNA, 21 nt, Artificial Sequence
  Oligomer
uguggcagauaucgaggugga

SEQ ID NO: 82688 - RNA, 21 nt, Artificial Sequence
  Oligomer
cuggugauuguuggugaugga

SEQ ID NO: 82689 - RNA, 21 nt, Artificial Sequence
  Oligomer
uguccugccuauuaucuguca

SEQ ID NO: 82690 - RNA, 21 nt, Artificial Sequence
  Oligomer
agagguguaugugcccacagu

SEQ ID NO: 82691 - RNA, 21 nt, Artificial Sequence
  Oligomer
ccuaagauuacaaaucagaag

SEQ ID NO: 82692 - RNA, 21 nt, Artificial Sequence
  Oligomer
caguguuugagaacuaugugg

SEQ ID NO: 82693 - RNA, 21 nt, Artificial Sequence
  Oligomer
ccgauguuauacugauguguu

SEQ ID NO: 82694 - RNA, 21 nt, Artificial Sequence
  Oligomer
agagguuuuugaaauggcuac

SEQ ID NO: 82695 - RNA, 21 nt, Artificial Sequence
  Oligomer
uaacuaacauguccugccuau

SEQ ID NO: 82696 - RNA, 21 nt, Artificial Sequence
  Oligomer
guaauuagugccacuuaaugu

SEQ ID NO: 82697 - RNA, 21 nt, Artificial Sequence
  Oligomer
cuugcucauagucuucagcaa

SEQ ID NO: 82698 - RNA, 21 nt, Artificial Sequence
  Oligomer
uuccuaauacugucauccuca

SEQ ID NO: 82699 - RNA, 21 nt, Artificial Sequence
  Oligomer
uggugauuguuggugauggag

SEQ ID NO: 82700 - RNA, 21 nt, Artificial Sequence
  Oligomer
auggagccuguggaaagacau

SEQ ID NO: 82701 - RNA, 21 nt, Artificial Sequence
  Oligomer
ccagaagucaagcauuucugu

SEQ ID NO: 82702 - RNA, 21 nt, Artificial Sequence
  Oligomer
aucugucagcugcaagguacu

SEQ ID NO: 82703 - RNA, 21 nt, Artificial Sequence
  Oligomer
uguuuuuccaucgacagcccu

SEQ ID NO: 82704 - RNA, 21 nt, Artificial Sequence
  Oligomer
aacaguugguaacuuuuguga

SEQ ID NO: 82705 - RNA, 21 nt, Artificial Sequence
  Oligomer
gcucauagucuucagcaagga

SEQ ID NO: 82706 - RNA, 21 nt, Artificial Sequence
  Oligomer
cggauucguugccugagcaau

SEQ ID NO: 82707 - RNA, 21 nt, Artificial Sequence
  Oligomer
accugaagaaggcagagauau

SEQ ID NO: 82708 - RNA, 21 nt, Artificial Sequence
  Oligomer
cauagucuucagcaaggacca

SEQ ID NO: 82709 - RNA, 21 nt, Artificial Sequence
  Oligomer
aggaagauuaugaucgccuga

SEQ ID NO: 82710 - RNA, 21 nt, Artificial Sequence
  Oligomer
gaaaaaaucugggugccuugu

SEQ ID NO: 82711 - RNA, 21 nt, Artificial Sequence
  Oligomer
gccacuuaauguauguuacca

SEQ ID NO: 82712 - RNA, 21 nt, Artificial Sequence
  Oligomer
ucugugguuucauguuaguua

SEQ ID NO: 82713 - RNA, 21 nt, Artificial Sequence
  Oligomer
cagaguuacaguucugugguu

SEQ ID NO: 82714 - RNA, 21 nt, Artificial Sequence
  Oligomer
agucaccacuucagggcuuua

SEQ ID NO: 82715 - RNA, 21 nt, Artificial Sequence
  Oligomer
gauuacuggccuuuuucauuu

SEQ ID NO: 82716 - RNA, 21 nt, Artificial Sequence
  Oligomer
guguucagcaaagaccaaaga

SEQ ID NO: 82717 - RNA, 21 nt, Artificial Sequence
  Oligomer
ugugcccacaguguuugagaa

SEQ ID NO: 82718 - RNA, 21 nt, Artificial Sequence
  Oligomer
acugauguguuuuuccaucga

SEQ ID NO: 82719 - RNA, 21 nt, Artificial Sequence
  Oligomer
caagguacucuggugagucac

SEQ ID NO: 82720 - RNA, 21 nt, Artificial Sequence
  Oligomer
caucuugcuaccaguauuuag

SEQ ID NO: 82721 - RNA, 21 nt, Artificial Sequence
  Oligomer
cccagacuagauguaguauuu

SEQ ID NO: 82722 - RNA, 21 nt, Artificial Sequence
  Oligomer
gaguuacaguucugugguuuc

SEQ ID NO: 82723 - RNA, 21 nt, Artificial Sequence
  Oligomer
ugcagcuguggcagaguuaca

SEQ ID NO: 82724 - RNA, 21 nt, Artificial Sequence
  Oligomer
uaucgagguggauggaaagca

SEQ ID NO: 82725 - RNA, 21 nt, Artificial Sequence
  Oligomer
agcaucuggcucuaauucaca

SEQ ID NO: 82726 - RNA, 21 nt, Artificial Sequence
  Oligomer
ccuugucuugugaaaccuugc

SEQ ID NO: 82727 - RNA, 21 nt, Artificial Sequence
  Oligomer
ugggcuaaguaaauaggaauu

SEQ ID NO: 82728 - RNA, 21 nt, Artificial Sequence
  Oligomer
aacuucuugcuucuuucuaga

SEQ ID NO: 82729 - RNA, 21 nt, Artificial Sequence
  Oligomer
gagaacuauguggcagauauc

SEQ ID NO: 82730 - RNA, 21 nt, Artificial Sequence
  Oligomer
ucaucuugcuaccaguauuua

SEQ ID NO: 82731 - RNA, 21 nt, Artificial Sequence
  Oligomer
cuuucuagaaagagaaacagu

SEQ ID NO: 82732 - RNA, 21 nt, Artificial Sequence
  Oligomer
aagauggagugagagagguuu

SEQ ID NO: 82733 - RNA, 21 nt, Artificial Sequence
  Oligomer
caaguucaugcagcuguggca

SEQ ID NO: 82734 - RNA, 21 nt, Artificial Sequence
  Oligomer
uuggugauggagccuguggaa

SEQ ID NO: 82735 - RNA, 21 nt, Artificial Sequence
  Oligomer
uugugaauuaggcuguaacua

SEQ ID NO: 82736 - RNA, 21 nt, Artificial Sequence
  Oligomer
gauggaaagcagguagaguug

SEQ ID NO: 82737 - RNA, 21 nt, Artificial Sequence
  Oligomer
guuacuguguaauuagugcca

SEQ ID NO: 82738 - RNA, 21 nt, Artificial Sequence
  Oligomer
uuuggguacauggaguguuca

SEQ ID NO: 82739 - RNA, 21 nt, Artificial Sequence
  Oligomer
cgugggaagaaaaaaucuggg

SEQ ID NO: 82740 - RNA, 21 nt, Artificial Sequence
  Oligomer
agucaucuugcuaccaguauu

SEQ ID NO: 82741 - RNA, 21 nt, Artificial Sequence
  Oligomer
aaaccugaagaaggcagagau

SEQ ID NO: 82742 - RNA, 21 nt, Artificial Sequence
  Oligomer
uuuccaucgacagcccugaua

SEQ ID NO: 82743 - RNA, 21 nt, Artificial Sequence
  Oligomer
uuggguacauggaguguucag

SEQ ID NO: 82744 - RNA, 21 nt, Artificial Sequence
  Oligomer
aagaaacuggugauuguuggu

SEQ ID NO: 82745 - RNA, 21 nt, Artificial Sequence
  Oligomer
guaacuuuugugaauuaggcu

SEQ ID NO: 82746 - RNA, 21 nt, Artificial Sequence
  Oligomer
ccugaagaaggcagagauaug

SEQ ID NO: 82747 - RNA, 21 nt, Artificial Sequence
  Oligomer
ggaaagcagguagaguuggcu

SEQ ID NO: 82748 - RNA, 21 nt, Artificial Sequence
  Oligomer
uaguguaugauuacuggccuu

SEQ ID NO: 82749 - RNA, 21 nt, Artificial Sequence
  Oligomer
cauccucaaagaaaguguauu

SEQ ID NO: 82750 - RNA, 21 nt, Artificial Sequence
  Oligomer
aggcuguaacuacuuuauaac

SEQ ID NO: 82751 - RNA, 21 nt, Artificial Sequence
  Oligomer
cagcaaagaccaaagauggag

SEQ ID NO: 82752 - RNA, 21 nt, Artificial Sequence
  Oligomer
ggauucguugccugagcaaug

SEQ ID NO: 82753 - RNA, 21 nt, Artificial Sequence
  Oligomer
gugauggagccuguggaaaga

SEQ ID NO: 82754 - RNA, 21 nt, Artificial Sequence
  Oligomer
aucgacagcccugauaguuua

SEQ ID NO: 82755 - RNA, 21 nt, Artificial Sequence
  Oligomer
acuaacauguccugccuauua

SEQ ID NO: 82756 - RNA, 21 nt, Artificial Sequence
  Oligomer
cuucggaaugaugagcacaca

SEQ ID NO: 82757 - RNA, 21 nt, Artificial Sequence
  Oligomer
accaaagauggagugagagag

SEQ ID NO: 82758 - RNA, 21 nt, Artificial Sequence
  Oligomer
cuugcuaccaguauuuagaag

SEQ ID NO: 82759 - RNA, 21 nt, Artificial Sequence
  Oligomer
uacuggccuuuuucauuuauc

SEQ ID NO: 82760 - RNA, 21 nt, Artificial Sequence
  Oligomer
ucugauaaaagauggccauau

SEQ ID NO: 82761 - RNA, 21 nt, Artificial Sequence
  Oligomer
gaagaaacuggugauuguugg

SEQ ID NO: 82762 - RNA, 21 nt, Artificial Sequence
  Oligomer
cuaauacugucauccucaaag

SEQ ID NO: 82763 - RNA, 21 nt, Artificial Sequence
  Oligomer
cuuuggaagauggcauaaccu

SEQ ID NO: 82764 - RNA, 21 nt, Artificial Sequence
  Oligomer
cagcuguggcagaguuacagu

SEQ ID NO: 82765 - RNA, 21 nt, Artificial Sequence
  Oligomer
guuaguccacggucuggucuu

SEQ ID NO: 82766 - RNA, 21 nt, Artificial Sequence
  Oligomer
cagcugggcaggaagauuaug

SEQ ID NO: 82767 - RNA, 21 nt, Artificial Sequence
  Oligomer
augauuacuggccuuuuucau

SEQ ID NO: 82768 - RNA, 21 nt, Artificial Sequence
  Oligomer
acucagucucucuucucucca

SEQ ID NO: 82769 - RNA, 21 nt, Artificial Sequence
  Oligomer
uucacgccugaggcaauuaga

SEQ ID NO: 82770 - RNA, 21 nt, Artificial Sequence
  Oligomer
aguucucauggguggcacuca

SEQ ID NO: 82771 - RNA, 21 nt, Artificial Sequence
  Oligomer
uugguuucacgccugaggcaa

SEQ ID NO: 82772 - RNA, 21 nt, Artificial Sequence
  Oligomer
augaagcaggagccggugaaa

SEQ ID NO: 82773 - RNA, 21 nt, Artificial Sequence
  Oligomer
uagacacuuuggaagauggca

SEQ ID NO: 82774 - RNA, 21 nt, Artificial Sequence
  Oligomer
aguauuuagaagccaacuaug

SEQ ID NO: 82775 - RNA, 21 nt, Artificial Sequence
  Oligomer
cuagaaagagaaacaguuggu

SEQ ID NO: 82776 - RNA, 21 nt, Artificial Sequence
  Oligomer
acaguucugugguuucauguu

SEQ ID NO: 82777 - RNA, 21 nt, Artificial Sequence
  Oligomer
cagaaaagcccaaguucaugc

SEQ ID NO: 82778 - RNA, 21 nt, Artificial Sequence
  Oligomer
acuuuugugaauuaggcugua

SEQ ID NO: 82779 - RNA, 21 nt, Artificial Sequence
  Oligomer
ccugauaguuuagaaaacauc

SEQ ID NO: 82780 - RNA, 21 nt, Artificial Sequence
  Oligomer
cacaguguuugagaacuaugu

SEQ ID NO: 82781 - RNA, 21 nt, Artificial Sequence
  Oligomer
agguggauggaaagcagguag

SEQ ID NO: 82782 - RNA, 21 nt, Artificial Sequence
  Oligomer
acauguccugccuauuaucug

SEQ ID NO: 82783 - RNA, 21 nt, Artificial Sequence
  Oligomer
ugaaaccuugcugcaagcaca

SEQ ID NO: 82784 - RNA, 21 nt, Artificial Sequence
  Oligomer
uuggaaauaaagucagaugga

SEQ ID NO: 82785 - RNA, 21 nt, Artificial Sequence
  Oligomer
uacugucauccucaaagaaag

SEQ ID NO: 82786 - RNA, 21 nt, Artificial Sequence
  Oligomer
cacuuuggaagauggcauaac

SEQ ID NO: 82787 - RNA, 21 nt, Artificial Sequence
  Oligomer
gacgugggaagaaaaaaucug

SEQ ID NO: 82788 - RNA, 21 nt, Artificial Sequence
  Oligomer
aguguaugauuacuggccuuu

SEQ ID NO: 82789 - RNA, 21 nt, Artificial Sequence
  Oligomer
ucuggugagucaccacuucag

SEQ ID NO: 82790 - RNA, 21 nt, Artificial Sequence
  Oligomer
ugguaacuuuugugaauuagg

SEQ ID NO: 82791 - RNA, 21 nt, Artificial Sequence
  Oligomer
gaaauggcuacgagagcugcu

SEQ ID NO: 82792 - RNA, 21 nt, Artificial Sequence
  Oligomer
auugguuucacgccugaggca

SEQ ID NO: 82793 - RNA, 21 nt, Artificial Sequence
  Oligomer
gaaagacaugcuugcucauag

SEQ ID NO: 82794 - RNA, 21 nt, Artificial Sequence
  Oligomer
gauuauuaacgauguccaacc

SEQ ID NO: 82795 - RNA, 21 nt, Artificial Sequence
  Oligomer
aacuauguggcagauaucgag

SEQ ID NO: 82796 - RNA, 21 nt, Artificial Sequence
  Oligomer
uuggauuuccuaauacuguca

SEQ ID NO: 82797 - RNA, 21 nt, Artificial Sequence
  Oligomer
gaaagcagguagaguuggcuu

SEQ ID NO: 82798 - RNA, 21 nt, Artificial Sequence
  Oligomer
gagauauggcaaacaggauug

SEQ ID NO: 82799 - RNA, 21 nt, Artificial Sequence
  Oligomer
guggauggaaagcagguagag

SEQ ID NO: 82800 - RNA, 21 nt, Artificial Sequence
  Oligomer
uuuugugaauuaggcuguaac

SEQ ID NO: 82801 - RNA, 21 nt, Artificial Sequence
  Oligomer
aaccugaagaaggcagagaua

SEQ ID NO: 82802 - RNA, 21 nt, Artificial Sequence
  Oligomer
ugugaaaccuugcugcaagca

SEQ ID NO: 82803 - RNA, 21 nt, Artificial Sequence
  Oligomer
gaaaagcccaaguucaugcag

SEQ ID NO: 82804 - RNA, 21 nt, Artificial Sequence
  Oligomer
ccaguuaauuuuuccaacuac

SEQ ID NO: 82805 - RNA, 21 nt, Artificial Sequence
  Oligomer
aaaugggcucaaccagaaaag

SEQ ID NO: 82806 - RNA, 21 nt, Artificial Sequence
  Oligomer
cugacacaccaggcgcuaauu

SEQ ID NO: 82807 - RNA, 21 nt, Artificial Sequence
  Oligomer
gauuuuguuggcauagcucug

SEQ ID NO: 82808 - RNA, 21 nt, Artificial Sequence
  Oligomer
cugucucaccuggacuuaagc

SEQ ID NO: 82809 - RNA, 21 nt, Artificial Sequence
  Oligomer
gauuacaaaucagaagucauc

SEQ ID NO: 82810 - RNA, 21 nt, Artificial Sequence
  Oligomer
guggcacucagucucucuucu

SEQ ID NO: 82811 - RNA, 21 nt, Artificial Sequence
  Oligomer
aagagaaacaguugguaacuu

SEQ ID NO: 82812 - RNA, 21 nt, Artificial Sequence
  Oligomer
ucagcugcaagguacucuggu

SEQ ID NO: 82813 - RNA, 21 nt, Artificial Sequence
  Oligomer
cuuaugcgguuaauuuugaag

SEQ ID NO: 82814 - RNA, 21 nt, Artificial Sequence
  Oligomer
uugcuucuuucuagaaagaga

SEQ ID NO: 82815 - RNA, 21 nt, Artificial Sequence
  Oligomer
aaccagaaaagcccaaguuca

SEQ ID NO: 82816 - RNA, 21 nt, Artificial Sequence
  Oligomer
cucuccagcugacuaaacuuu

SEQ ID NO: 82817 - RNA, 21 nt, Artificial Sequence
  Oligomer
ugauuauuaacgauguccaac

SEQ ID NO: 82818 - RNA, 21 nt, Artificial Sequence
  Oligomer
agcccugauaguuuagaaaac

SEQ ID NO: 82819 - RNA, 21 nt, Artificial Sequence
  Oligomer
cacaccaggcgcuaauucaag

SEQ ID NO: 82820 - RNA, 21 nt, Artificial Sequence
  Oligomer
gcuaccaguauuuagaagcca

SEQ ID NO: 82821 - RNA, 21 nt, Artificial Sequence
  Oligomer
guuuuuccaucgacagcccug

SEQ ID NO: 82822 - RNA, 21 nt, Artificial Sequence
  Oligomer
ucucuucucuccagcugacua

SEQ ID NO: 82823 - RNA, 21 nt, Artificial Sequence
  Oligomer
uaccaguauuuagaagccaac

SEQ ID NO: 82824 - RNA, 21 nt, Artificial Sequence
  Oligomer
gcuuuuggguacauggagugu

SEQ ID NO: 82825 - RNA, 21 nt, Artificial Sequence
  Oligomer
ggcagaguuacaguucugugg

SEQ ID NO: 82826 - RNA, 21 nt, Artificial Sequence
  Oligomer
guguaugauuacuggccuuuu

SEQ ID NO: 82827 - RNA, 21 nt, Artificial Sequence
  Oligomer
ugaagaaggcagagauauggc

SEQ ID NO: 82828 - RNA, 21 nt, Artificial Sequence
  Oligomer
gaaugaugagcacacaaggcg

SEQ ID NO: 82829 - RNA, 21 nt, Artificial Sequence
  Oligomer
caucuggcucuaauucacagu

SEQ ID NO: 82830 - RNA, 21 nt, Artificial Sequence
  Oligomer
aaagaccaaagauggagugag

SEQ ID NO: 82831 - RNA, 21 nt, Artificial Sequence
  Oligomer
guaccaguuaauuuuuccaac

SEQ ID NO: 82832 - RNA, 21 nt, Artificial Sequence
  Oligomer
guggcagaguuacaguucugu

SEQ ID NO: 82833 - RNA, 21 nt, Artificial Sequence
  Oligomer
uaaccugucucaccuggacuu

SEQ ID NO: 82834 - RNA, 21 nt, Artificial Sequence
  Oligomer
agaaacaguugguaacuuuug

SEQ ID NO: 82835 - RNA, 21 nt, Artificial Sequence
  Oligomer
gauuguuggugauggagccug

SEQ ID NO: 82836 - RNA, 21 nt, Artificial Sequence
  Oligomer
cugucagcugcaagguacucu

SEQ ID NO: 82837 - RNA, 21 nt, Artificial Sequence
  Oligomer
agaguuacaguucugugguuu

SEQ ID NO: 82838 - RNA, 21 nt, Artificial Sequence
  Oligomer
ucucucacuccaucuuugguc

SEQ ID NO: 82839 - RNA, 21 nt, Artificial Sequence
  Oligomer
uuucaaaaaccucucucacuc

SEQ ID NO: 82840 - RNA, 21 nt, Artificial Sequence
  Oligomer
uuuacuuagcccagcuccaug

SEQ ID NO: 82841 - RNA, 21 nt, Artificial Sequence
  Oligomer
uuuccaucugacuuuauuucc

SEQ ID NO: 82842 - RNA, 21 nt, Artificial Sequence
  Oligomer
accucucucacuccaucuuug

SEQ ID NO: 82843 - RNA, 21 nt, Artificial Sequence
  Oligomer
uuugcugaacacuccauguac

SEQ ID NO: 82844 - RNA, 21 nt, Artificial Sequence
  Oligomer
uugguaacauacauuaagugg

SEQ ID NO: 82845 - RNA, 21 nt, Artificial Sequence
  Oligomer
uuucucuuucuagaaagaagc

SEQ ID NO: 82846 - RNA, 21 nt, Artificial Sequence
  Oligomer
ucaucauuccgaagauccuuc

SEQ ID NO: 82847 - RNA, 21 nt, Artificial Sequence
  Oligomer
ucuaccugcuuuccauccacc

SEQ ID NO: 82848 - RNA, 21 nt, Artificial Sequence
  Oligomer
uuacuuagcccagcuccaugg

SEQ ID NO: 82849 - RNA, 21 nt, Artificial Sequence
  Oligomer
uugcugaacacuccauguacc

SEQ ID NO: 82850 - RNA, 21 nt, Artificial Sequence
  Oligomer
uucuuauucccaaccaggaug

SEQ ID NO: 82851 - RNA, 21 nt, Artificial Sequence
  Oligomer
uuggcuucuaaauacugguag

SEQ ID NO: 82852 - RNA, 21 nt, Artificial Sequence
  Oligomer
auguuuucuaaacuaucaggg

SEQ ID NO: 82853 - RNA, 21 nt, Artificial Sequence
  Oligomer
uucaaaaaccucucucacucc

SEQ ID NO: 82854 - RNA, 21 nt, Artificial Sequence
  Oligomer
ucugccacauaguucucaaac

SEQ ID NO: 82855 - RNA, 21 nt, Artificial Sequence
  Oligomer
uaacucugccacagcugcaug

SEQ ID NO: 82856 - RNA, 21 nt, Artificial Sequence
  Oligomer
uuugccauaucucugccuucu

SEQ ID NO: 82857 - RNA, 21 nt, Artificial Sequence
  Oligomer
uuuucuaaacuaucagggcug

SEQ ID NO: 82858 - RNA, 21 nt, Artificial Sequence
  Oligomer
uuccauccaccucgauaucug

SEQ ID NO: 82859 - RNA, 21 nt, Artificial Sequence
  Oligomer
uccuguuugccauaucucugc

SEQ ID NO: 82860 - RNA, 21 nt, Artificial Sequence
  Oligomer
uuuccauccaccucgauaucu

SEQ ID NO: 82861 - RNA, 21 nt, Artificial Sequence
  Oligomer
ucucguagccauuucaaaaac

SEQ ID NO: 82862 - RNA, 21 nt, Artificial Sequence
  Oligomer
uuccuauuuacuuagcccagc

SEQ ID NO: 82863 - RNA, 21 nt, Artificial Sequence
  Oligomer
auccuguuugccauaucucug

SEQ ID NO: 82864 - RNA, 21 nt, Artificial Sequence
  Oligomer
ucgauaucugccacauaguuc

SEQ ID NO: 82865 - RNA, 21 nt, Artificial Sequence
  Oligomer
ucccacaaagccaacucuacc

SEQ ID NO: 82866 - RNA, 21 nt, Artificial Sequence
  Oligomer
ugccauaucucugccuucuuc

SEQ ID NO: 82867 - RNA, 21 nt, Artificial Sequence
  Oligomer
cuauuuacuuagcccagcucc

SEQ ID NO: 82868 - RNA, 21 nt, Artificial Sequence
  Oligomer
aaacacaucaguauaacaucg

SEQ ID NO: 82869 - RNA, 21 nt, Artificial Sequence
  Oligomer
aaaaaccucucucacuccauc

SEQ ID NO: 82870 - RNA, 21 nt, Artificial Sequence
  Oligomer
ucuagcuugcagagcagcucu

SEQ ID NO: 82871 - RNA, 21 nt, Artificial Sequence
  Oligomer
uucuucagguuucaccggcuc

SEQ ID NO: 82872 - RNA, 21 nt, Artificial Sequence
  Oligomer
aacucuaccugcuuuccaucc

SEQ ID NO: 82873 - RNA, 21 nt, Artificial Sequence
  Oligomer
uacccaaaagcgccaauccug

SEQ ID NO: 82874 - RNA, 21 nt, Artificial Sequence
  Oligomer
ugccuucuucagguuucaccg

SEQ ID NO: 82875 - RNA, 21 nt, Artificial Sequence
  Oligomer
auuccuauuuacuuagcccag

SEQ ID NO: 82876 - RNA, 21 nt, Artificial Sequence
  Oligomer
uaguuggcuucuaaauacugg

SEQ ID NO: 82877 - RNA, 21 nt, Artificial Sequence
  Oligomer
uccaaagugucuaauugccuc

SEQ ID NO: 82878 - RNA, 21 nt, Artificial Sequence
  Oligomer
uuuggucuuugcugaacacuc

SEQ ID NO: 82879 - RNA, 21 nt, Artificial Sequence
  Oligomer
augagcaagcaugucuuucca

SEQ ID NO: 82880 - RNA, 21 nt, Artificial Sequence
  Oligomer
uaaucuuccugcccagcugug

SEQ ID NO: 82881 - RNA, 21 nt, Artificial Sequence
  Oligomer
ucaaaaaccucucucacucca

SEQ ID NO: 82882 - RNA, 21 nt, Artificial Sequence
  Oligomer
auuaaguggcacuaauuacac

SEQ ID NO: 82883 - RNA, 21 nt, Artificial Sequence
  Oligomer
aaaaguuaccaacuguuucuc

SEQ ID NO: 82884 - RNA, 21 nt, Artificial Sequence
  Oligomer
uuucugggauguuuucuaaac

SEQ ID NO: 82885 - RNA, 21 nt, Artificial Sequence
  Oligomer
uuucuuugaggaugacaguau

SEQ ID NO: 82886 - RNA, 21 nt, Artificial Sequence
  Oligomer
uuggucuuugcugaacacucc

SEQ ID NO: 82887 - RNA, 21 nt, Artificial Sequence
  Oligomer
uucuuugaggaugacaguauu

SEQ ID NO: 82888 - RNA, 21 nt, Artificial Sequence
  Oligomer
ccuguuugccauaucucugcc

SEQ ID NO: 82889 - RNA, 21 nt, Artificial Sequence
  Oligomer
auaaucuuccugcccagcugu

SEQ ID NO: 82890 - RNA, 21 nt, Artificial Sequence
  Oligomer
uacugguagcaagaugacuuc

SEQ ID NO: 82891 - RNA, 21 nt, Artificial Sequence
  Oligomer
ugacucaccagaguaccuugc

SEQ ID NO: 82892 - RNA, 21 nt, Artificial Sequence
  Oligomer
uaaguggcacuaauuacacag

SEQ ID NO: 82893 - RNA, 21 nt, Artificial Sequence
  Oligomer
ucauaaucuuccugcccagcu

SEQ ID NO: 82894 - RNA, 21 nt, Artificial Sequence
  Oligomer
ugucuuuccacaggcuccauc

SEQ ID NO: 82895 - RNA, 21 nt, Artificial Sequence
  Oligomer
ugcugaacacuccauguaccc

SEQ ID NO: 82896 - RNA, 21 nt, Artificial Sequence
  Oligomer
uccuauuuacuuagcccagcu

SEQ ID NO: 82897 - RNA, 21 nt, Artificial Sequence
  Oligomer
augagaacugguggcuccucu

SEQ ID NO: 82898 - RNA, 21 nt, Artificial Sequence
  Oligomer
aguauaacaucgguaucuggg

SEQ ID NO: 82899 - RNA, 21 nt, Artificial Sequence
  Oligomer
caacaaucaccaguuucuucc

SEQ ID NO: 82900 - RNA, 21 nt, Artificial Sequence
  Oligomer
uuucuuccggauggcagccau

SEQ ID NO: 82901 - RNA, 21 nt, Artificial Sequence
  Oligomer
aaaguuaccaacuguuucucu

SEQ ID NO: 82902 - RNA, 21 nt, Artificial Sequence
  Oligomer
aaacuaucagggcugucgaug

SEQ ID NO: 82903 - RNA, 21 nt, Artificial Sequence
  Oligomer
uuucuaaacuaucagggcugu

SEQ ID NO: 82904 - RNA, 21 nt, Artificial Sequence
  Oligomer
acaaucaccaguuucuuccgg

SEQ ID NO: 82905 - RNA, 21 nt, Artificial Sequence
  Oligomer
ugucccacaaagccaacucua

SEQ ID NO: 82906 - RNA, 21 nt, Artificial Sequence
  Oligomer
uguacccaaaagcgccaaucc

SEQ ID NO: 82907 - RNA, 21 nt, Artificial Sequence
  Oligomer
aucauaaucuuccugcccagc

SEQ ID NO: 82908 - RNA, 21 nt, Artificial Sequence
  Oligomer
uuacagccuaauucacaaaag

SEQ ID NO: 82909 - RNA, 21 nt, Artificial Sequence
  Oligomer
ugaagacuaugagcaagcaug

SEQ ID NO: 82910 - RNA, 21 nt, Artificial Sequence
  Oligomer
uuuccacaggcuccaucacca

SEQ ID NO: 82911 - RNA, 21 nt, Artificial Sequence
  Oligomer
uuuucugguugagcccauuuu

SEQ ID NO: 82912 - RNA, 21 nt, Artificial Sequence
  Oligomer
uuaaguccaggugagacaggu

SEQ ID NO: 82913 - RNA, 21 nt, Artificial Sequence
  Oligomer
aguuauaaaguaguuacagcc

SEQ ID NO: 82914 - RNA, 21 nt, Artificial Sequence
  Oligomer
uucacaaaaguuaccaacugu

SEQ ID NO: 82915 - RNA, 21 nt, Artificial Sequence
  Oligomer
auccaccucgauaucugccac

SEQ ID NO: 82916 - RNA, 21 nt, Artificial Sequence
  Oligomer
auacugguagcaagaugacuu

SEQ ID NO: 82917 - RNA, 21 nt, Artificial Sequence
  Oligomer
uucugggauguuuucuaaacu

SEQ ID NO: 82918 - RNA, 21 nt, Artificial Sequence
  Oligomer
accaauuccuauuuacuuagc

SEQ ID NO: 82919 - RNA, 21 nt, Artificial Sequence
  Oligomer
ugucuaauugccucaggcgug

SEQ ID NO: 82920 - RNA, 21 nt, Artificial Sequence
  Oligomer
uuaccaacuguuucucuuucu

SEQ ID NO: 82921 - RNA, 21 nt, Artificial Sequence
  Oligomer
auucacaaaaguuaccaacug

SEQ ID NO: 82922 - RNA, 21 nt, Artificial Sequence
  Oligomer
aaaguaguuacagccuaauuc

SEQ ID NO: 82923 - RNA, 21 nt, Artificial Sequence
  Oligomer
uucuaaacuaucagggcuguc

SEQ ID NO: 82924 - RNA, 21 nt, Artificial Sequence
  Oligomer
acugguagcaagaugacuucu

SEQ ID NO: 82925 - RNA, 21 nt, Artificial Sequence
  Oligomer
uuauucccaaccaggaugaug

SEQ ID NO: 82926 - RNA, 21 nt, Artificial Sequence
  Oligomer
uucucuuucuagaaagaagca

SEQ ID NO: 82927 - RNA, 21 nt, Artificial Sequence
  Oligomer
uugcagcaagguuucacaaga

SEQ ID NO: 82928 - RNA, 21 nt, Artificial Sequence
  Oligomer
ucaguauaacaucgguaucug

SEQ ID NO: 82929 - RNA, 21 nt, Artificial Sequence
  Oligomer
aacaaucaccaguuucuuccg

SEQ ID NO: 82930 - RNA, 21 nt, Artificial Sequence
  Oligomer
aaguaguuacagccuaauuca

SEQ ID NO: 82931 - RNA, 21 nt, Artificial Sequence
  Oligomer
auuagagccagaugcuuaagu

SEQ ID NO: 82932 - RNA, 21 nt, Artificial Sequence
  Oligomer
guuaccaacuguuucucuuuc

SEQ ID NO: 82933 - RNA, 21 nt, Artificial Sequence
  Oligomer
auguacccaaaagcgccaauc

SEQ ID NO: 82934 - RNA, 21 nt, Artificial Sequence
  Oligomer
uaucugccacauaguucucaa

SEQ ID NO: 82935 - RNA, 21 nt, Artificial Sequence
  Oligomer
uaagguaacuaacaugaaacc

SEQ ID NO: 82936 - RNA, 21 nt, Artificial Sequence
  Oligomer
ucucacuccaucuuuggucuu

SEQ ID NO: 82937 - RNA, 21 nt, Artificial Sequence
  Oligomer
cugccuucuucagguuucacc

SEQ ID NO: 82938 - RNA, 21 nt, Artificial Sequence
  Oligomer
uugccauaucucugccuucuu

SEQ ID NO: 82939 - RNA, 21 nt, Artificial Sequence
  Oligomer
guaauauggccaucuuuuauc

SEQ ID NO: 82940 - RNA, 21 nt, Artificial Sequence
  Oligomer
aucuuuggucuuugcugaaca

SEQ ID NO: 82941 - RNA, 21 nt, Artificial Sequence
  Oligomer
ugaaaaaggccaguaaucaua

SEQ ID NO: 82942 - RNA, 21 nt, Artificial Sequence
  Oligomer
aucaguauaacaucgguaucu

SEQ ID NO: 82943 - RNA, 21 nt, Artificial Sequence
  Oligomer
cucaggcgaucauaaucuucc

SEQ ID NO: 82944 - RNA, 21 nt, Artificial Sequence
  Oligomer
uuccaucugacuuuauuucca

SEQ ID NO: 82945 - RNA, 21 nt, Artificial Sequence
  Oligomer
aaaauacuacaucuagucugg

SEQ ID NO: 82946 - RNA, 21 nt, Artificial Sequence
  Oligomer
uaacaugaaaccacagaacug

SEQ ID NO: 82947 - RNA, 21 nt, Artificial Sequence
  Oligomer
aggcgaucauaaucuuccugc

SEQ ID NO: 82948 - RNA, 21 nt, Artificial Sequence
  Oligomer
accucgauaucugccacauag

SEQ ID NO: 82949 - RNA, 21 nt, Artificial Sequence
  Oligomer
uucuaaauacugguagcaaga

SEQ ID NO: 82950 - RNA, 21 nt, Artificial Sequence
  Oligomer
uccauccaccucgauaucugc

SEQ ID NO: 82951 - RNA, 21 nt, Artificial Sequence
  Oligomer
ugccacauaguucucaaacac

SEQ ID NO: 82952 - RNA, 21 nt, Artificial Sequence
  Oligomer
uccauguacccaaaagcgcca

SEQ ID NO: 82953 - RNA, 21 nt, Artificial Sequence
  Oligomer
uguuugccauaucucugccuu

SEQ ID NO: 82954 - RNA, 21 nt, Artificial Sequence
  Oligomer
aauccuguuugccauaucucu

SEQ ID NO: 82955 - RNA, 21 nt, Artificial Sequence
  Oligomer
uucccacgucuagcuugcaga

SEQ ID NO: 82956 - RNA, 21 nt, Artificial Sequence
  Oligomer
uuaaguggcacuaauuacaca

SEQ ID NO: 82957 - RNA, 21 nt, Artificial Sequence
  Oligomer
ugaauuagcgccugguguguc

SEQ ID NO: 82958 - RNA, 21 nt, Artificial Sequence
  Oligomer
ugagcaagcaugucuuuccac

SEQ ID NO: 82959 - RNA, 21 nt, Artificial Sequence
  Oligomer
ucugccuucuucagguuucac

SEQ ID NO: 82960 - RNA, 21 nt, Artificial Sequence
  Oligomer
uguuuucuaaacuaucagggc

SEQ ID NO: 82961 - RNA, 21 nt, Artificial Sequence
  Oligomer
agagcuaugccaacaaaaucu

SEQ ID NO: 82962 - RNA, 21 nt, Artificial Sequence
  Oligomer
uaugagcaagcaugucuuucc

SEQ ID NO: 82963 - RNA, 21 nt, Artificial Sequence
  Oligomer
auaucugccacauaguucuca

SEQ ID NO: 82964 - RNA, 21 nt, Artificial Sequence
  Oligomer
cacaaagccaacucuaccugc

SEQ ID NO: 82965 - RNA, 21 nt, Artificial Sequence
  Oligomer
uauuuacuuagcccagcucca

SEQ ID NO: 82966 - RNA, 21 nt, Artificial Sequence
  Oligomer
uccaucuuuggucuuugcuga

SEQ ID NO: 82967 - RNA, 21 nt, Artificial Sequence
  Oligomer
auuucaaaaaccucucucacu

SEQ ID NO: 82968 - RNA, 21 nt, Artificial Sequence
  Oligomer
ucugccacagcugcaugaacu

SEQ ID NO: 82969 - RNA, 21 nt, Artificial Sequence
  Oligomer
acaaaaguuaccaacuguuuc

SEQ ID NO: 82970 - RNA, 21 nt, Artificial Sequence
  Oligomer
augaaaccacagaacuguaac

SEQ ID NO: 82971 - RNA, 21 nt, Artificial Sequence
  Oligomer
uaggcaggacauguuaguuau

SEQ ID NO: 82972 - RNA, 21 nt, Artificial Sequence
  Oligomer
acuccauguacccaaaagcgc

SEQ ID NO: 82973 - RNA, 21 nt, Artificial Sequence
  Oligomer
ucugguugagcccauuuucaa

SEQ ID NO: 82974 - RNA, 21 nt, Artificial Sequence
  Oligomer
uaccugcuuuccauccaccuc

SEQ ID NO: 82975 - RNA, 21 nt, Artificial Sequence
  Oligomer
cuuuccauccaccucgauauc

SEQ ID NO: 82976 - RNA, 21 nt, Artificial Sequence
  Oligomer
acuaacaugaaaccacagaac

SEQ ID NO: 82977 - RNA, 21 nt, Artificial Sequence
  Oligomer
uaccuugcagcugacagauaa

SEQ ID NO: 82978 - RNA, 21 nt, Artificial Sequence
  Oligomer
uauaacaucgguaucugggua

SEQ ID NO: 82979 - RNA, 21 nt, Artificial Sequence
  Oligomer
ucacaagacaaggcacccaga

SEQ ID NO: 82980 - RNA, 21 nt, Artificial Sequence
  Oligomer
ugugucccacaaagccaacuc

SEQ ID NO: 82981 - RNA, 21 nt, Artificial Sequence
  Oligomer
uaacauacauuaaguggcacu

SEQ ID NO: 82982 - RNA, 21 nt, Artificial Sequence
  Oligomer
ucaccagaguaccuugcagcu

SEQ ID NO: 82983 - RNA, 21 nt, Artificial Sequence
  Oligomer
cacuccauguacccaaaagcg

SEQ ID NO: 82984 - RNA, 21 nt, Artificial Sequence
  Oligomer
aaaagcgccaauccuguuugc

SEQ ID NO: 82985 - RNA, 21 nt, Artificial Sequence
  Oligomer
aucgguaucuggguaggagag

SEQ ID NO: 82986 - RNA, 21 nt, Artificial Sequence
  Oligomer
ucaccaacaaucaccaguuuc

SEQ ID NO: 82987 - RNA, 21 nt, Artificial Sequence
  Oligomer
ucaccaguuucuuccggaugg

SEQ ID NO: 82988 - RNA, 21 nt, Artificial Sequence
  Oligomer
acacugugggcacauacaccu

SEQ ID NO: 82989 - RNA, 21 nt, Artificial Sequence
  Oligomer
ucucugccuucuucagguuuc

SEQ ID NO: 82990 - RNA, 21 nt, Artificial Sequence
  Oligomer
ugcugaagacuaugagcaagc

SEQ ID NO: 82991 - RNA, 21 nt, Artificial Sequence
  Oligomer
gaaaaaggccaguaaucauac

SEQ ID NO: 82992 - RNA, 21 nt, Artificial Sequence
  Oligomer
acccaaaagcgccaauccugu

SEQ ID NO: 82993 - RNA, 21 nt, Artificial Sequence
  Oligomer
uggucuuugcugaacacucca

SEQ ID NO: 82994 - RNA, 21 nt, Artificial Sequence
  Oligomer
uaguucucaaacacugugggc

SEQ ID NO: 82995 - RNA, 21 nt, Artificial Sequence
  Oligomer
gucuuugcugaacacuccaug

SEQ ID NO: 82996 - RNA, 21 nt, Artificial Sequence
  Oligomer
uuucuagaaagaagcaagaag

SEQ ID NO: 82997 - RNA, 21 nt, Artificial Sequence
  Oligomer
cauaguucucaaacacugugg

SEQ ID NO: 82998 - RNA, 21 nt, Artificial Sequence
  Oligomer
uaacaucgguaucuggguagg

SEQ ID NO: 82999 - RNA, 21 nt, Artificial Sequence
  Oligomer
uccacuuuucugggauguuuu

SEQ ID NO: 83000 - RNA, 21 nt, Artificial Sequence
  Oligomer
ucugggauguuuucuaaacua

SEQ ID NO: 83001 - RNA, 21 nt, Artificial Sequence
  Oligomer
gcuccaucaccaacaaucacc

SEQ ID NO: 83002 - RNA, 21 nt, Artificial Sequence
  Oligomer
acugagugccacccaugagaa

SEQ ID NO: 83003 - RNA, 21 nt, Artificial Sequence
  Oligomer
ucuuugcugaacacuccaugu

SEQ ID NO: 83004 - RNA, 21 nt, Artificial Sequence
  Oligomer
uggaaaaauuaacugguacag

SEQ ID NO: 83005 - RNA, 21 nt, Artificial Sequence
  Oligomer
ugguugagcccauuuucaaaa

SEQ ID NO: 83006 - RNA, 21 nt, Artificial Sequence
  Oligomer
aacuguaacucugccacagcu

SEQ ID NO: 83007 - RNA, 21 nt, Artificial Sequence
  Oligomer
ccacaaagccaacucuaccug

SEQ ID NO: 83008 - RNA, 21 nt, Artificial Sequence
  Oligomer
aguaguuacagccuaauucac

SEQ ID NO: 83009 - RNA, 21 nt, Artificial Sequence
  Oligomer
cuugugugcucaucauuccga

SEQ ID NO: 83010 - RNA, 21 nt, Artificial Sequence
  Oligomer
auaguucucaaacacuguggg

SEQ ID NO: 83011 - RNA, 21 nt, Artificial Sequence
  Oligomer
ugaauuagagccagaugcuua

SEQ ID NO: 83012 - RNA, 21 nt, Artificial Sequence
  Oligomer
augcuuaaguccaggugagac

SEQ ID NO: 83013 - RNA, 21 nt, Artificial Sequence
  Oligomer
ugggauguuuucuaaacuauc

SEQ ID NO: 83014 - RNA, 21 nt, Artificial Sequence
  Oligomer
auaacaucgguaucuggguag

SEQ ID NO: 83015 - RNA, 21 nt, Artificial Sequence
  Oligomer
aaagcccugaaguggugacuc

SEQ ID NO: 83016 - RNA, 21 nt, Artificial Sequence
  Oligomer
gccauuucaaaaaccucucuc

SEQ ID NO: 83017 - RNA, 21 nt, Artificial Sequence
  Oligomer
cuaacaugaaaccacagaacu

SEQ ID NO: 83018 - RNA, 21 nt, Artificial Sequence
  Oligomer
auuuacuuagcccagcuccau

SEQ ID NO: 83019 - RNA, 21 nt, Artificial Sequence
  Oligomer
ugggacagaaaugcuugacuu

SEQ ID NO: 83020 - RNA, 21 nt, Artificial Sequence
  Oligomer
uccaccucgauaucugccaca

SEQ ID NO: 83021 - RNA, 21 nt, Artificial Sequence
  Oligomer
uccaucaccaacaaucaccag

SEQ ID NO: 83022 - RNA, 21 nt, Artificial Sequence
  Oligomer
ugacagauaauaggcaggaca

SEQ ID NO: 83023 - RNA, 21 nt, Artificial Sequence
  Oligomer
acugugggcacauacaccucu

SEQ ID NO: 83024 - RNA, 21 nt, Artificial Sequence
  Oligomer
cuucugauuuguaaucuuagg

SEQ ID NO: 83025 - RNA, 21 nt, Artificial Sequence
  Oligomer
ccacauaguucucaaacacug

SEQ ID NO: 83026 - RNA, 21 nt, Artificial Sequence
  Oligomer
aacacaucaguauaacaucgg

SEQ ID NO: 83027 - RNA, 21 nt, Artificial Sequence
  Oligomer
guagccauuucaaaaaccucu

SEQ ID NO: 83028 - RNA, 21 nt, Artificial Sequence
  Oligomer
auaggcaggacauguuaguua

SEQ ID NO: 83029 - RNA, 21 nt, Artificial Sequence
  Oligomer
acauuaaguggcacuaauuac

SEQ ID NO: 83030 - RNA, 21 nt, Artificial Sequence
  Oligomer
uugcugaagacuaugagcaag

SEQ ID NO: 83031 - RNA, 21 nt, Artificial Sequence
  Oligomer
ugaggaugacaguauuaggaa

SEQ ID NO: 83032 - RNA, 21 nt, Artificial Sequence
  Oligomer
cuccaucaccaacaaucacca

SEQ ID NO: 83033 - RNA, 21 nt, Artificial Sequence
  Oligomer
augucuuuccacaggcuccau

SEQ ID NO: 83034 - RNA, 21 nt, Artificial Sequence
  Oligomer
acagaaaugcuugacuucugg

SEQ ID NO: 83035 - RNA, 21 nt, Artificial Sequence
  Oligomer
aguaccuugcagcugacagau

SEQ ID NO: 83036 - RNA, 21 nt, Artificial Sequence
  Oligomer
agggcugucgauggaaaaaca

SEQ ID NO: 83037 - RNA, 21 nt, Artificial Sequence
  Oligomer
ucacaaaaguuaccaacuguu

SEQ ID NO: 83038 - RNA, 21 nt, Artificial Sequence
  Oligomer
uccuugcugaagacuaugagc

SEQ ID NO: 83039 - RNA, 21 nt, Artificial Sequence
  Oligomer
auugcucaggcaacgaauccg

SEQ ID NO: 83040 - RNA, 21 nt, Artificial Sequence
  Oligomer
auaucucugccuucuucaggu

SEQ ID NO: 83041 - RNA, 21 nt, Artificial Sequence
  Oligomer
ugguccuugcugaagacuaug

SEQ ID NO: 83042 - RNA, 21 nt, Artificial Sequence
  Oligomer
ucaggcgaucauaaucuuccu

SEQ ID NO: 83043 - RNA, 21 nt, Artificial Sequence
  Oligomer
acaaggcacccagauuuuuuc

SEQ ID NO: 83044 - RNA, 21 nt, Artificial Sequence
  Oligomer
ugguaacauacauuaaguggc

SEQ ID NO: 83045 - RNA, 21 nt, Artificial Sequence
  Oligomer
uaacuaacaugaaaccacaga

SEQ ID NO: 83046 - RNA, 21 nt, Artificial Sequence
  Oligomer
aaccacagaacuguaacucug

SEQ ID NO: 83047 - RNA, 21 nt, Artificial Sequence
  Oligomer
uaaagcccugaaguggugacu

SEQ ID NO: 83048 - RNA, 21 nt, Artificial Sequence
  Oligomer
aaaugaaaaaggccaguaauc

SEQ ID NO: 83049 - RNA, 21 nt, Artificial Sequence
  Oligomer
ucuuuggucuuugcugaacac

SEQ ID NO: 83050 - RNA, 21 nt, Artificial Sequence
  Oligomer
uucucaaacacugugggcaca

SEQ ID NO: 83051 - RNA, 21 nt, Artificial Sequence
  Oligomer
ucgauggaaaaacacaucagu

SEQ ID NO: 83052 - RNA, 21 nt, Artificial Sequence
  Oligomer
gugacucaccagaguaccuug

SEQ ID NO: 83053 - RNA, 21 nt, Artificial Sequence
  Oligomer
cuaaauacugguagcaagaug

SEQ ID NO: 83054 - RNA, 21 nt, Artificial Sequence
  Oligomer
aaauacuacaucuagucuggg

SEQ ID NO: 83055 - RNA, 21 nt, Artificial Sequence
  Oligomer
gaaaccacagaacuguaacuc

SEQ ID NO: 83056 - RNA, 21 nt, Artificial Sequence
  Oligomer
uguaacucugccacagcugca

SEQ ID NO: 83057 - RNA, 21 nt, Artificial Sequence
  Oligomer
ugcuuuccauccaccucgaua

SEQ ID NO: 83058 - RNA, 21 nt, Artificial Sequence
  Oligomer
ugugaauuagagccagaugcu

SEQ ID NO: 83059 - RNA, 21 nt, Artificial Sequence
  Oligomer
gcaagguuucacaagacaagg

SEQ ID NO: 83060 - RNA, 21 nt, Artificial Sequence
  Oligomer
aauuccuauuuacuuagccca

SEQ ID NO: 83061 - RNA, 21 nt, Artificial Sequence
  Oligomer
ucuagaaagaagcaagaaguu

SEQ ID NO: 83062 - RNA, 21 nt, Artificial Sequence
  Oligomer
gauaucugccacauaguucuc

SEQ ID NO: 83063 - RNA, 21 nt, Artificial Sequence
  Oligomer
uaaauacugguagcaagauga

SEQ ID NO: 83064 - RNA, 21 nt, Artificial Sequence
  Oligomer
acuguuucucuuucuagaaag

SEQ ID NO: 83065 - RNA, 21 nt, Artificial Sequence
  Oligomer
aaaccucucucacuccaucuu

SEQ ID NO: 83066 - RNA, 21 nt, Artificial Sequence
  Oligomer
ugccacagcugcaugaacuug

SEQ ID NO: 83067 - RNA, 21 nt, Artificial Sequence
  Oligomer
uuccacaggcuccaucaccaa

SEQ ID NO: 83068 - RNA, 21 nt, Artificial Sequence
  Oligomer
uaguuacagccuaauucacaa

SEQ ID NO: 83069 - RNA, 21 nt, Artificial Sequence
  Oligomer
caacucuaccugcuuuccauc

SEQ ID NO: 83070 - RNA, 21 nt, Artificial Sequence
  Oligomer
uggcacuaauuacacaguaac

SEQ ID NO: 83071 - RNA, 21 nt, Artificial Sequence
  Oligomer
ugaacacuccauguacccaaa

SEQ ID NO: 83072 - RNA, 21 nt, Artificial Sequence
  Oligomer
cccagauuuuuucuucccacg

SEQ ID NO: 83073 - RNA, 21 nt, Artificial Sequence
  Oligomer
aauacugguagcaagaugacu

SEQ ID NO: 83074 - RNA, 21 nt, Artificial Sequence
  Oligomer
aucucugccuucuucagguuu

SEQ ID NO: 83075 - RNA, 21 nt, Artificial Sequence
  Oligomer
uaucagggcugucgauggaaa

SEQ ID NO: 83076 - RNA, 21 nt, Artificial Sequence
  Oligomer
cugaacacuccauguacccaa

SEQ ID NO: 83077 - RNA, 21 nt, Artificial Sequence
  Oligomer
accaacaaucaccaguuucuu

SEQ ID NO: 83078 - RNA, 21 nt, Artificial Sequence
  Oligomer
agccuaauucacaaaaguuac

SEQ ID NO: 83079 - RNA, 21 nt, Artificial Sequence
  Oligomer
cauaucucugccuucuucagg

SEQ ID NO: 83080 - RNA, 21 nt, Artificial Sequence
  Oligomer
agccaacucuaccugcuuucc

SEQ ID NO: 83081 - RNA, 21 nt, Artificial Sequence
  Oligomer
aaggccaguaaucauacacua

SEQ ID NO: 83082 - RNA, 21 nt, Artificial Sequence
  Oligomer
aauacacuuucuuugaggaug

SEQ ID NO: 83083 - RNA, 21 nt, Artificial Sequence
  Oligomer
guuauaaaguaguuacagccu

SEQ ID NO: 83084 - RNA, 21 nt, Artificial Sequence
  Oligomer
cuccaucuuuggucuuugcug

SEQ ID NO: 83085 - RNA, 21 nt, Artificial Sequence
  Oligomer
cauugcucaggcaacgaaucc

SEQ ID NO: 83086 - RNA, 21 nt, Artificial Sequence
  Oligomer
ucuuuccacaggcuccaucac

SEQ ID NO: 83087 - RNA, 21 nt, Artificial Sequence
  Oligomer
uaaacuaucagggcugucgau

SEQ ID NO: 83088 - RNA, 21 nt, Artificial Sequence
  Oligomer
uaauaggcaggacauguuagu

SEQ ID NO: 83089 - RNA, 21 nt, Artificial Sequence
  Oligomer
ugugugcucaucauuccgaag

SEQ ID NO: 83090 - RNA, 21 nt, Artificial Sequence
  Oligomer
cucucucacuccaucuuuggu

SEQ ID NO: 83091 - RNA, 21 nt, Artificial Sequence
  Oligomer
cuucuaaauacugguagcaag

SEQ ID NO: 83092 - RNA, 21 nt, Artificial Sequence
  Oligomer
gauaaaugaaaaaggccagua

SEQ ID NO: 83093 - RNA, 21 nt, Artificial Sequence
  Oligomer
auauggccaucuuuuaucaga

SEQ ID NO: 83094 - RNA, 21 nt, Artificial Sequence
  Oligomer
ccaacaaucaccaguuucuuc

SEQ ID NO: 83095 - RNA, 21 nt, Artificial Sequence
  Oligomer
cuuugaggaugacaguauuag

SEQ ID NO: 83096 - RNA, 21 nt, Artificial Sequence
  Oligomer
agguuaugccaucuuccaaag

SEQ ID NO: 83097 - RNA, 21 nt, Artificial Sequence
  Oligomer
acuguaacucugccacagcug

SEQ ID NO: 83098 - RNA, 21 nt, Artificial Sequence
  Oligomer
aagaccagaccguggacuaac

SEQ ID NO: 83099 - RNA, 21 nt, Artificial Sequence
  Oligomer
cauaaucuuccugcccagcug

SEQ ID NO: 83100 - RNA, 21 nt, Artificial Sequence
  Oligomer
augaaaaaggccaguaaucau

SEQ ID NO: 83101 - RNA, 21 nt, Artificial Sequence
  Oligomer
uggagagaagagagacugagu

SEQ ID NO: 83102 - RNA, 21 nt, Artificial Sequence
  Oligomer
ucuaauugccucaggcgugaa

SEQ ID NO: 83103 - RNA, 21 nt, Artificial Sequence
  Oligomer
ugagugccacccaugagaacu

SEQ ID NO: 83104 - RNA, 21 nt, Artificial Sequence
  Oligomer
uugccucaggcgugaaaccaa

SEQ ID NO: 83105 - RNA, 21 nt, Artificial Sequence
  Oligomer
uuucaccggcuccugcuucau

SEQ ID NO: 83106 - RNA, 21 nt, Artificial Sequence
  Oligomer
ugccaucuuccaaagugucua

SEQ ID NO: 83107 - RNA, 21 nt, Artificial Sequence
  Oligomer
cauaguuggcuucuaaauacu

SEQ ID NO: 83108 - RNA, 21 nt, Artificial Sequence
  Oligomer
accaacuguuucucuuucuag

SEQ ID NO: 83109 - RNA, 21 nt, Artificial Sequence
  Oligomer
aacaugaaaccacagaacugu

SEQ ID NO: 83110 - RNA, 21 nt, Artificial Sequence
  Oligomer
gcaugaacuugggcuuuucug

SEQ ID NO: 83111 - RNA, 21 nt, Artificial Sequence
  Oligomer
uacagccuaauucacaaaagu

SEQ ID NO: 83112 - RNA, 21 nt, Artificial Sequence
  Oligomer
gauguuuucuaaacuaucagg

SEQ ID NO: 83113 - RNA, 21 nt, Artificial Sequence
  Oligomer
acauaguucucaaacacugug

SEQ ID NO: 83114 - RNA, 21 nt, Artificial Sequence
  Oligomer
cuaccugcuuuccauccaccu

SEQ ID NO: 83115 - RNA, 21 nt, Artificial Sequence
  Oligomer
cagauaauaggcaggacaugu

SEQ ID NO: 83116 - RNA, 21 nt, Artificial Sequence
  Oligomer
ugugcuugcagcaagguuuca

SEQ ID NO: 83117 - RNA, 21 nt, Artificial Sequence
  Oligomer
uccaucugacuuuauuuccaa

SEQ ID NO: 83118 - RNA, 21 nt, Artificial Sequence
  Oligomer
cuuucuuugaggaugacagua

SEQ ID NO: 83119 - RNA, 21 nt, Artificial Sequence
  Oligomer
guuaugccaucuuccaaagug

SEQ ID NO: 83120 - RNA, 21 nt, Artificial Sequence
  Oligomer
cagauuuuuucuucccacguc

SEQ ID NO: 83121 - RNA, 21 nt, Artificial Sequence
  Oligomer
aaaggccaguaaucauacacu

SEQ ID NO: 83122 - RNA, 21 nt, Artificial Sequence
  Oligomer
cugaaguggugacucaccaga

SEQ ID NO: 83123 - RNA, 21 nt, Artificial Sequence
  Oligomer
ccuaauucacaaaaguuacca

SEQ ID NO: 83124 - RNA, 21 nt, Artificial Sequence
  Oligomer
agcagcucucguagccauuuc

SEQ ID NO: 83125 - RNA, 21 nt, Artificial Sequence
  Oligomer
ugccucaggcgugaaaccaau

SEQ ID NO: 83126 - RNA, 21 nt, Artificial Sequence
  Oligomer
cuaugagcaagcaugucuuuc

SEQ ID NO: 83127 - RNA, 21 nt, Artificial Sequence
  Oligomer
gguuggacaucguuaauaauc

SEQ ID NO: 83128 - RNA, 21 nt, Artificial Sequence
  Oligomer
cucgauaucugccacauaguu

SEQ ID NO: 83129 - RNA, 21 nt, Artificial Sequence
  Oligomer
ugacaguauuaggaaauccaa

SEQ ID NO: 83130 - RNA, 21 nt, Artificial Sequence
  Oligomer
aagccaacucuaccugcuuuc

SEQ ID NO: 83131 - RNA, 21 nt, Artificial Sequence
  Oligomer
caauccuguuugccauaucuc

SEQ ID NO: 83132 - RNA, 21 nt, Artificial Sequence
  Oligomer
cucuaccugcuuuccauccac

SEQ ID NO: 83133 - RNA, 21 nt, Artificial Sequence
  Oligomer
guuacagccuaauucacaaaa

SEQ ID NO: 83134 - RNA, 21 nt, Artificial Sequence
  Oligomer
uaucucugccuucuucagguu

SEQ ID NO: 83135 - RNA, 21 nt, Artificial Sequence
  Oligomer
ugcuugcagcaagguuucaca

SEQ ID NO: 83136 - RNA, 21 nt, Artificial Sequence
  Oligomer
cugcaugaacuugggcuuuuc

SEQ ID NO: 83137 - RNA, 21 nt, Artificial Sequence
  Oligomer
guaguuggaaaaauuaacugg

SEQ ID NO: 83138 - RNA, 21 nt, Artificial Sequence
  Oligomer
cuuuucugguugagcccauuu

SEQ ID NO: 83139 - RNA, 21 nt, Artificial Sequence
  Oligomer
aauuagcgccuggugugucag

SEQ ID NO: 83140 - RNA, 21 nt, Artificial Sequence
  Oligomer
cagagcuaugccaacaaaauc

SEQ ID NO: 83141 - RNA, 21 nt, Artificial Sequence
  Oligomer
gcuuaaguccaggugagacag

SEQ ID NO: 83142 - RNA, 21 nt, Artificial Sequence
  Oligomer
gaugacuucugauuuguaauc

SEQ ID NO: 83143 - RNA, 21 nt, Artificial Sequence
  Oligomer
agaagagagacugagugccac

SEQ ID NO: 83144 - RNA, 21 nt, Artificial Sequence
  Oligomer
aaguuaccaacuguuucucuu

SEQ ID NO: 83145 - RNA, 21 nt, Artificial Sequence
  Oligomer
accagaguaccuugcagcuga

SEQ ID NO: 83146 - RNA, 21 nt, Artificial Sequence
  Oligomer
cuucaaaauuaaccgcauaag

SEQ ID NO: 83147 - RNA, 21 nt, Artificial Sequence
  Oligomer
ucucuuucuagaaagaagcaa

SEQ ID NO: 83148 - RNA, 21 nt, Artificial Sequence
  Oligomer
ugaacuugggcuuuucugguu

SEQ ID NO: 83149 - RNA, 21 nt, Artificial Sequence
  Oligomer
aaaguuuagucagcuggagag

SEQ ID NO: 83150 - RNA, 21 nt, Artificial Sequence
  Oligomer
guuggacaucguuaauaauca

SEQ ID NO: 83151 - RNA, 21 nt, Artificial Sequence
  Oligomer
guuuucuaaacuaucagggcu

SEQ ID NO: 83152 - RNA, 21 nt, Artificial Sequence
  Oligomer
cuugaauuagcgccuggugug

SEQ ID NO: 83153 - RNA, 21 nt, Artificial Sequence
  Oligomer
uggcuucuaaauacugguagc

SEQ ID NO: 83154 - RNA, 21 nt, Artificial Sequence
  Oligomer
cagggcugucgauggaaaaac

SEQ ID NO: 83155 - RNA, 21 nt, Artificial Sequence
  Oligomer
uagucagcuggagagaagaga

SEQ ID NO: 83156 - RNA, 21 nt, Artificial Sequence
  Oligomer
guuggcuucuaaauacuggua

SEQ ID NO: 83157 - RNA, 21 nt, Artificial Sequence
  Oligomer
acacuccauguacccaaaagc

SEQ ID NO: 83158 - RNA, 21 nt, Artificial Sequence
  Oligomer
ccacagaacuguaacucugcc

SEQ ID NO: 83159 - RNA, 21 nt, Artificial Sequence
  Oligomer
aaaaggccaguaaucauacac

SEQ ID NO: 83160 - RNA, 21 nt, Artificial Sequence
  Oligomer
gccauaucucugccuucuuca

SEQ ID NO: 83161 - RNA, 21 nt, Artificial Sequence
  Oligomer
cgccuugugugcucaucauuc

SEQ ID NO: 83162 - RNA, 21 nt, Artificial Sequence
  Oligomer
acugugaauuagagccagaug

SEQ ID NO: 83163 - RNA, 21 nt, Artificial Sequence
  Oligomer
cucacuccaucuuuggucuuu

SEQ ID NO: 83164 - RNA, 21 nt, Artificial Sequence
  Oligomer
guuggaaaaauuaacugguac

SEQ ID NO: 83165 - RNA, 21 nt, Artificial Sequence
  Oligomer
acagaacuguaacucugccac

SEQ ID NO: 83166 - RNA, 21 nt, Artificial Sequence
  Oligomer
aaguccaggugagacagguua

SEQ ID NO: 83167 - RNA, 21 nt, Artificial Sequence
  Oligomer
caaaaguuaccaacuguuucu

SEQ ID NO: 83168 - RNA, 21 nt, Artificial Sequence
  Oligomer
caggcuccaucaccaacaauc

SEQ ID NO: 83169 - RNA, 21 nt, Artificial Sequence
  Oligomer
agaguaccuugcagcugacag

SEQ ID NO: 83170 - RNA, 21 nt, Artificial Sequence
  Oligomer
aaaccacagaacuguaacucu

SEQ ID NO: 83171 - RNA, 23 nt, Artificial Sequence
  Oligomer
agaugaagcaggagccggugaaa

SEQ ID NO: 83172 - RNA, 23 nt, Artificial Sequence
  Oligomer
gacuaaacuuuuuuucuguacca

SEQ ID NO: 83173 - RNA, 23 nt, Artificial Sequence
  Oligomer
ucuuaacuucuugcuucuuucua

SEQ ID NO: 83174 - RNA, 23 nt, Artificial Sequence
  Oligomer
caacuacuaauagaauaaaggca

SEQ ID NO: 83175 - RNA, 23 nt, Artificial Sequence
  Oligomer
caauggcugccauccggaagaaa

SEQ ID NO: 83176 - RNA, 23 nt, Artificial Sequence
  Oligomer
aagaugaagcaggagccggugaa

SEQ ID NO: 83177 - RNA, 23 nt, Artificial Sequence
  Oligomer
gcuaaguaaauaggaauugguuu

SEQ ID NO: 83178 - RNA, 23 nt, Artificial Sequence
  Oligomer
aauugguuucacgccugaggcaa

SEQ ID NO: 83179 - RNA, 23 nt, Artificial Sequence
  Oligomer
caguuuuuugaaaaugggcucaa

SEQ ID NO: 83180 - RNA, 23 nt, Artificial Sequence
  Oligomer
uguuuuuccaucgacagcccuga

SEQ ID NO: 83181 - RNA, 23 nt, Artificial Sequence
  Oligomer
ccaacuacuaauagaauaaaggc

SEQ ID NO: 83182 - RNA, 23 nt, Artificial Sequence
  Oligomer
cauuucugucccaacgugcccau

SEQ ID NO: 83183 - RNA, 23 nt, Artificial Sequence
  Oligomer
guuuuuccaucgacagcccugau

SEQ ID NO: 83184 - RNA, 23 nt, Artificial Sequence
  Oligomer
guucaugcagcuguggcagaguu

SEQ ID NO: 83185 - RNA, 23 nt, Artificial Sequence
  Oligomer
uuuuuugaaaaugggcucaacca

SEQ ID NO: 83186 - RNA, 23 nt, Artificial Sequence
  Oligomer
guuaguccacggucuggucuuca

SEQ ID NO: 83187 - RNA, 23 nt, Artificial Sequence
  Oligomer
guguuuuuccaucgacagcccug

SEQ ID NO: 83188 - RNA, 23 nt, Artificial Sequence
  Oligomer
uucugucccaacgugcccaucau

SEQ ID NO: 83189 - RNA, 23 nt, Artificial Sequence
  Oligomer
gaauuucuuaacuucuugcuucu

SEQ ID NO: 83190 - RNA, 23 nt, Artificial Sequence
  Oligomer
aaugaugagcacacaaggcggga

SEQ ID NO: 83191 - RNA, 23 nt, Artificial Sequence
  Oligomer
aguguauuuggaaauaaagucag

SEQ ID NO: 83192 - RNA, 23 nt, Artificial Sequence
  Oligomer
cugacuaaacuuuuuuucuguac

SEQ ID NO: 83193 - RNA, 23 nt, Artificial Sequence
  Oligomer
cuaaguaaauaggaauugguuuc

SEQ ID NO: 83194 - RNA, 23 nt, Artificial Sequence
  Oligomer
aguuggcuuugugggacacagcu

SEQ ID NO: 83195 - RNA, 23 nt, Artificial Sequence
  Oligomer
ucguuaguccacggucuggucuu

SEQ ID NO: 83196 - RNA, 23 nt, Artificial Sequence
  Oligomer
gugagucaccacuucagggcuuu

SEQ ID NO: 83197 - RNA, 23 nt, Artificial Sequence
  Oligomer
cuaauucacagugcucuuuucuc

SEQ ID NO: 83198 - RNA, 23 nt, Artificial Sequence
  Oligomer
cuaaacuuuuuuucuguaccagu

SEQ ID NO: 83199 - RNA, 23 nt, Artificial Sequence
  Oligomer
gucacuuuuucugauaaaagaug

SEQ ID NO: 83200 - RNA, 23 nt, Artificial Sequence
  Oligomer
caacuaugauuauuaacgauguc

SEQ ID NO: 83201 - RNA, 23 nt, Artificial Sequence
  Oligomer
gauuuuguuggcauagcucuggg

SEQ ID NO: 83202 - RNA, 23 nt, Artificial Sequence
  Oligomer
aauggcugccauccggaagaaac

SEQ ID NO: 83203 - RNA, 23 nt, Artificial Sequence
  Oligomer
guaaauaggaauugguuucacgc

SEQ ID NO: 83204 - RNA, 23 nt, Artificial Sequence
  Oligomer
auuauuaacgauguccaacccgu

SEQ ID NO: 83205 - RNA, 23 nt, Artificial Sequence
  Oligomer
uauuaacgauguccaacccgucu

SEQ ID NO: 83206 - RNA, 23 nt, Artificial Sequence
  Oligomer
accacuucagggcuuuacuccgu

SEQ ID NO: 83207 - RNA, 23 nt, Artificial Sequence
  Oligomer
aaauggcuacgagagcugcucug

SEQ ID NO: 83208 - RNA, 23 nt, Artificial Sequence
  Oligomer
aagaggcuggacucggauucguu

SEQ ID NO: 83209 - RNA, 23 nt, Artificial Sequence
  Oligomer
gugauuguuggugauggagccug

SEQ ID NO: 83210 - RNA, 23 nt, Artificial Sequence
  Oligomer
uucuuaacuucuugcuucuuucu

SEQ ID NO: 83211 - RNA, 23 nt, Artificial Sequence
  Oligomer
ugacuaaacuuuuuuucuguacc

SEQ ID NO: 83212 - RNA, 23 nt, Artificial Sequence
  Oligomer
auucguugccugagcaauggcug

SEQ ID NO: 83213 - RNA, 23 nt, Artificial Sequence
  Oligomer
acuaaacuuuuuuucuguaccag

SEQ ID NO: 83214 - RNA, 23 nt, Artificial Sequence
  Oligomer
uuaguccacggucuggucuucag

SEQ ID NO: 83215 - RNA, 23 nt, Artificial Sequence
  Oligomer
uuuuugaaaaugggcucaaccag

SEQ ID NO: 83216 - RNA, 23 nt, Artificial Sequence
  Oligomer
uuucugucccaacgugcccauca

SEQ ID NO: 83217 - RNA, 23 nt, Artificial Sequence
  Oligomer
aacuacuaauagaauaaaggcag

SEQ ID NO: 83218 - RNA, 23 nt, Artificial Sequence
  Oligomer
ucuaauucacagugcucuuuucu

SEQ ID NO: 83219 - RNA, 23 nt, Artificial Sequence
  Oligomer
guuuuuugaaaaugggcucaacc

SEQ ID NO: 83220 - RNA, 23 nt, Artificial Sequence
  Oligomer
ucuccucacuguauccagguucc

SEQ ID NO: 83221 - RNA, 23 nt, Artificial Sequence
  Oligomer
aguaaauaggaauugguuucacg

SEQ ID NO: 83222 - RNA, 23 nt, Artificial Sequence
  Oligomer
uuuucuccucacuguauccaggu

SEQ ID NO: 83223 - RNA, 23 nt, Artificial Sequence
  Oligomer
aguuuuuugaaaaugggcucaac

SEQ ID NO: 83224 - RNA, 23 nt, Artificial Sequence
  Oligomer
ucacuuuuucugauaaaagaugg

SEQ ID NO: 83225 - RNA, 23 nt, Artificial Sequence
  Oligomer
uuucuuaacuucuugcuucuuuc

SEQ ID NO: 83226 - RNA, 23 nt, Artificial Sequence
  Oligomer
cacuuuuucugauaaaagauggc

SEQ ID NO: 83227 - RNA, 23 nt, Artificial Sequence
  Oligomer
uuucuccucacuguauccagguu

SEQ ID NO: 83228 - RNA, 23 nt, Artificial Sequence
  Oligomer
auguuauacugauguguuuuucc

SEQ ID NO: 83229 - RNA, 23 nt, Artificial Sequence
  Oligomer
aaguaaauaggaauugguuucac

SEQ ID NO: 83230 - RNA, 23 nt, Artificial Sequence
  Oligomer
uaaauaggaauugguuucacgcc

SEQ ID NO: 83231 - RNA, 23 nt, Artificial Sequence
  Oligomer
aacuaugauuauuaacgaugucc

SEQ ID NO: 83232 - RNA, 23 nt, Artificial Sequence
  Oligomer
cuuuucuccucacuguauccagg

SEQ ID NO: 83233 - RNA, 23 nt, Artificial Sequence
  Oligomer
uuaacgauguccaacccgucugg

SEQ ID NO: 83234 - RNA, 23 nt, Artificial Sequence
  Oligomer
uaauucacagugcucuuuucucc

SEQ ID NO: 83235 - RNA, 23 nt, Artificial Sequence
  Oligomer
uuauuaacgauguccaacccguc

SEQ ID NO: 83236 - RNA, 23 nt, Artificial Sequence
  Oligomer
aaacaucccagaaaaguggaccc

SEQ ID NO: 83237 - RNA, 23 nt, Artificial Sequence
  Oligomer
auuaacgauguccaacccgucug

SEQ ID NO: 83238 - RNA, 23 nt, Artificial Sequence
  Oligomer
uuucaccggcuccugcuucaucu

SEQ ID NO: 83239 - RNA, 23 nt, Artificial Sequence
  Oligomer
ugguacagaaaaaaaguuuaguc

SEQ ID NO: 83240 - RNA, 23 nt, Artificial Sequence
  Oligomer
uagaaagaagcaagaaguuaaga

SEQ ID NO: 83241 - RNA, 23 nt, Artificial Sequence
  Oligomer
ugccuuuauucuauuaguaguug

SEQ ID NO: 83242 - RNA, 23 nt, Artificial Sequence
  Oligomer
uuucuuccggauggcagccauug

SEQ ID NO: 83243 - RNA, 23 nt, Artificial Sequence
  Oligomer
uucaccggcuccugcuucaucuu

SEQ ID NO: 83244 - RNA, 23 nt, Artificial Sequence
  Oligomer
aaaccaauuccuauuuacuuagc

SEQ ID NO: 83245 - RNA, 23 nt, Artificial Sequence
  Oligomer
uugccucaggcgugaaaccaauu

SEQ ID NO: 83246 - RNA, 23 nt, Artificial Sequence
  Oligomer
uugagcccauuuucaaaaaacug

SEQ ID NO: 83247 - RNA, 23 nt, Artificial Sequence
  Oligomer
ucagggcugucgauggaaaaaca

SEQ ID NO: 83248 - RNA, 23 nt, Artificial Sequence
  Oligomer
gccuuuauucuauuaguaguugg

SEQ ID NO: 83249 - RNA, 23 nt, Artificial Sequence
  Oligomer
augggcacguugggacagaaaug

SEQ ID NO: 83250 - RNA, 23 nt, Artificial Sequence
  Oligomer
aucagggcugucgauggaaaaac

SEQ ID NO: 83251 - RNA, 23 nt, Artificial Sequence
  Oligomer
aacucugccacagcugcaugaac

SEQ ID NO: 83252 - RNA, 23 nt, Artificial Sequence
  Oligomer
ugguugagcccauuuucaaaaaa

SEQ ID NO: 83253 - RNA, 23 nt, Artificial Sequence
  Oligomer
ugaagaccagaccguggacuaac

SEQ ID NO: 83254 - RNA, 23 nt, Artificial Sequence
  Oligomer
cagggcugucgauggaaaaacac

SEQ ID NO: 83255 - RNA, 23 nt, Artificial Sequence
  Oligomer
augaugggcacguugggacagaa

SEQ ID NO: 83256 - RNA, 23 nt, Artificial Sequence
  Oligomer
agaagcaagaaguuaagaaauuc

SEQ ID NO: 83257 - RNA, 23 nt, Artificial Sequence
  Oligomer
ucccgccuugugugcucaucauu

SEQ ID NO: 83258 - RNA, 23 nt, Artificial Sequence
  Oligomer
cugacuuuauuuccaaauacacu

SEQ ID NO: 83259 - RNA, 23 nt, Artificial Sequence
  Oligomer
guacagaaaaaaaguuuagucag

SEQ ID NO: 83260 - RNA, 23 nt, Artificial Sequence
  Oligomer
gaaaccaauuccuauuuacuuag

SEQ ID NO: 83261 - RNA, 23 nt, Artificial Sequence
  Oligomer
agcugugucccacaaagccaacu

SEQ ID NO: 83262 - RNA, 23 nt, Artificial Sequence
  Oligomer
aagaccagaccguggacuaacga

SEQ ID NO: 83263 - RNA, 23 nt, Artificial Sequence
  Oligomer
aaagcccugaaguggugacucac

SEQ ID NO: 83264 - RNA, 23 nt, Artificial Sequence
  Oligomer
gagaaaagagcacugugaauuag

SEQ ID NO: 83265 - RNA, 23 nt, Artificial Sequence
  Oligomer
acugguacagaaaaaaaguuuag

SEQ ID NO: 83266 - RNA, 23 nt, Artificial Sequence
  Oligomer
caucuuuuaucagaaaaagugac

SEQ ID NO: 83267 - RNA, 23 nt, Artificial Sequence
  Oligomer
gacaucguuaauaaucauaguug

SEQ ID NO: 83268 - RNA, 23 nt, Artificial Sequence
  Oligomer
cccagagcuaugccaacaaaauc

SEQ ID NO: 83269 - RNA, 23 nt, Artificial Sequence
  Oligomer
guuucuuccggauggcagccauu

SEQ ID NO: 83270 - RNA, 23 nt, Artificial Sequence
  Oligomer
gcgugaaaccaauuccuauuuac

SEQ ID NO: 83271 - RNA, 23 nt, Artificial Sequence
  Oligomer
acggguuggacaucguuaauaau

SEQ ID NO: 83272 - RNA, 23 nt, Artificial Sequence
  Oligomer
agacggguuggacaucguuaaua

SEQ ID NO: 83273 - RNA, 23 nt, Artificial Sequence
  Oligomer
acggaguaaagcccugaaguggu

SEQ ID NO: 83274 - RNA, 23 nt, Artificial Sequence
  Oligomer
cagagcagcucucguagccauuu

SEQ ID NO: 83275 - RNA, 23 nt, Artificial Sequence
  Oligomer
aacgaauccgaguccagccucuu

SEQ ID NO: 83276 - RNA, 23 nt, Artificial Sequence
  Oligomer
caggcuccaucaccaacaaucac

SEQ ID NO: 83277 - RNA, 23 nt, Artificial Sequence
  Oligomer
agaaagaagcaagaaguuaagaa

SEQ ID NO: 83278 - RNA, 23 nt, Artificial Sequence
  Oligomer
gguacagaaaaaaaguuuaguca

SEQ ID NO: 83279 - RNA, 23 nt, Artificial Sequence
  Oligomer
cagccauugcucaggcaacgaau

SEQ ID NO: 83280 - RNA, 23 nt, Artificial Sequence
  Oligomer
cugguacagaaaaaaaguuuagu

SEQ ID NO: 83281 - RNA, 23 nt, Artificial Sequence
  Oligomer
cugaagaccagaccguggacuaa

SEQ ID NO: 83282 - RNA, 23 nt, Artificial Sequence
  Oligomer
cugguugagcccauuuucaaaaa

SEQ ID NO: 83283 - RNA, 23 nt, Artificial Sequence
  Oligomer
ugaugggcacguugggacagaaa

SEQ ID NO: 83284 - RNA, 23 nt, Artificial Sequence
  Oligomer
cugccuuuauucuauuaguaguu

SEQ ID NO: 83285 - RNA, 23 nt, Artificial Sequence
  Oligomer
agaaaagagcacugugaauuaga

SEQ ID NO: 83286 - RNA, 23 nt, Artificial Sequence
  Oligomer
gguugagcccauuuucaaaaaac

SEQ ID NO: 83287 - RNA, 23 nt, Artificial Sequence
  Oligomer
ggaaccuggauacagugaggaga

SEQ ID NO: 83288 - RNA, 23 nt, Artificial Sequence
  Oligomer
cgugaaaccaauuccuauuuacu

SEQ ID NO: 83289 - RNA, 23 nt, Artificial Sequence
  Oligomer
accuggauacagugaggagaaaa

SEQ ID NO: 83290 - RNA, 23 nt, Artificial Sequence
  Oligomer
guugagcccauuuucaaaaaacu

SEQ ID NO: 83291 - RNA, 23 nt, Artificial Sequence
  Oligomer
ccaucuuuuaucagaaaaaguga

SEQ ID NO: 83292 - RNA, 23 nt, Artificial Sequence
  Oligomer
gaaagaagcaagaaguuaagaaa

SEQ ID NO: 83293 - RNA, 23 nt, Artificial Sequence
  Oligomer
gccaucuuuuaucagaaaaagug

SEQ ID NO: 83294 - RNA, 23 nt, Artificial Sequence
  Oligomer
aaccuggauacagugaggagaaa

SEQ ID NO: 83295 - RNA, 23 nt, Artificial Sequence
  Oligomer
ggaaaaacacaucaguauaacau

SEQ ID NO: 83296 - RNA, 23 nt, Artificial Sequence
  Oligomer
gugaaaccaauuccuauuuacuu

SEQ ID NO: 83297 - RNA, 23 nt, Artificial Sequence
  Oligomer
ggcgugaaaccaauuccuauuua

SEQ ID NO: 83298 - RNA, 23 nt, Artificial Sequence
  Oligomer
ggacaucguuaauaaucauaguu

SEQ ID NO: 83299 - RNA, 23 nt, Artificial Sequence
  Oligomer
ccuggauacagugaggagaaaag

SEQ ID NO: 83300 - RNA, 23 nt, Artificial Sequence
  Oligomer
ccagacggguuggacaucguuaa

SEQ ID NO: 83301 - RNA, 23 nt, Artificial Sequence
  Oligomer
ggagaaaagagcacugugaauua

SEQ ID NO: 83302 - RNA, 23 nt, Artificial Sequence
  Oligomer
gacggguuggacaucguuaauaa

SEQ ID NO: 83303 - RNA, 23 nt, Artificial Sequence
  Oligomer
ggguccacuuuucugggauguuu

SEQ ID NO: 83304 - RNA, 23 nt, Artificial Sequence
  Oligomer
cagacggguuggacaucguuaau

SEQ ID NO: 83305 - RNA, 23 nt, Artificial Sequence
  Oligomer
uuaggcuguaacuacuuuauaac

SEQ ID NO: 83306 - RNA, 23 nt, Artificial Sequence
  Oligomer
gaccaaagauggagugagagagg

SEQ ID NO: 83307 - RNA, 23 nt, Artificial Sequence
  Oligomer
cccagauaccgauguuauacuga

SEQ ID NO: 83308 - RNA, 23 nt, Artificial Sequence
  Oligomer
acccagauaccgauguuauacug

SEQ ID NO: 83309 - RNA, 23 nt, Artificial Sequence
  Oligomer
uacccagauaccgauguuauacu

SEQ ID NO: 83310 - RNA, 23 nt, Artificial Sequence
  Oligomer
cuacccagauaccgauguuauac

SEQ ID NO: 83311 - RNA, 23 nt, Artificial Sequence
  Oligomer
ccuacccagauaccgauguuaua

SEQ ID NO: 83312 - RNA, 23 nt, Artificial Sequence
  Oligomer
accaaagauggagugagagaggu

SEQ ID NO: 83313 - RNA, 23 nt, Artificial Sequence
  Oligomer
gauuauuaacgauguccaacccg

SEQ ID NO: 83314 - RNA, 23 nt, Artificial Sequence
  Oligomer
cgacagcccugauaguuuagaaa

SEQ ID NO: 83315 - RNA, 23 nt, Artificial Sequence
  Oligomer
ggagcugggcuaaguaaauagga

SEQ ID NO: 83316 - RNA, 23 nt, Artificial Sequence
  Oligomer
uggagcugggcuaaguaaauagg

SEQ ID NO: 83317 - RNA, 23 nt, Artificial Sequence
  Oligomer
auggagcugggcuaaguaaauag

SEQ ID NO: 83318 - RNA, 23 nt, Artificial Sequence
  Oligomer
cauggagcugggcuaaguaaaua

SEQ ID NO: 83319 - RNA, 23 nt, Artificial Sequence
  Oligomer
ccauggagcugggcuaaguaaau

SEQ ID NO: 83320 - RNA, 23 nt, Artificial Sequence
  Oligomer
gauggagugagagagguuuuuga

SEQ ID NO: 83321 - RNA, 23 nt, Artificial Sequence
  Oligomer
gaauaaaggcaguuuucuaaaaa

SEQ ID NO: 83322 - RNA, 23 nt, Artificial Sequence
  Oligomer
agaauaaaggcaguuuucuaaaa

SEQ ID NO: 83323 - RNA, 23 nt, Artificial Sequence
  Oligomer
uagaauaaaggcaguuuucuaaa

SEQ ID NO: 83324 - RNA, 23 nt, Artificial Sequence
  Oligomer
gagcugggcuaaguaaauaggaa

SEQ ID NO: 83325 - RNA, 23 nt, Artificial Sequence
  Oligomer
cccauggagcugggcuaaguaaa

SEQ ID NO: 83326 - RNA, 23 nt, Artificial Sequence
  Oligomer
ccccauggagcugggcuaaguaa

SEQ ID NO: 83327 - RNA, 23 nt, Artificial Sequence
  Oligomer
accccauggagcugggcuaagua

SEQ ID NO: 83328 - RNA, 23 nt, Artificial Sequence
  Oligomer
ggaaagacaugcuugcucauagu

SEQ ID NO: 83329 - RNA, 23 nt, Artificial Sequence
  Oligomer
uggaaagacaugcuugcucauag

SEQ ID NO: 83330 - RNA, 23 nt, Artificial Sequence
  Oligomer
guggaaagacaugcuugcucaua

SEQ ID NO: 83331 - RNA, 23 nt, Artificial Sequence
  Oligomer
uguggaaagacaugcuugcucau

SEQ ID NO: 83332 - RNA, 23 nt, Artificial Sequence
  Oligomer
cuguggaaagacaugcuugcuca

SEQ ID NO: 83333 - RNA, 23 nt, Artificial Sequence
  Oligomer
gccggugaaaccugaagaaggca

SEQ ID NO: 83334 - RNA, 23 nt, Artificial Sequence
  Oligomer
agccggugaaaccugaagaaggc

SEQ ID NO: 83335 - RNA, 23 nt, Artificial Sequence
  Oligomer
gagccggugaaaccugaagaagg

SEQ ID NO: 83336 - RNA, 23 nt, Artificial Sequence
  Oligomer
ggagccggugaaaccugaagaag

SEQ ID NO: 83337 - RNA, 23 nt, Artificial Sequence
  Oligomer
aggagccggugaaaccugaagaa

SEQ ID NO: 83338 - RNA, 23 nt, Artificial Sequence
  Oligomer
auaucgagguggauggaaagcag

SEQ ID NO: 83339 - RNA, 23 nt, Artificial Sequence
  Oligomer
gauaucgagguggauggaaagca

SEQ ID NO: 83340 - RNA, 23 nt, Artificial Sequence
  Oligomer
agauaucgagguggauggaaagc

SEQ ID NO: 83341 - RNA, 23 nt, Artificial Sequence
  Oligomer
cagauaucgagguggauggaaag

SEQ ID NO: 83342 - RNA, 23 nt, Artificial Sequence
  Oligomer
gcagauaucgagguggauggaaa

SEQ ID NO: 83343 - RNA, 23 nt, Artificial Sequence
  Oligomer
ccacaguguuugagaacuaugug

SEQ ID NO: 83344 - RNA, 23 nt, Artificial Sequence
  Oligomer
cccacaguguuugagaacuaugu

SEQ ID NO: 83345 - RNA, 23 nt, Artificial Sequence
  Oligomer
gcccacaguguuugagaacuaug

SEQ ID NO: 83346 - RNA, 23 nt, Artificial Sequence
  Oligomer
ugcccacaguguuugagaacuau

SEQ ID NO: 83347 - RNA, 23 nt, Artificial Sequence
  Oligomer
gugcccacaguguuugagaacua

SEQ ID NO: 83348 - RNA, 23 nt, Artificial Sequence
  Oligomer
gauggagccuguggaaagacaug

SEQ ID NO: 83349 - RNA, 23 nt, Artificial Sequence
  Oligomer
ugauggagccuguggaaagacau

SEQ ID NO: 83350 - RNA, 23 nt, Artificial Sequence
  Oligomer
gugauggagccuguggaaagaca

SEQ ID NO: 83351 - RNA, 23 nt, Artificial Sequence
  Oligomer
ggugauggagccuguggaaagac

SEQ ID NO: 83352 - RNA, 23 nt, Artificial Sequence
  Oligomer
uggugauggagccuguggaaaga

SEQ ID NO: 83353 - RNA, 23 nt, Artificial Sequence
  Oligomer
gaaaaugggcucaaccagaaaag

SEQ ID NO: 83354 - RNA, 23 nt, Artificial Sequence
  Oligomer
ugaaaaugggcucaaccagaaaa

SEQ ID NO: 83355 - RNA, 23 nt, Artificial Sequence
  Oligomer
uugaaaaugggcucaaccagaaa

SEQ ID NO: 83356 - RNA, 23 nt, Artificial Sequence
  Oligomer
uuugaaaaugggcucaaccagaa

SEQ ID NO: 83357 - RNA, 23 nt, Artificial Sequence
  Oligomer
uuuugaaaaugggcucaaccaga

SEQ ID NO: 83358 - RNA, 23 nt, Artificial Sequence
  Oligomer
accaguauuuagaagccaacuau

SEQ ID NO: 83359 - RNA, 23 nt, Artificial Sequence
  Oligomer
ggagccuguggaaagacaugcuu

SEQ ID NO: 83360 - RNA, 23 nt, Artificial Sequence
  Oligomer
uggagccuguggaaagacaugcu

SEQ ID NO: 83361 - RNA, 23 nt, Artificial Sequence
  Oligomer
auggagccuguggaaagacaugc

SEQ ID NO: 83362 - RNA, 23 nt, Artificial Sequence
  Oligomer
gauaaaagauggccauauuaccc

SEQ ID NO: 83363 - RNA, 23 nt, Artificial Sequence
  Oligomer
agcugggcaggaagauuaugauc

SEQ ID NO: 83364 - RNA, 23 nt, Artificial Sequence
  Oligomer
cagcugggcaggaagauuaugau

SEQ ID NO: 83365 - RNA, 23 nt, Artificial Sequence
  Oligomer
acagcugggcaggaagauuauga

SEQ ID NO: 83366 - RNA, 23 nt, Artificial Sequence
  Oligomer
cacagcugggcaggaagauuaug

SEQ ID NO: 83367 - RNA, 23 nt, Artificial Sequence
  Oligomer
acacagcugggcaggaagauuau

SEQ ID NO: 83368 - RNA, 23 nt, Artificial Sequence
  Oligomer
ggcagauaucgagguggauggaa

SEQ ID NO: 83369 - RNA, 23 nt, Artificial Sequence
  Oligomer
uggcagauaucgagguggaugga

SEQ ID NO: 83370 - RNA, 23 nt, Artificial Sequence
  Oligomer
guggcagauaucgagguggaugg

SEQ ID NO: 83371 - RNA, 23 nt, Artificial Sequence
  Oligomer
uguggcagauaucgagguggaug

SEQ ID NO: 83372 - RNA, 23 nt, Artificial Sequence
  Oligomer
auguggcagauaucgagguggau

SEQ ID NO: 83373 - RNA, 23 nt, Artificial Sequence
  Oligomer
gaaauaaagucagauggaaaauu

SEQ ID NO: 83374 - RNA, 23 nt, Artificial Sequence
  Oligomer
ggaaauaaagucagauggaaaau

SEQ ID NO: 83375 - RNA, 23 nt, Artificial Sequence
  Oligomer
cagcuguggcagaguuacaguuc

SEQ ID NO: 83376 - RNA, 23 nt, Artificial Sequence
  Oligomer
gcagcuguggcagaguuacaguu

SEQ ID NO: 83377 - RNA, 23 nt, Artificial Sequence
  Oligomer
ugcagcuguggcagaguuacagu

SEQ ID NO: 83378 - RNA, 23 nt, Artificial Sequence
  Oligomer
augcagcuguggcagaguuacag

SEQ ID NO: 83379 - RNA, 23 nt, Artificial Sequence
  Oligomer
caugcagcuguggcagaguuaca

SEQ ID NO: 83380 - RNA, 23 nt, Artificial Sequence
  Oligomer
gguggauggaaagcagguagagu

SEQ ID NO: 83381 - RNA, 23 nt, Artificial Sequence
  Oligomer
agguggauggaaagcagguagag

SEQ ID NO: 83382 - RNA, 23 nt, Artificial Sequence
  Oligomer
gagguggauggaaagcagguaga

SEQ ID NO: 83383 - RNA, 23 nt, Artificial Sequence
  Oligomer
cgagguggauggaaagcagguag

SEQ ID NO: 83384 - RNA, 23 nt, Artificial Sequence
  Oligomer
ucgagguggauggaaagcaggua

SEQ ID NO: 83385 - RNA, 23 nt, Artificial Sequence
  Oligomer
agaacuauguggcagauaucgag

SEQ ID NO: 83386 - RNA, 23 nt, Artificial Sequence
  Oligomer
gagaacuauguggcagauaucga

SEQ ID NO: 83387 - RNA, 23 nt, Artificial Sequence
  Oligomer
ugagaacuauguggcagauaucg

SEQ ID NO: 83388 - RNA, 23 nt, Artificial Sequence
  Oligomer
uugagaacuauguggcagauauc

SEQ ID NO: 83389 - RNA, 23 nt, Artificial Sequence
  Oligomer
uuugagaacuauguggcagauau

SEQ ID NO: 83390 - RNA, 23 nt, Artificial Sequence
  Oligomer
aaaugggcucaaccagaaaagcc

SEQ ID NO: 83391 - RNA, 23 nt, Artificial Sequence
  Oligomer
aaaaugggcucaaccagaaaagc

SEQ ID NO: 83392 - RNA, 23 nt, Artificial Sequence
  Oligomer
aagucagauggaaaauucauuuu

SEQ ID NO: 83393 - RNA, 23 nt, Artificial Sequence
  Oligomer
gacacagcugggcaggaagauua

SEQ ID NO: 83394 - RNA, 23 nt, Artificial Sequence
  Oligomer
uuggaagauggcauaaccugucu

SEQ ID NO: 83395 - RNA, 23 nt, Artificial Sequence
  Oligomer
uuuggaagauggcauaaccuguc

SEQ ID NO: 83396 - RNA, 23 nt, Artificial Sequence
  Oligomer
cuuuggaagauggcauaaccugu

SEQ ID NO: 83397 - RNA, 23 nt, Artificial Sequence
  Oligomer
aaaccuugcugcaagcacagccc

SEQ ID NO: 83398 - RNA, 23 nt, Artificial Sequence
  Oligomer
gaaaccuugcugcaagcacagcc

SEQ ID NO: 83399 - RNA, 23 nt, Artificial Sequence
  Oligomer
ugaaaccuugcugcaagcacagc

SEQ ID NO: 83400 - RNA, 23 nt, Artificial Sequence
  Oligomer
gugaaaccuugcugcaagcacag

SEQ ID NO: 83401 - RNA, 23 nt, Artificial Sequence
  Oligomer
ugugaaaccuugcugcaagcaca

SEQ ID NO: 83402 - RNA, 23 nt, Artificial Sequence
  Oligomer
cugcaagcuagacgugggaagaa

SEQ ID NO: 83403 - RNA, 23 nt, Artificial Sequence
  Oligomer
ucugcaagcuagacgugggaaga

SEQ ID NO: 83404 - RNA, 23 nt, Artificial Sequence
  Oligomer
ugugcccacaguguuugagaacu

SEQ ID NO: 83405 - RNA, 23 nt, Artificial Sequence
  Oligomer
augugcccacaguguuugagaac

SEQ ID NO: 83406 - RNA, 23 nt, Artificial Sequence
  Oligomer
uaugugcccacaguguuugagaa

SEQ ID NO: 83407 - RNA, 23 nt, Artificial Sequence
  Oligomer
ugggcaggaagauuaugaucgcc

SEQ ID NO: 83408 - RNA, 23 nt, Artificial Sequence
  Oligomer
cugggcaggaagauuaugaucgc

SEQ ID NO: 83409 - RNA, 23 nt, Artificial Sequence
  Oligomer
gcugggcaggaagauuaugaucg

SEQ ID NO: 83410 - RNA, 23 nt, Artificial Sequence
  Oligomer
accuaagauuacaaaucagaagu

SEQ ID NO: 83411 - RNA, 23 nt, Artificial Sequence
  Oligomer
uaccuaagauuacaaaucagaag

SEQ ID NO: 83412 - RNA, 23 nt, Artificial Sequence
  Oligomer
uuaccuaagauuacaaaucagaa

SEQ ID NO: 83413 - RNA, 23 nt, Artificial Sequence
  Oligomer
uaacuucuugcuucuuucuagaa

SEQ ID NO: 83414 - RNA, 23 nt, Artificial Sequence
  Oligomer
uuaacuucuugcuucuuucuaga

SEQ ID NO: 83415 - RNA, 23 nt, Artificial Sequence
  Oligomer
gaagauuaugaucgccugaggcc

SEQ ID NO: 83416 - RNA, 23 nt, Artificial Sequence
  Oligomer
ggaagauuaugaucgccugaggc

SEQ ID NO: 83417 - RNA, 23 nt, Artificial Sequence
  Oligomer
aggaagauuaugaucgccugagg

SEQ ID NO: 83418 - RNA, 23 nt, Artificial Sequence
  Oligomer
caggaagauuaugaucgccugag

SEQ ID NO: 83419 - RNA, 23 nt, Artificial Sequence
  Oligomer
gcaggaagauuaugaucgccuga

SEQ ID NO: 83420 - RNA, 23 nt, Artificial Sequence
  Oligomer
gaguuggcuuugugggacacagc

SEQ ID NO: 83421 - RNA, 23 nt, Artificial Sequence
  Oligomer
agaguuggcuuugugggacacag

SEQ ID NO: 83422 - RNA, 23 nt, Artificial Sequence
  Oligomer
uagaguuggcuuugugggacaca

SEQ ID NO: 83423 - RNA, 23 nt, Artificial Sequence
  Oligomer
guagaguuggcuuugugggacac

SEQ ID NO: 83424 - RNA, 23 nt, Artificial Sequence
  Oligomer
gguagaguuggcuuugugggaca

SEQ ID NO: 83425 - RNA, 23 nt, Artificial Sequence
  Oligomer
ggcaggaagauuaugaucgccug

SEQ ID NO: 83426 - RNA, 23 nt, Artificial Sequence
  Oligomer
guuugagaacuauguggcagaua

SEQ ID NO: 83427 - RNA, 23 nt, Artificial Sequence
  Oligomer
uguuugagaacuauguggcagau

SEQ ID NO: 83428 - RNA, 23 nt, Artificial Sequence
  Oligomer
guguuugagaacuauguggcaga

SEQ ID NO: 83429 - RNA, 23 nt, Artificial Sequence
  Oligomer
aguguuugagaacuauguggcag

SEQ ID NO: 83430 - RNA, 23 nt, Artificial Sequence
  Oligomer
caguguuugagaacuauguggca

SEQ ID NO: 83431 - RNA, 23 nt, Artificial Sequence
  Oligomer
cagaagucaucuugcuaccagua

SEQ ID NO: 83432 - RNA, 23 nt, Artificial Sequence
  Oligomer
uagaaaacaucccagaaaagugg

SEQ ID NO: 83433 - RNA, 23 nt, Artificial Sequence
  Oligomer
uuagaaaacaucccagaaaagug

SEQ ID NO: 83434 - RNA, 23 nt, Artificial Sequence
  Oligomer
ggauucguugccugagcaauggc

SEQ ID NO: 83435 - RNA, 23 nt, Artificial Sequence
  Oligomer
cggauucguugccugagcaaugg

SEQ ID NO: 83436 - RNA, 23 nt, Artificial Sequence
  Oligomer
ucggauucguugccugagcaaug

SEQ ID NO: 83437 - RNA, 23 nt, Artificial Sequence
  Oligomer
cucggauucguugccugagcaau

SEQ ID NO: 83438 - RNA, 23 nt, Artificial Sequence
  Oligomer
acucggauucguugccugagcaa

SEQ ID NO: 83439 - RNA, 23 nt, Artificial Sequence
  Oligomer
gugaaaccugaagaaggcagaga

SEQ ID NO: 83440 - RNA, 23 nt, Artificial Sequence
  Oligomer
ggugaaaccugaagaaggcagag

SEQ ID NO: 83441 - RNA, 23 nt, Artificial Sequence
  Oligomer
cggugaaaccugaagaaggcaga

SEQ ID NO: 83442 - RNA, 23 nt, Artificial Sequence
  Oligomer
ccaaguucaugcagcuguggcag

SEQ ID NO: 83443 - RNA, 23 nt, Artificial Sequence
  Oligomer
cccaaguucaugcagcuguggca

SEQ ID NO: 83444 - RNA, 23 nt, Artificial Sequence
  Oligomer
gcccaaguucaugcagcuguggc

SEQ ID NO: 83445 - RNA, 23 nt, Artificial Sequence
  Oligomer
guuuuugaaauggcuacgagagc

SEQ ID NO: 83446 - RNA, 23 nt, Artificial Sequence
  Oligomer
gguuuuugaaauggcuacgagag

SEQ ID NO: 83447 - RNA, 23 nt, Artificial Sequence
  Oligomer
gcaucuggcucuaauucacagug

SEQ ID NO: 83448 - RNA, 23 nt, Artificial Sequence
  Oligomer
agcaucuggcucuaauucacagu

SEQ ID NO: 83449 - RNA, 23 nt, Artificial Sequence
  Oligomer
aagcaucuggcucuaauucacag

SEQ ID NO: 83450 - RNA, 23 nt, Artificial Sequence
  Oligomer
uaagcaucuggcucuaauucaca

SEQ ID NO: 83451 - RNA, 23 nt, Artificial Sequence
  Oligomer
uuaagcaucuggcucuaauucac

SEQ ID NO: 83452 - RNA, 23 nt, Artificial Sequence
  Oligomer
acaguguuugagaacuauguggc

SEQ ID NO: 83453 - RNA, 23 nt, Artificial Sequence
  Oligomer
cacaguguuugagaacuaugugg

SEQ ID NO: 83454 - RNA, 23 nt, Artificial Sequence
  Oligomer
uauguggcagauaucgaggugga

SEQ ID NO: 83455 - RNA, 23 nt, Artificial Sequence
  Oligomer
auguguuuuuccaucgacagccc

SEQ ID NO: 83456 - RNA, 23 nt, Artificial Sequence
  Oligomer
gauguguuuuuccaucgacagcc

SEQ ID NO: 83457 - RNA, 23 nt, Artificial Sequence
  Oligomer
ugauguguuuuuccaucgacagc

SEQ ID NO: 83458 - RNA, 23 nt, Artificial Sequence
  Oligomer
cugauguguuuuuccaucgacag

SEQ ID NO: 83459 - RNA, 23 nt, Artificial Sequence
  Oligomer
acugauguguuuuuccaucgaca

SEQ ID NO: 83460 - RNA, 23 nt, Artificial Sequence
  Oligomer
gaaugaugagcacacaaggcggg

SEQ ID NO: 83461 - RNA, 23 nt, Artificial Sequence
  Oligomer
ggaaugaugagcacacaaggcgg

SEQ ID NO: 83462 - RNA, 23 nt, Artificial Sequence
  Oligomer
aguauuuagaagccaacuaugau

SEQ ID NO: 83463 - RNA, 23 nt, Artificial Sequence
  Oligomer
caguauuuagaagccaacuauga

SEQ ID NO: 83464 - RNA, 23 nt, Artificial Sequence
  Oligomer
ccaguauuuagaagccaacuaug

SEQ ID NO: 83465 - RNA, 23 nt, Artificial Sequence
  Oligomer
cuauuaucugucagcugcaaggu

SEQ ID NO: 83466 - RNA, 23 nt, Artificial Sequence
  Oligomer
ccuauuaucugucagcugcaagg

SEQ ID NO: 83467 - RNA, 23 nt, Artificial Sequence
  Oligomer
caucuggcucuaauucacagugc

SEQ ID NO: 83468 - RNA, 23 nt, Artificial Sequence
  Oligomer
ucaugcagcuguggcagaguuac

SEQ ID NO: 83469 - RNA, 23 nt, Artificial Sequence
  Oligomer
uucaugcagcuguggcagaguua

SEQ ID NO: 83470 - RNA, 23 nt, Artificial Sequence
  Oligomer
ugguuucacgccugaggcaauua

SEQ ID NO: 83471 - RNA, 23 nt, Artificial Sequence
  Oligomer
uugguuucacgccugaggcaauu

SEQ ID NO: 83472 - RNA, 23 nt, Artificial Sequence
  Oligomer
auugguuucacgccugaggcaau

SEQ ID NO: 83473 - RNA, 23 nt, Artificial Sequence
  Oligomer
uaugauuacuggccuuuuucauu

SEQ ID NO: 83474 - RNA, 23 nt, Artificial Sequence
  Oligomer
guaugauuacuggccuuuuucau

SEQ ID NO: 83475 - RNA, 23 nt, Artificial Sequence
  Oligomer
guuucauguuaguuaccuuauag

SEQ ID NO: 83476 - RNA, 23 nt, Artificial Sequence
  Oligomer
gguuucauguuaguuaccuuaua

SEQ ID NO: 83477 - RNA, 23 nt, Artificial Sequence
  Oligomer
ugguuucauguuaguuaccuuau

SEQ ID NO: 83478 - RNA, 23 nt, Artificial Sequence
  Oligomer
gugguuucauguuaguuaccuua

SEQ ID NO: 83479 - RNA, 23 nt, Artificial Sequence
  Oligomer
ugugguuucauguuaguuaccuu

SEQ ID NO: 83480 - RNA, 23 nt, Artificial Sequence
  Oligomer
uuuugacacugcucuaacagccc

SEQ ID NO: 83481 - RNA, 23 nt, Artificial Sequence
  Oligomer
cuuuugacacugcucuaacagcc

SEQ ID NO: 83482 - RNA, 23 nt, Artificial Sequence
  Oligomer
cugucagcugcaagguacucugg

SEQ ID NO: 83483 - RNA, 23 nt, Artificial Sequence
  Oligomer
ucugucagcugcaagguacucug

SEQ ID NO: 83484 - RNA, 23 nt, Artificial Sequence
  Oligomer
aucugucagcugcaagguacucu

SEQ ID NO: 83485 - RNA, 23 nt, Artificial Sequence
  Oligomer
uaucugucagcugcaagguacuc

SEQ ID NO: 83486 - RNA, 23 nt, Artificial Sequence
  Oligomer
uuaucugucagcugcaagguacu

SEQ ID NO: 83487 - RNA, 23 nt, Artificial Sequence
  Oligomer
agucagauggaaaauucauuuuu

SEQ ID NO: 83488 - RNA, 23 nt, Artificial Sequence
  Oligomer
uguuggugauggagccuguggaa

SEQ ID NO: 83489 - RNA, 23 nt, Artificial Sequence
  Oligomer
uuguuggugauggagccugugga

SEQ ID NO: 83490 - RNA, 23 nt, Artificial Sequence
  Oligomer
auuguuggugauggagccugugg

SEQ ID NO: 83491 - RNA, 23 nt, Artificial Sequence
  Oligomer
gauuguuggugauggagccugug

SEQ ID NO: 83492 - RNA, 23 nt, Artificial Sequence
  Oligomer
ugauuguuggugauggagccugu

SEQ ID NO: 83493 - RNA, 23 nt, Artificial Sequence
  Oligomer
uguaugauuacuggccuuuuuca

SEQ ID NO: 83494 - RNA, 23 nt, Artificial Sequence
  Oligomer
cuauguggcagauaucgaggugg

SEQ ID NO: 83495 - RNA, 23 nt, Artificial Sequence
  Oligomer
acuauguggcagauaucgaggug

SEQ ID NO: 83496 - RNA, 23 nt, Artificial Sequence
  Oligomer
aacuauguggcagauaucgaggu

SEQ ID NO: 83497 - RNA, 23 nt, Artificial Sequence
  Oligomer
gaacuauguggcagauaucgagg

SEQ ID NO: 83498 - RNA, 23 nt, Artificial Sequence
  Oligomer
uagccaagaugaagcaggagccg

SEQ ID NO: 83499 - RNA, 23 nt, Artificial Sequence
  Oligomer
cuagccaagaugaagcaggagcc

SEQ ID NO: 83500 - RNA, 23 nt, Artificial Sequence
  Oligomer
gcuagccaagaugaagcaggagc

SEQ ID NO: 83501 - RNA, 23 nt, Artificial Sequence
  Oligomer
uggauggaaagcagguagaguug

SEQ ID NO: 83502 - RNA, 23 nt, Artificial Sequence
  Oligomer
guggauggaaagcagguagaguu

SEQ ID NO: 83503 - RNA, 23 nt, Artificial Sequence
  Oligomer
cugugguuucauguuaguuaccu

SEQ ID NO: 83504 - RNA, 23 nt, Artificial Sequence
  Oligomer
ucugugguuucauguuaguuacc

SEQ ID NO: 83505 - RNA, 23 nt, Artificial Sequence
  Oligomer
uucugugguuucauguuaguuac

SEQ ID NO: 83506 - RNA, 23 nt, Artificial Sequence
  Oligomer
guucugugguuucauguuaguua

SEQ ID NO: 83507 - RNA, 23 nt, Artificial Sequence
  Oligomer
uuggugauggagccuguggaaag

SEQ ID NO: 83508 - RNA, 23 nt, Artificial Sequence
  Oligomer
guuggugauggagccuguggaaa

SEQ ID NO: 83509 - RNA, 23 nt, Artificial Sequence
  Oligomer
ggauggaaagcagguagaguugg

SEQ ID NO: 83510 - RNA, 23 nt, Artificial Sequence
  Oligomer
gucagauggaaaauucauuuuuu

SEQ ID NO: 83511 - RNA, 23 nt, Artificial Sequence
  Oligomer
ccuuaugcgguuaauuuugaagu

SEQ ID NO: 83512 - RNA, 23 nt, Artificial Sequence
  Oligomer
aguucugugguuucauguuaguu

SEQ ID NO: 83513 - RNA, 23 nt, Artificial Sequence
  Oligomer
caguucugugguuucauguuagu

SEQ ID NO: 83514 - RNA, 23 nt, Artificial Sequence
  Oligomer
acaguucugugguuucauguuag

SEQ ID NO: 83515 - RNA, 23 nt, Artificial Sequence
  Oligomer
uacaguucugugguuucauguua

SEQ ID NO: 83516 - RNA, 23 nt, Artificial Sequence
  Oligomer
uauuaucugucagcugcaaggua

SEQ ID NO: 83517 - RNA, 23 nt, Artificial Sequence
  Oligomer
augggcucaaccagaaaagccca

SEQ ID NO: 83518 - RNA, 23 nt, Artificial Sequence
  Oligomer
aaugggcucaaccagaaaagccc

SEQ ID NO: 83519 - RNA, 23 nt, Artificial Sequence
  Oligomer
guggcagaguuacaguucugugg

SEQ ID NO: 83520 - RNA, 23 nt, Artificial Sequence
  Oligomer
uguggcagaguuacaguucugug

SEQ ID NO: 83521 - RNA, 23 nt, Artificial Sequence
  Oligomer
cuguggcagaguuacaguucugu

SEQ ID NO: 83522 - RNA, 23 nt, Artificial Sequence
  Oligomer
gcuguggcagaguuacaguucug

SEQ ID NO: 83523 - RNA, 23 nt, Artificial Sequence
  Oligomer
agcuguggcagaguuacaguucu

SEQ ID NO: 83524 - RNA, 23 nt, Artificial Sequence
  Oligomer
gggcaggaagauuaugaucgccu

SEQ ID NO: 83525 - RNA, 23 nt, Artificial Sequence
  Oligomer
gauggaaagcagguagaguuggc

SEQ ID NO: 83526 - RNA, 23 nt, Artificial Sequence
  Oligomer
gcuacgagagcugcucugcaagc

SEQ ID NO: 83527 - RNA, 23 nt, Artificial Sequence
  Oligomer
ggcuacgagagcugcucugcaag

SEQ ID NO: 83528 - RNA, 23 nt, Artificial Sequence
  Oligomer
uggcuacgagagcugcucugcaa

SEQ ID NO: 83529 - RNA, 23 nt, Artificial Sequence
  Oligomer
cgauguuauacugauguguuuuu

SEQ ID NO: 83530 - RNA, 23 nt, Artificial Sequence
  Oligomer
ccgauguuauacugauguguuuu

SEQ ID NO: 83531 - RNA, 23 nt, Artificial Sequence
  Oligomer
accgauguuauacugauguguuu

SEQ ID NO: 83532 - RNA, 23 nt, Artificial Sequence
  Oligomer
uaccgauguuauacugauguguu

SEQ ID NO: 83533 - RNA, 23 nt, Artificial Sequence
  Oligomer
auaccgauguuauacugaugugu

SEQ ID NO: 83534 - RNA, 23 nt, Artificial Sequence
  Oligomer
aucgagguggauggaaagcaggu

SEQ ID NO: 83535 - RNA, 23 nt, Artificial Sequence
  Oligomer
gcaagguacucuggugagucacc

SEQ ID NO: 83536 - RNA, 23 nt, Artificial Sequence
  Oligomer
ugcaagguacucuggugagucac

SEQ ID NO: 83537 - RNA, 23 nt, Artificial Sequence
  Oligomer
cugcaagguacucuggugaguca

SEQ ID NO: 83538 - RNA, 23 nt, Artificial Sequence
  Oligomer
agguagaguuggcuuugugggac

SEQ ID NO: 83539 - RNA, 23 nt, Artificial Sequence
  Oligomer
cagguagaguuggcuuuguggga

SEQ ID NO: 83540 - RNA, 23 nt, Artificial Sequence
  Oligomer
gaguuacaguucugugguuucau

SEQ ID NO: 83541 - RNA, 23 nt, Artificial Sequence
  Oligomer
agaguuacaguucugugguuuca

SEQ ID NO: 83542 - RNA, 23 nt, Artificial Sequence
  Oligomer
cagaguuacaguucugugguuuc

SEQ ID NO: 83543 - RNA, 23 nt, Artificial Sequence
  Oligomer
gacucggauucguugccugagca

SEQ ID NO: 83544 - RNA, 23 nt, Artificial Sequence
  Oligomer
ggacucggauucguugccugagc

SEQ ID NO: 83545 - RNA, 23 nt, Artificial Sequence
  Oligomer
uggacucggauucguugccugag

SEQ ID NO: 83546 - RNA, 23 nt, Artificial Sequence
  Oligomer
cuggacucggauucguugccuga

SEQ ID NO: 83547 - RNA, 23 nt, Artificial Sequence
  Oligomer
gcugcaagguacucuggugaguc

SEQ ID NO: 83548 - RNA, 23 nt, Artificial Sequence
  Oligomer
agcugcaagguacucuggugagu

SEQ ID NO: 83549 - RNA, 23 nt, Artificial Sequence
  Oligomer
cagcugcaagguacucuggugag

SEQ ID NO: 83550 - RNA, 23 nt, Artificial Sequence
  Oligomer
ucagcugcaagguacucugguga

SEQ ID NO: 83551 - RNA, 23 nt, Artificial Sequence
  Oligomer
accccagaagucaagcauuucug

SEQ ID NO: 83552 - RNA, 23 nt, Artificial Sequence
  Oligomer
gaccccagaagucaagcauuucu

SEQ ID NO: 83553 - RNA, 23 nt, Artificial Sequence
  Oligomer
gcagguagaguuggcuuuguggg

SEQ ID NO: 83554 - RNA, 23 nt, Artificial Sequence
  Oligomer
agcagguagaguuggcuuugugg

SEQ ID NO: 83555 - RNA, 23 nt, Artificial Sequence
  Oligomer
caggagccggugaaaccugaaga

SEQ ID NO: 83556 - RNA, 23 nt, Artificial Sequence
  Oligomer
uaucgagguggauggaaagcagg

SEQ ID NO: 83557 - RNA, 23 nt, Artificial Sequence
  Oligomer
guuuugucacuuuuucugauaaa

SEQ ID NO: 83558 - RNA, 23 nt, Artificial Sequence
  Oligomer
cuugugaaaccuugcugcaagca

SEQ ID NO: 83559 - RNA, 23 nt, Artificial Sequence
  Oligomer
ucuugugaaaccuugcugcaagc

SEQ ID NO: 83560 - RNA, 23 nt, Artificial Sequence
  Oligomer
gauaccgauguuauacugaugug

SEQ ID NO: 83561 - RNA, 23 nt, Artificial Sequence
  Oligomer
agauaccgauguuauacugaugu

SEQ ID NO: 83562 - RNA, 23 nt, Artificial Sequence
  Oligomer
cagauaccgauguuauacugaug

SEQ ID NO: 83563 - RNA, 23 nt, Artificial Sequence
  Oligomer
ccagauaccgauguuauacugau

SEQ ID NO: 83564 - RNA, 23 nt, Artificial Sequence
  Oligomer
auuagacacuuuggaagauggca

SEQ ID NO: 83565 - RNA, 23 nt, Artificial Sequence
  Oligomer
ggaauuucuuaacuucuugcuuc

SEQ ID NO: 83566 - RNA, 23 nt, Artificial Sequence
  Oligomer
aggaauuucuuaacuucuugcuu

SEQ ID NO: 83567 - RNA, 23 nt, Artificial Sequence
  Oligomer
aaggaauuucuuaacuucuugcu

SEQ ID NO: 83568 - RNA, 23 nt, Artificial Sequence
  Oligomer
caaggaauuucuuaacuucuugc

SEQ ID NO: 83569 - RNA, 23 nt, Artificial Sequence
  Oligomer
ucaaggaauuucuuaacuucuug

SEQ ID NO: 83570 - RNA, 23 nt, Artificial Sequence
  Oligomer
ccuguggaaagacaugcuugcuc

SEQ ID NO: 83571 - RNA, 23 nt, Artificial Sequence
  Oligomer
gccuguggaaagacaugcuugcu

SEQ ID NO: 83572 - RNA, 23 nt, Artificial Sequence
  Oligomer
agccuguggaaagacaugcuugc

SEQ ID NO: 83573 - RNA, 23 nt, Artificial Sequence
  Oligomer
gagccuguggaaagacaugcuug

SEQ ID NO: 83574 - RNA, 23 nt, Artificial Sequence
  Oligomer
cugacacaccaggcgcuaauuca

SEQ ID NO: 83575 - RNA, 23 nt, Artificial Sequence
  Oligomer
ccugacacaccaggcgcuaauuc

SEQ ID NO: 83576 - RNA, 23 nt, Artificial Sequence
  Oligomer
accugacacaccaggcgcuaauu

SEQ ID NO: 83577 - RNA, 23 nt, Artificial Sequence
  Oligomer
caccugacacaccaggcgcuaau

SEQ ID NO: 83578 - RNA, 23 nt, Artificial Sequence
  Oligomer
uucaaggaauuucuuaacuucuu

SEQ ID NO: 83579 - RNA, 23 nt, Artificial Sequence
  Oligomer
auucaaggaauuucuuaacuucu

SEQ ID NO: 83580 - RNA, 23 nt, Artificial Sequence
  Oligomer
aauucaaggaauuucuuaacuuc

SEQ ID NO: 83581 - RNA, 23 nt, Artificial Sequence
  Oligomer
ucuccuacccagauaccgauguu

SEQ ID NO: 83582 - RNA, 23 nt, Artificial Sequence
  Oligomer
cucuccuacccagauaccgaugu

SEQ ID NO: 83583 - RNA, 23 nt, Artificial Sequence
  Oligomer
ccucuccuacccagauaccgaug

SEQ ID NO: 83584 - RNA, 23 nt, Artificial Sequence
  Oligomer
cccucuccuacccagauaccgau

SEQ ID NO: 83585 - RNA, 23 nt, Artificial Sequence
  Oligomer
ccccucuccuacccagauaccga

SEQ ID NO: 83586 - RNA, 23 nt, Artificial Sequence
  Oligomer
acuuuggaagauggcauaaccug

SEQ ID NO: 83587 - RNA, 23 nt, Artificial Sequence
  Oligomer
ucuggcucuaauucacagugcuc

SEQ ID NO: 83588 - RNA, 23 nt, Artificial Sequence
  Oligomer
aucuggcucuaauucacagugcu

SEQ ID NO: 83589 - RNA, 23 nt, Artificial Sequence
  Oligomer
guucagcaaagaccaaagaugga

SEQ ID NO: 83590 - RNA, 23 nt, Artificial Sequence
  Oligomer
uacugauguguuuuuccaucgac

SEQ ID NO: 83591 - RNA, 23 nt, Artificial Sequence
  Oligomer
auacugauguguuuuuccaucga

SEQ ID NO: 83592 - RNA, 23 nt, Artificial Sequence
  Oligomer
uauacugauguguuuuuccaucg

SEQ ID NO: 83593 - RNA, 23 nt, Artificial Sequence
  Oligomer
uuauacugauguguuuuuccauc

SEQ ID NO: 83594 - RNA, 23 nt, Artificial Sequence
  Oligomer
guuauacugauguguuuuuccau

SEQ ID NO: 83595 - RNA, 23 nt, Artificial Sequence
  Oligomer
uccuacccagauaccgauguuau

SEQ ID NO: 83596 - RNA, 23 nt, Artificial Sequence
  Oligomer
aaggaccaguucccagaggugua

SEQ ID NO: 83597 - RNA, 23 nt, Artificial Sequence
  Oligomer
aaaucugggugccuugucuugug

SEQ ID NO: 83598 - RNA, 23 nt, Artificial Sequence
  Oligomer
aaaaucugggugccuugucuugu

SEQ ID NO: 83599 - RNA, 23 nt, Artificial Sequence
  Oligomer
aaaaaucugggugccuugucuug

SEQ ID NO: 83600 - RNA, 23 nt, Artificial Sequence
  Oligomer
aaaaaaucugggugccuugucuu

SEQ ID NO: 83601 - RNA, 23 nt, Artificial Sequence
  Oligomer
aguucaugcagcuguggcagagu

SEQ ID NO: 83602 - RNA, 23 nt, Artificial Sequence
  Oligomer
aaguucaugcagcuguggcagag

SEQ ID NO: 83603 - RNA, 23 nt, Artificial Sequence
  Oligomer
caaguucaugcagcuguggcaga

SEQ ID NO: 83604 - RNA, 23 nt, Artificial Sequence
  Oligomer
cucucuucucuccagcugacuaa

SEQ ID NO: 83605 - RNA, 23 nt, Artificial Sequence
  Oligomer
ucucucuucucuccagcugacua

SEQ ID NO: 83606 - RNA, 23 nt, Artificial Sequence
  Oligomer
gucucucuucucuccagcugacu

SEQ ID NO: 83607 - RNA, 23 nt, Artificial Sequence
  Oligomer
agucucucuucucuccagcugac

SEQ ID NO: 83608 - RNA, 23 nt, Artificial Sequence
  Oligomer
ucuucucuccagcugacuaaacu

SEQ ID NO: 83609 - RNA, 23 nt, Artificial Sequence
  Oligomer
cucuucucuccagcugacuaaac

SEQ ID NO: 83610 - RNA, 23 nt, Artificial Sequence
  Oligomer
ucucuucucuccagcugacuaaa

SEQ ID NO: 83611 - RNA, 23 nt, Artificial Sequence
  Oligomer
gauguuauacugauguguuuuuc

SEQ ID NO: 83612 - RNA, 23 nt, Artificial Sequence
  Oligomer
aauuagacacuuuggaagauggc

SEQ ID NO: 83613 - RNA, 23 nt, Artificial Sequence
  Oligomer
ggcugccauccggaagaaacugg

SEQ ID NO: 83614 - RNA, 23 nt, Artificial Sequence
  Oligomer
uggcugccauccggaagaaacug

SEQ ID NO: 83615 - RNA, 23 nt, Artificial Sequence
  Oligomer
auggcugccauccggaagaaacu

SEQ ID NO: 83616 - RNA, 23 nt, Artificial Sequence
  Oligomer
uugugaaaccuugcugcaagcac

SEQ ID NO: 83617 - RNA, 23 nt, Artificial Sequence
  Oligomer
aagcagguagaguuggcuuugug

SEQ ID NO: 83618 - RNA, 23 nt, Artificial Sequence
  Oligomer
cuuaagcaucuggcucuaauuca

SEQ ID NO: 83619 - RNA, 23 nt, Artificial Sequence
  Oligomer
ccggugaaaccugaagaaggcag

SEQ ID NO: 83620 - RNA, 23 nt, Artificial Sequence
  Oligomer
uuacaguucugugguuucauguu

SEQ ID NO: 83621 - RNA, 23 nt, Artificial Sequence
  Oligomer
guuacaguucugugguuucaugu

SEQ ID NO: 83622 - RNA, 23 nt, Artificial Sequence
  Oligomer
auuaucugucagcugcaagguac

SEQ ID NO: 83623 - RNA, 23 nt, Artificial Sequence
  Oligomer
cuuaacuucuugcuucuuucuag

SEQ ID NO: 83624 - RNA, 23 nt, Artificial Sequence
  Oligomer
ggacacagcugggcaggaagauu

SEQ ID NO: 83625 - RNA, 23 nt, Artificial Sequence
  Oligomer
gaucuucggaaugaugagcacac

SEQ ID NO: 83626 - RNA, 23 nt, Artificial Sequence
  Oligomer
agauuaugaucgccugaggcccc

SEQ ID NO: 83627 - RNA, 23 nt, Artificial Sequence
  Oligomer
aagauuaugaucgccugaggccc

SEQ ID NO: 83628 - RNA, 23 nt, Artificial Sequence
  Oligomer
gcccaccaggguccuuuugacac

SEQ ID NO: 83629 - RNA, 23 nt, Artificial Sequence
  Oligomer
ggcccaccaggguccuuuugaca

SEQ ID NO: 83630 - RNA, 23 nt, Artificial Sequence
  Oligomer
aauucacagugcucuuuucuccu

SEQ ID NO: 83631 - RNA, 23 nt, Artificial Sequence
  Oligomer
uuaaauucccguuuugucacuuu

SEQ ID NO: 83632 - RNA, 23 nt, Artificial Sequence
  Oligomer
uuuaaauucccguuuugucacuu

SEQ ID NO: 83633 - RNA, 23 nt, Artificial Sequence
  Oligomer
uuuuaaauucccguuuugucacu

SEQ ID NO: 83634 - RNA, 23 nt, Artificial Sequence
  Oligomer
uuuuuaaauucccguuuugucac

SEQ ID NO: 83635 - RNA, 23 nt, Artificial Sequence
  Oligomer
uuuuuuaaauucccguuuuguca

SEQ ID NO: 83636 - RNA, 23 nt, Artificial Sequence
  Oligomer
ucaccacuucagggcuuuacucc

SEQ ID NO: 83637 - RNA, 23 nt, Artificial Sequence
  Oligomer
gucaccacuucagggcuuuacuc

SEQ ID NO: 83638 - RNA, 23 nt, Artificial Sequence
  Oligomer
agucaccacuucagggcuuuacu

SEQ ID NO: 83639 - RNA, 23 nt, Artificial Sequence
  Oligomer
gagucaccacuucagggcuuuac

SEQ ID NO: 83640 - RNA, 23 nt, Artificial Sequence
  Oligomer
ugagucaccacuucagggcuuua

SEQ ID NO: 83641 - RNA, 23 nt, Artificial Sequence
  Oligomer
uguuauacugauguguuuuucca

SEQ ID NO: 83642 - RNA, 23 nt, Artificial Sequence
  Oligomer
gauucguugccugagcaauggcu

SEQ ID NO: 83643 - RNA, 23 nt, Artificial Sequence
  Oligomer
ggaaagcagguagaguuggcuuu

SEQ ID NO: 83644 - RNA, 23 nt, Artificial Sequence
  Oligomer
gaaaacaucccagaaaaguggac

SEQ ID NO: 83645 - RNA, 23 nt, Artificial Sequence
  Oligomer
agaaaacaucccagaaaagugga

SEQ ID NO: 83646 - RNA, 23 nt, Artificial Sequence
  Oligomer
cuggugagucaccacuucagggc

SEQ ID NO: 83647 - RNA, 23 nt, Artificial Sequence
  Oligomer
ucuggugagucaccacuucaggg

SEQ ID NO: 83648 - RNA, 23 nt, Artificial Sequence
  Oligomer
cucugcaagcuagacgugggaag

SEQ ID NO: 83649 - RNA, 23 nt, Artificial Sequence
  Oligomer
gcucugcaagcuagacgugggaa

SEQ ID NO: 83650 - RNA, 23 nt, Artificial Sequence
  Oligomer
cuccuacccagauaccgauguua

SEQ ID NO: 83651 - RNA, 23 nt, Artificial Sequence
  Oligomer
aggagccaccaguucucaugggu

SEQ ID NO: 83652 - RNA, 23 nt, Artificial Sequence
  Oligomer
gaggagccaccaguucucauggg

SEQ ID NO: 83653 - RNA, 23 nt, Artificial Sequence
  Oligomer
agaggagccaccaguucucaugg

SEQ ID NO: 83654 - RNA, 23 nt, Artificial Sequence
  Oligomer
cagaggagccaccaguucucaug

SEQ ID NO: 83655 - RNA, 23 nt, Artificial Sequence
  Oligomer
ccagaggagccaccaguucucau

SEQ ID NO: 83656 - RNA, 23 nt, Artificial Sequence
  Oligomer
ucucguuaguccacggucugguc

SEQ ID NO: 83657 - RNA, 23 nt, Artificial Sequence
  Oligomer
cucucguuaguccacggucuggu

SEQ ID NO: 83658 - RNA, 23 nt, Artificial Sequence
  Oligomer
ucucucguuaguccacggucugg

SEQ ID NO: 83659 - RNA, 23 nt, Artificial Sequence
  Oligomer
uucucucguuaguccacggucug

SEQ ID NO: 83660 - RNA, 23 nt, Artificial Sequence
  Oligomer
guucucucguuaguccacggucu

SEQ ID NO: 83661 - RNA, 23 nt, Artificial Sequence
  Oligomer
auggaaagcagguagaguuggcu

SEQ ID NO: 83662 - RNA, 23 nt, Artificial Sequence
  Oligomer
uguucagcaaagaccaaagaugg

SEQ ID NO: 83663 - RNA, 23 nt, Artificial Sequence
  Oligomer
aguucucauggguggcacucagu

SEQ ID NO: 83664 - RNA, 23 nt, Artificial Sequence
  Oligomer
caguucucauggguggcacucag

SEQ ID NO: 83665 - RNA, 23 nt, Artificial Sequence
  Oligomer
accaguucucauggguggcacuc

SEQ ID NO: 83666 - RNA, 23 nt, Artificial Sequence
  Oligomer
caccaguucucauggguggcacu

SEQ ID NO: 83667 - RNA, 23 nt, Artificial Sequence
  Oligomer
ucuuuucuccucacuguauccag

SEQ ID NO: 83668 - RNA, 23 nt, Artificial Sequence
  Oligomer
ccacuucagggcuuuacuccgua

SEQ ID NO: 83669 - RNA, 23 nt, Artificial Sequence
  Oligomer
cuuuuucugauaaaagauggcca

SEQ ID NO: 83670 - RNA, 23 nt, Artificial Sequence
  Oligomer
ccaguuaauuuuuccaacuacua

SEQ ID NO: 83671 - RNA, 23 nt, Artificial Sequence
  Oligomer
gguucucucguuaguccacgguc

SEQ ID NO: 83672 - RNA, 23 nt, Artificial Sequence
  Oligomer
gucagcugcaagguacucuggug

SEQ ID NO: 83673 - RNA, 23 nt, Artificial Sequence
  Oligomer
ugucagcugcaagguacucuggu

SEQ ID NO: 83674 - RNA, 23 nt, Artificial Sequence
  Oligomer
agaaaagcccaaguucaugcagc

SEQ ID NO: 83675 - RNA, 23 nt, Artificial Sequence
  Oligomer
aguuacaguucugugguuucaug

SEQ ID NO: 83676 - RNA, 23 nt, Artificial Sequence
  Oligomer
uggaaagcagguagaguuggcuu

SEQ ID NO: 83677 - RNA, 23 nt, Artificial Sequence
  Oligomer
uguguuuuuccaucgacagcccu

SEQ ID NO: 83678 - RNA, 23 nt, Artificial Sequence
  Oligomer
guuauaaaguaguuacagccuaa

SEQ ID NO: 83679 - RNA, 23 nt, Artificial Sequence
  Oligomer
ccucucucacuccaucuuugguc

SEQ ID NO: 83680 - RNA, 23 nt, Artificial Sequence
  Oligomer
ucaguauaacaucgguaucuggg

SEQ ID NO: 83681 - RNA, 23 nt, Artificial Sequence
  Oligomer
caguauaacaucgguaucugggu

SEQ ID NO: 83682 - RNA, 23 nt, Artificial Sequence
  Oligomer
aguauaacaucgguaucugggua

SEQ ID NO: 83683 - RNA, 23 nt, Artificial Sequence
  Oligomer
guauaacaucgguaucuggguag

SEQ ID NO: 83684 - RNA, 23 nt, Artificial Sequence
  Oligomer
uauaacaucgguaucuggguagg

SEQ ID NO: 83685 - RNA, 23 nt, Artificial Sequence
  Oligomer
accucucucacuccaucuuuggu

SEQ ID NO: 83686 - RNA, 23 nt, Artificial Sequence
  Oligomer
cggguuggacaucguuaauaauc

SEQ ID NO: 83687 - RNA, 23 nt, Artificial Sequence
  Oligomer
uuucuaaacuaucagggcugucg

SEQ ID NO: 83688 - RNA, 23 nt, Artificial Sequence
  Oligomer
uccuauuuacuuagcccagcucc

SEQ ID NO: 83689 - RNA, 23 nt, Artificial Sequence
  Oligomer
ccuauuuacuuagcccagcucca

SEQ ID NO: 83690 - RNA, 23 nt, Artificial Sequence
  Oligomer
cuauuuacuuagcccagcuccau

SEQ ID NO: 83691 - RNA, 23 nt, Artificial Sequence
  Oligomer
uauuuacuuagcccagcuccaug

SEQ ID NO: 83692 - RNA, 23 nt, Artificial Sequence
  Oligomer
auuuacuuagcccagcuccaugg

SEQ ID NO: 83693 - RNA, 23 nt, Artificial Sequence
  Oligomer
ucaaaaaccucucucacuccauc

SEQ ID NO: 83694 - RNA, 23 nt, Artificial Sequence
  Oligomer
uuuuuagaaaacugccuuuauuc

SEQ ID NO: 83695 - RNA, 23 nt, Artificial Sequence
  Oligomer
uuuuagaaaacugccuuuauucu

SEQ ID NO: 83696 - RNA, 23 nt, Artificial Sequence
  Oligomer
uuuagaaaacugccuuuauucua

SEQ ID NO: 83697 - RNA, 23 nt, Artificial Sequence
  Oligomer
uuccuauuuacuuagcccagcuc

SEQ ID NO: 83698 - RNA, 23 nt, Artificial Sequence
  Oligomer
uuuacuuagcccagcuccauggg

SEQ ID NO: 83699 - RNA, 23 nt, Artificial Sequence
  Oligomer
uuacuuagcccagcuccaugggg

SEQ ID NO: 83700 - RNA, 23 nt, Artificial Sequence
  Oligomer
uacuuagcccagcuccauggggu

SEQ ID NO: 83701 - RNA, 23 nt, Artificial Sequence
  Oligomer
acuaugagcaagcaugucuuucc

SEQ ID NO: 83702 - RNA, 23 nt, Artificial Sequence
  Oligomer
cuaugagcaagcaugucuuucca

SEQ ID NO: 83703 - RNA, 23 nt, Artificial Sequence
  Oligomer
uaugagcaagcaugucuuuccac

SEQ ID NO: 83704 - RNA, 23 nt, Artificial Sequence
  Oligomer
augagcaagcaugucuuuccaca

SEQ ID NO: 83705 - RNA, 23 nt, Artificial Sequence
  Oligomer
ugagcaagcaugucuuuccacag

SEQ ID NO: 83706 - RNA, 23 nt, Artificial Sequence
  Oligomer
ugccuucuucagguuucaccggc

SEQ ID NO: 83707 - RNA, 23 nt, Artificial Sequence
  Oligomer
gccuucuucagguuucaccggcu

SEQ ID NO: 83708 - RNA, 23 nt, Artificial Sequence
  Oligomer
ccuucuucagguuucaccggcuc

SEQ ID NO: 83709 - RNA, 23 nt, Artificial Sequence
  Oligomer
cuucuucagguuucaccggcucc

SEQ ID NO: 83710 - RNA, 23 nt, Artificial Sequence
  Oligomer
uucuucagguuucaccggcuccu

SEQ ID NO: 83711 - RNA, 23 nt, Artificial Sequence
  Oligomer
cugcuuuccauccaccucgauau

SEQ ID NO: 83712 - RNA, 23 nt, Artificial Sequence
  Oligomer
ugcuuuccauccaccucgauauc

SEQ ID NO: 83713 - RNA, 23 nt, Artificial Sequence
  Oligomer
gcuuuccauccaccucgauaucu

SEQ ID NO: 83714 - RNA, 23 nt, Artificial Sequence
  Oligomer
cuuuccauccaccucgauaucug

SEQ ID NO: 83715 - RNA, 23 nt, Artificial Sequence
  Oligomer
uuuccauccaccucgauaucugc

SEQ ID NO: 83716 - RNA, 23 nt, Artificial Sequence
  Oligomer
cacauaguucucaaacacugugg

SEQ ID NO: 83717 - RNA, 23 nt, Artificial Sequence
  Oligomer
acauaguucucaaacacuguggg

SEQ ID NO: 83718 - RNA, 23 nt, Artificial Sequence
  Oligomer
cauaguucucaaacacugugggc

SEQ ID NO: 83719 - RNA, 23 nt, Artificial Sequence
  Oligomer
auaguucucaaacacugugggca

SEQ ID NO: 83720 - RNA, 23 nt, Artificial Sequence
  Oligomer
uaguucucaaacacugugggcac

SEQ ID NO: 83721 - RNA, 23 nt, Artificial Sequence
  Oligomer
caugucuuuccacaggcuccauc

SEQ ID NO: 83722 - RNA, 23 nt, Artificial Sequence
  Oligomer
augucuuuccacaggcuccauca

SEQ ID NO: 83723 - RNA, 23 nt, Artificial Sequence
  Oligomer
ugucuuuccacaggcuccaucac

SEQ ID NO: 83724 - RNA, 23 nt, Artificial Sequence
  Oligomer
gucuuuccacaggcuccaucacc

SEQ ID NO: 83725 - RNA, 23 nt, Artificial Sequence
  Oligomer
ucuuuccacaggcuccaucacca

SEQ ID NO: 83726 - RNA, 23 nt, Artificial Sequence
  Oligomer
cuuuucugguugagcccauuuuc

SEQ ID NO: 83727 - RNA, 23 nt, Artificial Sequence
  Oligomer
uuuucugguugagcccauuuuca

SEQ ID NO: 83728 - RNA, 23 nt, Artificial Sequence
  Oligomer
uuucugguugagcccauuuucaa

SEQ ID NO: 83729 - RNA, 23 nt, Artificial Sequence
  Oligomer
uucugguugagcccauuuucaaa

SEQ ID NO: 83730 - RNA, 23 nt, Artificial Sequence
  Oligomer
ucugguugagcccauuuucaaaa

SEQ ID NO: 83731 - RNA, 23 nt, Artificial Sequence
  Oligomer
auaguuggcuucuaaauacuggu

SEQ ID NO: 83732 - RNA, 23 nt, Artificial Sequence
  Oligomer
aagcaugucuuuccacaggcucc

SEQ ID NO: 83733 - RNA, 23 nt, Artificial Sequence
  Oligomer
agcaugucuuuccacaggcucca

SEQ ID NO: 83734 - RNA, 23 nt, Artificial Sequence
  Oligomer
gcaugucuuuccacaggcuccau

SEQ ID NO: 83735 - RNA, 23 nt, Artificial Sequence
  Oligomer
ggguaauauggccaucuuuuauc

SEQ ID NO: 83736 - RNA, 23 nt, Artificial Sequence
  Oligomer
gaucauaaucuuccugcccagcu

SEQ ID NO: 83737 - RNA, 23 nt, Artificial Sequence
  Oligomer
aucauaaucuuccugcccagcug

SEQ ID NO: 83738 - RNA, 23 nt, Artificial Sequence
  Oligomer
ucauaaucuuccugcccagcugu

SEQ ID NO: 83739 - RNA, 23 nt, Artificial Sequence
  Oligomer
cauaaucuuccugcccagcugug

SEQ ID NO: 83740 - RNA, 23 nt, Artificial Sequence
  Oligomer
auaaucuuccugcccagcugugu

SEQ ID NO: 83741 - RNA, 23 nt, Artificial Sequence
  Oligomer
uuccauccaccucgauaucugcc

SEQ ID NO: 83742 - RNA, 23 nt, Artificial Sequence
  Oligomer
uccauccaccucgauaucugcca

SEQ ID NO: 83743 - RNA, 23 nt, Artificial Sequence
  Oligomer
ccauccaccucgauaucugccac

SEQ ID NO: 83744 - RNA, 23 nt, Artificial Sequence
  Oligomer
cauccaccucgauaucugccaca

SEQ ID NO: 83745 - RNA, 23 nt, Artificial Sequence
  Oligomer
auccaccucgauaucugccacau

SEQ ID NO: 83746 - RNA, 23 nt, Artificial Sequence
  Oligomer
aauuuuccaucugacuuuauuuc

SEQ ID NO: 83747 - RNA, 23 nt, Artificial Sequence
  Oligomer
auuuuccaucugacuuuauuucc

SEQ ID NO: 83748 - RNA, 23 nt, Artificial Sequence
  Oligomer
gaacuguaacucugccacagcug

SEQ ID NO: 83749 - RNA, 23 nt, Artificial Sequence
  Oligomer
aacuguaacucugccacagcugc

SEQ ID NO: 83750 - RNA, 23 nt, Artificial Sequence
  Oligomer
acuguaacucugccacagcugca

SEQ ID NO: 83751 - RNA, 23 nt, Artificial Sequence
  Oligomer
cuguaacucugccacagcugcau

SEQ ID NO: 83752 - RNA, 23 nt, Artificial Sequence
  Oligomer
uguaacucugccacagcugcaug

SEQ ID NO: 83753 - RNA, 23 nt, Artificial Sequence
  Oligomer
acucuaccugcuuuccauccacc

SEQ ID NO: 83754 - RNA, 23 nt, Artificial Sequence
  Oligomer
cucuaccugcuuuccauccaccu

SEQ ID NO: 83755 - RNA, 23 nt, Artificial Sequence
  Oligomer
ucuaccugcuuuccauccaccuc

SEQ ID NO: 83756 - RNA, 23 nt, Artificial Sequence
  Oligomer
cuaccugcuuuccauccaccucg

SEQ ID NO: 83757 - RNA, 23 nt, Artificial Sequence
  Oligomer
uaccugcuuuccauccaccucga

SEQ ID NO: 83758 - RNA, 23 nt, Artificial Sequence
  Oligomer
cucgauaucugccacauaguucu

SEQ ID NO: 83759 - RNA, 23 nt, Artificial Sequence
  Oligomer
ucgauaucugccacauaguucuc

SEQ ID NO: 83760 - RNA, 23 nt, Artificial Sequence
  Oligomer
cgauaucugccacauaguucuca

SEQ ID NO: 83761 - RNA, 23 nt, Artificial Sequence
  Oligomer
gauaucugccacauaguucucaa

SEQ ID NO: 83762 - RNA, 23 nt, Artificial Sequence
  Oligomer
auaucugccacauaguucucaaa

SEQ ID NO: 83763 - RNA, 23 nt, Artificial Sequence
  Oligomer
ggcuuuucugguugagcccauuu

SEQ ID NO: 83764 - RNA, 23 nt, Artificial Sequence
  Oligomer
gcuuuucugguugagcccauuuu

SEQ ID NO: 83765 - RNA, 23 nt, Artificial Sequence
  Oligomer
aaaaugaauuuuccaucugacuu

SEQ ID NO: 83766 - RNA, 23 nt, Artificial Sequence
  Oligomer
uaaucuuccugcccagcuguguc

SEQ ID NO: 83767 - RNA, 23 nt, Artificial Sequence
  Oligomer
agacagguuaugccaucuuccaa

SEQ ID NO: 83768 - RNA, 23 nt, Artificial Sequence
  Oligomer
gacagguuaugccaucuuccaaa

SEQ ID NO: 83769 - RNA, 23 nt, Artificial Sequence
  Oligomer
acagguuaugccaucuuccaaag

SEQ ID NO: 83770 - RNA, 23 nt, Artificial Sequence
  Oligomer
gggcugugcuugcagcaagguuu

SEQ ID NO: 83771 - RNA, 23 nt, Artificial Sequence
  Oligomer
ggcugugcuugcagcaagguuuc

SEQ ID NO: 83772 - RNA, 23 nt, Artificial Sequence
  Oligomer
gcugugcuugcagcaagguuuca

SEQ ID NO: 83773 - RNA, 23 nt, Artificial Sequence
  Oligomer
cugugcuugcagcaagguuucac

SEQ ID NO: 83774 - RNA, 23 nt, Artificial Sequence
  Oligomer
ugugcuugcagcaagguuucaca

SEQ ID NO: 83775 - RNA, 23 nt, Artificial Sequence
  Oligomer
uucuucccacgucuagcuugcag

SEQ ID NO: 83776 - RNA, 23 nt, Artificial Sequence
  Oligomer
ucuucccacgucuagcuugcaga

SEQ ID NO: 83777 - RNA, 23 nt, Artificial Sequence
  Oligomer
aguucucaaacacugugggcaca

SEQ ID NO: 83778 - RNA, 23 nt, Artificial Sequence
  Oligomer
guucucaaacacugugggcacau

SEQ ID NO: 83779 - RNA, 23 nt, Artificial Sequence
  Oligomer
uucucaaacacugugggcacaua

SEQ ID NO: 83780 - RNA, 23 nt, Artificial Sequence
  Oligomer
ggcgaucauaaucuuccugccca

SEQ ID NO: 83781 - RNA, 23 nt, Artificial Sequence
  Oligomer
gcgaucauaaucuuccugcccag

SEQ ID NO: 83782 - RNA, 23 nt, Artificial Sequence
  Oligomer
cgaucauaaucuuccugcccagc

SEQ ID NO: 83783 - RNA, 23 nt, Artificial Sequence
  Oligomer
acuucugauuuguaaucuuaggu

SEQ ID NO: 83784 - RNA, 23 nt, Artificial Sequence
  Oligomer
cuucugauuuguaaucuuaggua

SEQ ID NO: 83785 - RNA, 23 nt, Artificial Sequence
  Oligomer
uucugauuuguaaucuuagguaa

SEQ ID NO: 83786 - RNA, 23 nt, Artificial Sequence
  Oligomer
uucuagaaagaagcaagaaguua

SEQ ID NO: 83787 - RNA, 23 nt, Artificial Sequence
  Oligomer
ucuagaaagaagcaagaaguuaa

SEQ ID NO: 83788 - RNA, 23 nt, Artificial Sequence
  Oligomer
ggccucaggcgaucauaaucuuc

SEQ ID NO: 83789 - RNA, 23 nt, Artificial Sequence
  Oligomer
gccucaggcgaucauaaucuucc

SEQ ID NO: 83790 - RNA, 23 nt, Artificial Sequence
  Oligomer
ccucaggcgaucauaaucuuccu

SEQ ID NO: 83791 - RNA, 23 nt, Artificial Sequence
  Oligomer
cucaggcgaucauaaucuuccug

SEQ ID NO: 83792 - RNA, 23 nt, Artificial Sequence
  Oligomer
ucaggcgaucauaaucuuccugc

SEQ ID NO: 83793 - RNA, 23 nt, Artificial Sequence
  Oligomer
gcugugucccacaaagccaacuc

SEQ ID NO: 83794 - RNA, 23 nt, Artificial Sequence
  Oligomer
cugugucccacaaagccaacucu

SEQ ID NO: 83795 - RNA, 23 nt, Artificial Sequence
  Oligomer
ugugucccacaaagccaacucua

SEQ ID NO: 83796 - RNA, 23 nt, Artificial Sequence
  Oligomer
gugucccacaaagccaacucuac

SEQ ID NO: 83797 - RNA, 23 nt, Artificial Sequence
  Oligomer
ugucccacaaagccaacucuacc

SEQ ID NO: 83798 - RNA, 23 nt, Artificial Sequence
  Oligomer
caggcgaucauaaucuuccugcc

SEQ ID NO: 83799 - RNA, 23 nt, Artificial Sequence
  Oligomer
uaucugccacauaguucucaaac

SEQ ID NO: 83800 - RNA, 23 nt, Artificial Sequence
  Oligomer
aucugccacauaguucucaaaca

SEQ ID NO: 83801 - RNA, 23 nt, Artificial Sequence
  Oligomer
ucugccacauaguucucaaacac

SEQ ID NO: 83802 - RNA, 23 nt, Artificial Sequence
  Oligomer
cugccacauaguucucaaacacu

SEQ ID NO: 83803 - RNA, 23 nt, Artificial Sequence
  Oligomer
ugccacauaguucucaaacacug

SEQ ID NO: 83804 - RNA, 23 nt, Artificial Sequence
  Oligomer
uacugguagcaagaugacuucug

SEQ ID NO: 83805 - RNA, 23 nt, Artificial Sequence
  Oligomer
ccacuuuucugggauguuuucua

SEQ ID NO: 83806 - RNA, 23 nt, Artificial Sequence
  Oligomer
cacuuuucugggauguuuucuaa

SEQ ID NO: 83807 - RNA, 23 nt, Artificial Sequence
  Oligomer
gccauugcucaggcaacgaaucc

SEQ ID NO: 83808 - RNA, 23 nt, Artificial Sequence
  Oligomer
ccauugcucaggcaacgaauccg

SEQ ID NO: 83809 - RNA, 23 nt, Artificial Sequence
  Oligomer
cauugcucaggcaacgaauccga

SEQ ID NO: 83810 - RNA, 23 nt, Artificial Sequence
  Oligomer
auugcucaggcaacgaauccgag

SEQ ID NO: 83811 - RNA, 23 nt, Artificial Sequence
  Oligomer
uugcucaggcaacgaauccgagu

SEQ ID NO: 83812 - RNA, 23 nt, Artificial Sequence
  Oligomer
ucucugccuucuucagguuucac

SEQ ID NO: 83813 - RNA, 23 nt, Artificial Sequence
  Oligomer
cucugccuucuucagguuucacc

SEQ ID NO: 83814 - RNA, 23 nt, Artificial Sequence
  Oligomer
ucugccuucuucagguuucaccg

SEQ ID NO: 83815 - RNA, 23 nt, Artificial Sequence
  Oligomer
cugccacagcugcaugaacuugg

SEQ ID NO: 83816 - RNA, 23 nt, Artificial Sequence
  Oligomer
ugccacagcugcaugaacuuggg

SEQ ID NO: 83817 - RNA, 23 nt, Artificial Sequence
  Oligomer
gccacagcugcaugaacuugggc

SEQ ID NO: 83818 - RNA, 23 nt, Artificial Sequence
  Oligomer
gcucucguagccauuucaaaaac

SEQ ID NO: 83819 - RNA, 23 nt, Artificial Sequence
  Oligomer
cucucguagccauuucaaaaacc

SEQ ID NO: 83820 - RNA, 23 nt, Artificial Sequence
  Oligomer
cacugugaauuagagccagaugc

SEQ ID NO: 83821 - RNA, 23 nt, Artificial Sequence
  Oligomer
acugugaauuagagccagaugcu

SEQ ID NO: 83822 - RNA, 23 nt, Artificial Sequence
  Oligomer
cugugaauuagagccagaugcuu

SEQ ID NO: 83823 - RNA, 23 nt, Artificial Sequence
  Oligomer
ugugaauuagagccagaugcuua

SEQ ID NO: 83824 - RNA, 23 nt, Artificial Sequence
  Oligomer
gugaauuagagccagaugcuuaa

SEQ ID NO: 83825 - RNA, 23 nt, Artificial Sequence
  Oligomer
gccacauaguucucaaacacugu

SEQ ID NO: 83826 - RNA, 23 nt, Artificial Sequence
  Oligomer
ccacauaguucucaaacacugug

SEQ ID NO: 83827 - RNA, 23 nt, Artificial Sequence
  Oligomer
uccaccucgauaucugccacaua

SEQ ID NO: 83828 - RNA, 23 nt, Artificial Sequence
  Oligomer
gggcugucgauggaaaaacacau

SEQ ID NO: 83829 - RNA, 23 nt, Artificial Sequence
  Oligomer
ggcugucgauggaaaaacacauc

SEQ ID NO: 83830 - RNA, 23 nt, Artificial Sequence
  Oligomer
gcugucgauggaaaaacacauca

SEQ ID NO: 83831 - RNA, 23 nt, Artificial Sequence
  Oligomer
cugucgauggaaaaacacaucag

SEQ ID NO: 83832 - RNA, 23 nt, Artificial Sequence
  Oligomer
ugucgauggaaaaacacaucagu

SEQ ID NO: 83833 - RNA, 23 nt, Artificial Sequence
  Oligomer
cccgccuugugugcucaucauuc

SEQ ID NO: 83834 - RNA, 23 nt, Artificial Sequence
  Oligomer
ccgccuugugugcucaucauucc

SEQ ID NO: 83835 - RNA, 23 nt, Artificial Sequence
  Oligomer
aucauaguuggcuucuaaauacu

SEQ ID NO: 83836 - RNA, 23 nt, Artificial Sequence
  Oligomer
ucauaguuggcuucuaaauacug

SEQ ID NO: 83837 - RNA, 23 nt, Artificial Sequence
  Oligomer
cauaguuggcuucuaaauacugg

SEQ ID NO: 83838 - RNA, 23 nt, Artificial Sequence
  Oligomer
accuugcagcugacagauaauag

SEQ ID NO: 83839 - RNA, 23 nt, Artificial Sequence
  Oligomer
ccuugcagcugacagauaauagg

SEQ ID NO: 83840 - RNA, 23 nt, Artificial Sequence
  Oligomer
gcacugugaauuagagccagaug

SEQ ID NO: 83841 - RNA, 23 nt, Artificial Sequence
  Oligomer
guaacucugccacagcugcauga

SEQ ID NO: 83842 - RNA, 23 nt, Artificial Sequence
  Oligomer
uaacucugccacagcugcaugaa

SEQ ID NO: 83843 - RNA, 23 nt, Artificial Sequence
  Oligomer
uaauugccucaggcgugaaacca

SEQ ID NO: 83844 - RNA, 23 nt, Artificial Sequence
  Oligomer
aauugccucaggcgugaaaccaa

SEQ ID NO: 83845 - RNA, 23 nt, Artificial Sequence
  Oligomer
auugccucaggcgugaaaccaau

SEQ ID NO: 83846 - RNA, 23 nt, Artificial Sequence
  Oligomer
aaugaaaaaggccaguaaucaua

SEQ ID NO: 83847 - RNA, 23 nt, Artificial Sequence
  Oligomer
augaaaaaggccaguaaucauac

SEQ ID NO: 83848 - RNA, 23 nt, Artificial Sequence
  Oligomer
cuauaagguaacuaacaugaaac

SEQ ID NO: 83849 - RNA, 23 nt, Artificial Sequence
  Oligomer
uauaagguaacuaacaugaaacc

SEQ ID NO: 83850 - RNA, 23 nt, Artificial Sequence
  Oligomer
auaagguaacuaacaugaaacca

SEQ ID NO: 83851 - RNA, 23 nt, Artificial Sequence
  Oligomer
uaagguaacuaacaugaaaccac

SEQ ID NO: 83852 - RNA, 23 nt, Artificial Sequence
  Oligomer
aagguaacuaacaugaaaccaca

SEQ ID NO: 83853 - RNA, 23 nt, Artificial Sequence
  Oligomer
gggcuguuagagcagugucaaaa

SEQ ID NO: 83854 - RNA, 23 nt, Artificial Sequence
  Oligomer
ggcuguuagagcagugucaaaag

SEQ ID NO: 83855 - RNA, 23 nt, Artificial Sequence
  Oligomer
ccagaguaccuugcagcugacag

SEQ ID NO: 83856 - RNA, 23 nt, Artificial Sequence
  Oligomer
cagaguaccuugcagcugacaga

SEQ ID NO: 83857 - RNA, 23 nt, Artificial Sequence
  Oligomer
agaguaccuugcagcugacagau

SEQ ID NO: 83858 - RNA, 23 nt, Artificial Sequence
  Oligomer
gaguaccuugcagcugacagaua

SEQ ID NO: 83859 - RNA, 23 nt, Artificial Sequence
  Oligomer
aguaccuugcagcugacagauaa

SEQ ID NO: 83860 - RNA, 23 nt, Artificial Sequence
  Oligomer
aaaaaugaauuuuccaucugacu

SEQ ID NO: 83861 - RNA, 23 nt, Artificial Sequence
  Oligomer
uuccacaggcuccaucaccaaca

SEQ ID NO: 83862 - RNA, 23 nt, Artificial Sequence
  Oligomer
uccacaggcuccaucaccaacaa

SEQ ID NO: 83863 - RNA, 23 nt, Artificial Sequence
  Oligomer
ccacaggcuccaucaccaacaau

SEQ ID NO: 83864 - RNA, 23 nt, Artificial Sequence
  Oligomer
cacaggcuccaucaccaacaauc

SEQ ID NO: 83865 - RNA, 23 nt, Artificial Sequence
  Oligomer
acaggcuccaucaccaacaauca

SEQ ID NO: 83866 - RNA, 23 nt, Artificial Sequence
  Oligomer
ugaaaaaggccaguaaucauaca

SEQ ID NO: 83867 - RNA, 23 nt, Artificial Sequence
  Oligomer
ccaccucgauaucugccacauag

SEQ ID NO: 83868 - RNA, 23 nt, Artificial Sequence
  Oligomer
caccucgauaucugccacauagu

SEQ ID NO: 83869 - RNA, 23 nt, Artificial Sequence
  Oligomer
accucgauaucugccacauaguu

SEQ ID NO: 83870 - RNA, 23 nt, Artificial Sequence
  Oligomer
ccucgauaucugccacauaguuc

SEQ ID NO: 83871 - RNA, 23 nt, Artificial Sequence
  Oligomer
cggcuccugcuucaucuuggcua

SEQ ID NO: 83872 - RNA, 23 nt, Artificial Sequence
  Oligomer
ggcuccugcuucaucuuggcuag

SEQ ID NO: 83873 - RNA, 23 nt, Artificial Sequence
  Oligomer
gcuccugcuucaucuuggcuagc

SEQ ID NO: 83874 - RNA, 23 nt, Artificial Sequence
  Oligomer
caacucuaccugcuuuccaucca

SEQ ID NO: 83875 - RNA, 23 nt, Artificial Sequence
  Oligomer
aacucuaccugcuuuccauccac

SEQ ID NO: 83876 - RNA, 23 nt, Artificial Sequence
  Oligomer
agguaacuaacaugaaaccacag

SEQ ID NO: 83877 - RNA, 23 nt, Artificial Sequence
  Oligomer
gguaacuaacaugaaaccacaga

SEQ ID NO: 83878 - RNA, 23 nt, Artificial Sequence
  Oligomer
guaacuaacaugaaaccacagaa

SEQ ID NO: 83879 - RNA, 23 nt, Artificial Sequence
  Oligomer
uaacuaacaugaaaccacagaac

SEQ ID NO: 83880 - RNA, 23 nt, Artificial Sequence
  Oligomer
cuuuccacaggcuccaucaccaa

SEQ ID NO: 83881 - RNA, 23 nt, Artificial Sequence
  Oligomer
uuuccacaggcuccaucaccaac

SEQ ID NO: 83882 - RNA, 23 nt, Artificial Sequence
  Oligomer
ccaacucuaccugcuuuccaucc

SEQ ID NO: 83883 - RNA, 23 nt, Artificial Sequence
  Oligomer
aaaaaaugaauuuuccaucugac

SEQ ID NO: 83884 - RNA, 23 nt, Artificial Sequence
  Oligomer
acuucaaaauuaaccgcauaagg

SEQ ID NO: 83885 - RNA, 23 nt, Artificial Sequence
  Oligomer
aacuaacaugaaaccacagaacu

SEQ ID NO: 83886 - RNA, 23 nt, Artificial Sequence
  Oligomer
acuaacaugaaaccacagaacug

SEQ ID NO: 83887 - RNA, 23 nt, Artificial Sequence
  Oligomer
cuaacaugaaaccacagaacugu

SEQ ID NO: 83888 - RNA, 23 nt, Artificial Sequence
  Oligomer
uaacaugaaaccacagaacugua

SEQ ID NO: 83889 - RNA, 23 nt, Artificial Sequence
  Oligomer
uaccuugcagcugacagauaaua

SEQ ID NO: 83890 - RNA, 23 nt, Artificial Sequence
  Oligomer
ugggcuuuucugguugagcccau

SEQ ID NO: 83891 - RNA, 23 nt, Artificial Sequence
  Oligomer
gggcuuuucugguugagcccauu

SEQ ID NO: 83892 - RNA, 23 nt, Artificial Sequence
  Oligomer
ccacagaacuguaacucugccac

SEQ ID NO: 83893 - RNA, 23 nt, Artificial Sequence
  Oligomer
cacagaacuguaacucugccaca

SEQ ID NO: 83894 - RNA, 23 nt, Artificial Sequence
  Oligomer
acagaacuguaacucugccacag

SEQ ID NO: 83895 - RNA, 23 nt, Artificial Sequence
  Oligomer
cagaacuguaacucugccacagc

SEQ ID NO: 83896 - RNA, 23 nt, Artificial Sequence
  Oligomer
agaacuguaacucugccacagcu

SEQ ID NO: 83897 - RNA, 23 nt, Artificial Sequence
  Oligomer
aggcgaucauaaucuuccugccc

SEQ ID NO: 83898 - RNA, 23 nt, Artificial Sequence
  Oligomer
gccaacucuaccugcuuuccauc

SEQ ID NO: 83899 - RNA, 23 nt, Artificial Sequence
  Oligomer
gcuugcagagcagcucucguagc

SEQ ID NO: 83900 - RNA, 23 nt, Artificial Sequence
  Oligomer
cuugcagagcagcucucguagcc

SEQ ID NO: 83901 - RNA, 23 nt, Artificial Sequence
  Oligomer
uugcagagcagcucucguagcca

SEQ ID NO: 83902 - RNA, 23 nt, Artificial Sequence
  Oligomer
aaaaacacaucaguauaacaucg

SEQ ID NO: 83903 - RNA, 23 nt, Artificial Sequence
  Oligomer
aaaacacaucaguauaacaucgg

SEQ ID NO: 83904 - RNA, 23 nt, Artificial Sequence
  Oligomer
aaacacaucaguauaacaucggu

SEQ ID NO: 83905 - RNA, 23 nt, Artificial Sequence
  Oligomer
aacacaucaguauaacaucggua

SEQ ID NO: 83906 - RNA, 23 nt, Artificial Sequence
  Oligomer
acacaucaguauaacaucgguau

SEQ ID NO: 83907 - RNA, 23 nt, Artificial Sequence
  Oligomer
accugcuuuccauccaccucgau

SEQ ID NO: 83908 - RNA, 23 nt, Artificial Sequence
  Oligomer
ggugacucaccagaguaccuugc

SEQ ID NO: 83909 - RNA, 23 nt, Artificial Sequence
  Oligomer
gugacucaccagaguaccuugca

SEQ ID NO: 83910 - RNA, 23 nt, Artificial Sequence
  Oligomer
ugacucaccagaguaccuugcag

SEQ ID NO: 83911 - RNA, 23 nt, Artificial Sequence
  Oligomer
gucccacaaagccaacucuaccu

SEQ ID NO: 83912 - RNA, 23 nt, Artificial Sequence
  Oligomer
ucccacaaagccaacucuaccug

SEQ ID NO: 83913 - RNA, 23 nt, Artificial Sequence
  Oligomer
augaaaccacagaacuguaacuc

SEQ ID NO: 83914 - RNA, 23 nt, Artificial Sequence
  Oligomer
ugaaaccacagaacuguaacucu

SEQ ID NO: 83915 - RNA, 23 nt, Artificial Sequence
  Oligomer
gaaaccacagaacuguaacucug

SEQ ID NO: 83916 - RNA, 23 nt, Artificial Sequence
  Oligomer
ugcucaggcaacgaauccgaguc

SEQ ID NO: 83917 - RNA, 23 nt, Artificial Sequence
  Oligomer
gcucaggcaacgaauccgagucc

SEQ ID NO: 83918 - RNA, 23 nt, Artificial Sequence
  Oligomer
cucaggcaacgaauccgagucca

SEQ ID NO: 83919 - RNA, 23 nt, Artificial Sequence
  Oligomer
ucaggcaacgaauccgaguccag

SEQ ID NO: 83920 - RNA, 23 nt, Artificial Sequence
  Oligomer
gacucaccagaguaccuugcagc

SEQ ID NO: 83921 - RNA, 23 nt, Artificial Sequence
  Oligomer
acucaccagaguaccuugcagcu

SEQ ID NO: 83922 - RNA, 23 nt, Artificial Sequence
  Oligomer
cucaccagaguaccuugcagcug

SEQ ID NO: 83923 - RNA, 23 nt, Artificial Sequence
  Oligomer
ucaccagaguaccuugcagcuga

SEQ ID NO: 83924 - RNA, 23 nt, Artificial Sequence
  Oligomer
cagaaaugcuugacuucuggggu

SEQ ID NO: 83925 - RNA, 23 nt, Artificial Sequence
  Oligomer
agaaaugcuugacuucugggguc

SEQ ID NO: 83926 - RNA, 23 nt, Artificial Sequence
  Oligomer
cccacaaagccaacucuaccugc

SEQ ID NO: 83927 - RNA, 23 nt, Artificial Sequence
  Oligomer
ccacaaagccaacucuaccugcu

SEQ ID NO: 83928 - RNA, 23 nt, Artificial Sequence
  Oligomer
ucuucagguuucaccggcuccug

SEQ ID NO: 83929 - RNA, 23 nt, Artificial Sequence
  Oligomer
ccugcuuuccauccaccucgaua

SEQ ID NO: 83930 - RNA, 23 nt, Artificial Sequence
  Oligomer
uuuaucagaaaaagugacaaaac

SEQ ID NO: 83931 - RNA, 23 nt, Artificial Sequence
  Oligomer
ugcuugcagcaagguuucacaag

SEQ ID NO: 83932 - RNA, 23 nt, Artificial Sequence
  Oligomer
gcuugcagcaagguuucacaaga

SEQ ID NO: 83933 - RNA, 23 nt, Artificial Sequence
  Oligomer
cacaucaguauaacaucgguauc

SEQ ID NO: 83934 - RNA, 23 nt, Artificial Sequence
  Oligomer
acaucaguauaacaucgguaucu

SEQ ID NO: 83935 - RNA, 23 nt, Artificial Sequence
  Oligomer
caucaguauaacaucgguaucug

SEQ ID NO: 83936 - RNA, 23 nt, Artificial Sequence
  Oligomer
aucaguauaacaucgguaucugg

SEQ ID NO: 83937 - RNA, 23 nt, Artificial Sequence
  Oligomer
ugccaucuuccaaagugucuaau

SEQ ID NO: 83938 - RNA, 23 nt, Artificial Sequence
  Oligomer
gaagcaagaaguuaagaaauucc

SEQ ID NO: 83939 - RNA, 23 nt, Artificial Sequence
  Oligomer
aagcaagaaguuaagaaauuccu

SEQ ID NO: 83940 - RNA, 23 nt, Artificial Sequence
  Oligomer
agcaagaaguuaagaaauuccuu

SEQ ID NO: 83941 - RNA, 23 nt, Artificial Sequence
  Oligomer
gcaagaaguuaagaaauuccuug

SEQ ID NO: 83942 - RNA, 23 nt, Artificial Sequence
  Oligomer
caagaaguuaagaaauuccuuga

SEQ ID NO: 83943 - RNA, 23 nt, Artificial Sequence
  Oligomer
gagcaagcaugucuuuccacagg

SEQ ID NO: 83944 - RNA, 23 nt, Artificial Sequence
  Oligomer
agcaagcaugucuuuccacaggc

SEQ ID NO: 83945 - RNA, 23 nt, Artificial Sequence
  Oligomer
gcaagcaugucuuuccacaggcu

SEQ ID NO: 83946 - RNA, 23 nt, Artificial Sequence
  Oligomer
caagcaugucuuuccacaggcuc

SEQ ID NO: 83947 - RNA, 23 nt, Artificial Sequence
  Oligomer
ugaauuagcgccuggugugucag

SEQ ID NO: 83948 - RNA, 23 nt, Artificial Sequence
  Oligomer
gaauuagcgccuggugugucagg

SEQ ID NO: 83949 - RNA, 23 nt, Artificial Sequence
  Oligomer
aauuagcgccuggugugucaggu

SEQ ID NO: 83950 - RNA, 23 nt, Artificial Sequence
  Oligomer
auuagcgccuggugugucaggug

SEQ ID NO: 83951 - RNA, 23 nt, Artificial Sequence
  Oligomer
aagaaguuaagaaauuccuugaa

SEQ ID NO: 83952 - RNA, 23 nt, Artificial Sequence
  Oligomer
agaaguuaagaaauuccuugaau

SEQ ID NO: 83953 - RNA, 23 nt, Artificial Sequence
  Oligomer
gaaguuaagaaauuccuugaauu

SEQ ID NO: 83954 - RNA, 23 nt, Artificial Sequence
  Oligomer
aacaucgguaucuggguaggaga

SEQ ID NO: 83955 - RNA, 23 nt, Artificial Sequence
  Oligomer
acaucgguaucuggguaggagag

SEQ ID NO: 83956 - RNA, 23 nt, Artificial Sequence
  Oligomer
caucgguaucuggguaggagagg

SEQ ID NO: 83957 - RNA, 23 nt, Artificial Sequence
  Oligomer
aucgguaucuggguaggagaggg

SEQ ID NO: 83958 - RNA, 23 nt, Artificial Sequence
  Oligomer
ucgguaucuggguaggagagggg

SEQ ID NO: 83959 - RNA, 23 nt, Artificial Sequence
  Oligomer
cagguuaugccaucuuccaaagu

SEQ ID NO: 83960 - RNA, 23 nt, Artificial Sequence
  Oligomer
gagcacugugaauuagagccaga

SEQ ID NO: 83961 - RNA, 23 nt, Artificial Sequence
  Oligomer
agcacugugaauuagagccagau

SEQ ID NO: 83962 - RNA, 23 nt, Artificial Sequence
  Oligomer
uccaucuuuggucuuugcugaac

SEQ ID NO: 83963 - RNA, 23 nt, Artificial Sequence
  Oligomer
gucgauggaaaaacacaucagua

SEQ ID NO: 83964 - RNA, 23 nt, Artificial Sequence
  Oligomer
ucgauggaaaaacacaucaguau

SEQ ID NO: 83965 - RNA, 23 nt, Artificial Sequence
  Oligomer
cgauggaaaaacacaucaguaua

SEQ ID NO: 83966 - RNA, 23 nt, Artificial Sequence
  Oligomer
gauggaaaaacacaucaguauaa

SEQ ID NO: 83967 - RNA, 23 nt, Artificial Sequence
  Oligomer
auggaaaaacacaucaguauaac

SEQ ID NO: 83968 - RNA, 23 nt, Artificial Sequence
  Oligomer
auaacaucgguaucuggguagga

SEQ ID NO: 83969 - RNA, 23 nt, Artificial Sequence
  Oligomer
uacaccucugggaacugguccuu

SEQ ID NO: 83970 - RNA, 23 nt, Artificial Sequence
  Oligomer
cacaagacaaggcacccagauuu

SEQ ID NO: 83971 - RNA, 23 nt, Artificial Sequence
  Oligomer
acaagacaaggcacccagauuuu

SEQ ID NO: 83972 - RNA, 23 nt, Artificial Sequence
  Oligomer
caagacaaggcacccagauuuuu

SEQ ID NO: 83973 - RNA, 23 nt, Artificial Sequence
  Oligomer
aagacaaggcacccagauuuuuu

SEQ ID NO: 83974 - RNA, 23 nt, Artificial Sequence
  Oligomer
acucugccacagcugcaugaacu

SEQ ID NO: 83975 - RNA, 23 nt, Artificial Sequence
  Oligomer
cucugccacagcugcaugaacuu

SEQ ID NO: 83976 - RNA, 23 nt, Artificial Sequence
  Oligomer
ucugccacagcugcaugaacuug

SEQ ID NO: 83977 - RNA, 23 nt, Artificial Sequence
  Oligomer
uuagucagcuggagagaagagag

SEQ ID NO: 83978 - RNA, 23 nt, Artificial Sequence
  Oligomer
uagucagcuggagagaagagaga

SEQ ID NO: 83979 - RNA, 23 nt, Artificial Sequence
  Oligomer
agucagcuggagagaagagagac

SEQ ID NO: 83980 - RNA, 23 nt, Artificial Sequence
  Oligomer
gucagcuggagagaagagagacu

SEQ ID NO: 83981 - RNA, 23 nt, Artificial Sequence
  Oligomer
aguuuagucagcuggagagaaga

SEQ ID NO: 83982 - RNA, 23 nt, Artificial Sequence
  Oligomer
guuuagucagcuggagagaagag

SEQ ID NO: 83983 - RNA, 23 nt, Artificial Sequence
  Oligomer
uuuagucagcuggagagaagaga

SEQ ID NO: 83984 - RNA, 23 nt, Artificial Sequence
  Oligomer
gaaaaacacaucaguauaacauc

SEQ ID NO: 83985 - RNA, 23 nt, Artificial Sequence
  Oligomer
gccaucuuccaaagugucuaauu

SEQ ID NO: 83986 - RNA, 23 nt, Artificial Sequence
  Oligomer
ccaguuucuuccggauggcagcc

SEQ ID NO: 83987 - RNA, 23 nt, Artificial Sequence
  Oligomer
caguuucuuccggauggcagcca

SEQ ID NO: 83988 - RNA, 23 nt, Artificial Sequence
  Oligomer
aguuucuuccggauggcagccau

SEQ ID NO: 83989 - RNA, 23 nt, Artificial Sequence
  Oligomer
gugcuugcagcaagguuucacaa

SEQ ID NO: 83990 - RNA, 23 nt, Artificial Sequence
  Oligomer
cacaaagccaacucuaccugcuu

SEQ ID NO: 83991 - RNA, 23 nt, Artificial Sequence
  Oligomer
ugaauuagagccagaugcuuaag

SEQ ID NO: 83992 - RNA, 23 nt, Artificial Sequence
  Oligomer
cugccuucuucagguuucaccgg

SEQ ID NO: 83993 - RNA, 23 nt, Artificial Sequence
  Oligomer
aacaugaaaccacagaacuguaa

SEQ ID NO: 83994 - RNA, 23 nt, Artificial Sequence
  Oligomer
acaugaaaccacagaacuguaac

SEQ ID NO: 83995 - RNA, 23 nt, Artificial Sequence
  Oligomer
guaccuugcagcugacagauaau

SEQ ID NO: 83996 - RNA, 23 nt, Artificial Sequence
  Oligomer
cuagaaagaagcaagaaguuaag

SEQ ID NO: 83997 - RNA, 23 nt, Artificial Sequence
  Oligomer
aaucuuccugcccagcugugucc

SEQ ID NO: 83998 - RNA, 23 nt, Artificial Sequence
  Oligomer
gugugcucaucauuccgaagauc

SEQ ID NO: 83999 - RNA, 23 nt, Artificial Sequence
  Oligomer
ggggccucaggcgaucauaaucu

SEQ ID NO: 84000 - RNA, 23 nt, Artificial Sequence
  Oligomer
gggccucaggcgaucauaaucuu

SEQ ID NO: 84001 - RNA, 23 nt, Artificial Sequence
  Oligomer
gugucaaaaggacccuggugggc

SEQ ID NO: 84002 - RNA, 23 nt, Artificial Sequence
  Oligomer
ugucaaaaggacccuggugggcc

SEQ ID NO: 84003 - RNA, 23 nt, Artificial Sequence
  Oligomer
aggagaaaagagcacugugaauu

SEQ ID NO: 84004 - RNA, 23 nt, Artificial Sequence
  Oligomer
aaagugacaaaacgggaauuuaa

SEQ ID NO: 84005 - RNA, 23 nt, Artificial Sequence
  Oligomer
aagugacaaaacgggaauuuaaa

SEQ ID NO: 84006 - RNA, 23 nt, Artificial Sequence
  Oligomer
agugacaaaacgggaauuuaaaa

SEQ ID NO: 84007 - RNA, 23 nt, Artificial Sequence
  Oligomer
gugacaaaacgggaauuuaaaaa

SEQ ID NO: 84008 - RNA, 23 nt, Artificial Sequence
  Oligomer
ugacaaaacgggaauuuaaaaaa

SEQ ID NO: 84009 - RNA, 23 nt, Artificial Sequence
  Oligomer
ggaguaaagcccugaagugguga

SEQ ID NO: 84010 - RNA, 23 nt, Artificial Sequence
  Oligomer
gaguaaagcccugaaguggugac

SEQ ID NO: 84011 - RNA, 23 nt, Artificial Sequence
  Oligomer
aguaaagcccugaaguggugacu

SEQ ID NO: 84012 - RNA, 23 nt, Artificial Sequence
  Oligomer
guaaagcccugaaguggugacuc

SEQ ID NO: 84013 - RNA, 23 nt, Artificial Sequence
  Oligomer
uaaagcccugaaguggugacuca

SEQ ID NO: 84014 - RNA, 23 nt, Artificial Sequence
  Oligomer
uggaaaaacacaucaguauaaca

SEQ ID NO: 84015 - RNA, 23 nt, Artificial Sequence
  Oligomer
agccauugcucaggcaacgaauc

SEQ ID NO: 84016 - RNA, 23 nt, Artificial Sequence
  Oligomer
aaagccaacucuaccugcuuucc

SEQ ID NO: 84017 - RNA, 23 nt, Artificial Sequence
  Oligomer
guccacuuuucugggauguuuuc

SEQ ID NO: 84018 - RNA, 23 nt, Artificial Sequence
  Oligomer
uccacuuuucugggauguuuucu

SEQ ID NO: 84019 - RNA, 23 nt, Artificial Sequence
  Oligomer
gcccugaaguggugacucaccag

SEQ ID NO: 84020 - RNA, 23 nt, Artificial Sequence
  Oligomer
cccugaaguggugacucaccaga

SEQ ID NO: 84021 - RNA, 23 nt, Artificial Sequence
  Oligomer
cuucccacgucuagcuugcagag

SEQ ID NO: 84022 - RNA, 23 nt, Artificial Sequence
  Oligomer
uucccacgucuagcuugcagagc

SEQ ID NO: 84023 - RNA, 23 nt, Artificial Sequence
  Oligomer
uaacaucgguaucuggguaggag

SEQ ID NO: 84024 - RNA, 23 nt, Artificial Sequence
  Oligomer
acccaugagaacugguggcuccu

SEQ ID NO: 84025 - RNA, 23 nt, Artificial Sequence
  Oligomer
cccaugagaacugguggcuccuc

SEQ ID NO: 84026 - RNA, 23 nt, Artificial Sequence
  Oligomer
ccaugagaacugguggcuccucu

SEQ ID NO: 84027 - RNA, 23 nt, Artificial Sequence
  Oligomer
caugagaacugguggcuccucug

SEQ ID NO: 84028 - RNA, 23 nt, Artificial Sequence
  Oligomer
augagaacugguggcuccucugg

SEQ ID NO: 84029 - RNA, 23 nt, Artificial Sequence
  Oligomer
gaccagaccguggacuaacgaga

SEQ ID NO: 84030 - RNA, 23 nt, Artificial Sequence
  Oligomer
accagaccguggacuaacgagag

SEQ ID NO: 84031 - RNA, 23 nt, Artificial Sequence
  Oligomer
ccagaccguggacuaacgagaga

SEQ ID NO: 84032 - RNA, 23 nt, Artificial Sequence
  Oligomer
cagaccguggacuaacgagagaa

SEQ ID NO: 84033 - RNA, 23 nt, Artificial Sequence
  Oligomer
agaccguggacuaacgagagaac

SEQ ID NO: 84034 - RNA, 23 nt, Artificial Sequence
  Oligomer
agccaacucuaccugcuuuccau

SEQ ID NO: 84035 - RNA, 23 nt, Artificial Sequence
  Oligomer
ccaucuuuggucuuugcugaaca

SEQ ID NO: 84036 - RNA, 23 nt, Artificial Sequence
  Oligomer
acugagugccacccaugagaacu

SEQ ID NO: 84037 - RNA, 23 nt, Artificial Sequence
  Oligomer
cugagugccacccaugagaacug

SEQ ID NO: 84038 - RNA, 23 nt, Artificial Sequence
  Oligomer
gagugccacccaugagaacuggu

SEQ ID NO: 84039 - RNA, 23 nt, Artificial Sequence
  Oligomer
agugccacccaugagaacuggug

SEQ ID NO: 84040 - RNA, 23 nt, Artificial Sequence
  Oligomer
cuggauacagugaggagaaaaga

SEQ ID NO: 84041 - RNA, 23 nt, Artificial Sequence
  Oligomer
uacggaguaaagcccugaagugg

SEQ ID NO: 84042 - RNA, 23 nt, Artificial Sequence
  Oligomer
uggccaucuuuuaucagaaaaag

SEQ ID NO: 84043 - RNA, 23 nt, Artificial Sequence
  Oligomer
uaguaguuggaaaaauuaacugg

SEQ ID NO: 84044 - RNA, 23 nt, Artificial Sequence
  Oligomer
gaccguggacuaacgagagaacc

SEQ ID NO: 84045 - RNA, 23 nt, Artificial Sequence
  Oligomer
caccagaguaccuugcagcugac

SEQ ID NO: 84046 - RNA, 23 nt, Artificial Sequence
  Oligomer
accagaguaccuugcagcugaca

SEQ ID NO: 84047 - RNA, 23 nt, Artificial Sequence
  Oligomer
gcugcaugaacuugggcuuuucu

SEQ ID NO: 84048 - RNA, 23 nt, Artificial Sequence
  Oligomer
caugaaaccacagaacuguaacu

SEQ ID NO: 84049 - RNA, 23 nt, Artificial Sequence
  Oligomer
aagccaacucuaccugcuuucca

SEQ ID NO: 84050 - RNA, 23 nt, Artificial Sequence
  Oligomer
agggcugucgauggaaaaacaca

SEQ ID NO: 84051 - RNA, 19 nt, Artificial Sequence
  Oligomer
ccacaacuaauuucaccca

SEQ ID NO: 84052 - RNA, 19 nt, Artificial Sequence
  Oligomer
cauggaugcuggcaucuua

SEQ ID NO: 84053 - RNA, 19 nt, Artificial Sequence
  Oligomer
gagacagcucagcacugaa

SEQ ID NO: 84054 - RNA, 19 nt, Artificial Sequence
  Oligomer
agucuaacaccacaacuaa

SEQ ID NO: 84055 - RNA, 19 nt, Artificial Sequence
  Oligomer
caucaaucggaacucaagu

SEQ ID NO: 84056 - RNA, 19 nt, Artificial Sequence
  Oligomer
guguaaggaugcaguggga

SEQ ID NO: 84057 - RNA, 19 nt, Artificial Sequence
  Oligomer
cggugaguguaaggaugca

SEQ ID NO: 84058 - RNA, 19 nt, Artificial Sequence
  Oligomer
uggagaucagcguggugaa

SEQ ID NO: 84059 - RNA, 19 nt, Artificial Sequence
  Oligomer
cauugagacugaguugaca

SEQ ID NO: 84060 - RNA, 19 nt, Artificial Sequence
  Oligomer
caucguccucacagucuua

SEQ ID NO: 84061 - RNA, 19 nt, Artificial Sequence
  Oligomer
ucaucaaucggaacucaag

SEQ ID NO: 84062 - RNA, 19 nt, Artificial Sequence
  Oligomer
gaugugccagauacccaaa

SEQ ID NO: 84063 - RNA, 19 nt, Artificial Sequence
  Oligomer
cuauuuugagggcagugga

SEQ ID NO: 84064 - RNA, 19 nt, Artificial Sequence
  Oligomer
ccuauuucuggcugccuca

SEQ ID NO: 84065 - RNA, 19 nt, Artificial Sequence
  Oligomer
gagauugaagaaauccgaa

SEQ ID NO: 84066 - RNA, 19 nt, Artificial Sequence
  Oligomer
guccuugaacaauuugugc

SEQ ID NO: 84067 - RNA, 19 nt, Artificial Sequence
  Oligomer
ccaauaccuauguaugcaa

SEQ ID NO: 84068 - RNA, 19 nt, Artificial Sequence
  Oligomer
acaucacacgggcaucaca

SEQ ID NO: 84069 - RNA, 19 nt, Artificial Sequence
  Oligomer
gucuaacaccacaacuaau

SEQ ID NO: 84070 - RNA, 19 nt, Artificial Sequence
  Oligomer
cugauuucccaccucccaa

SEQ ID NO: 84071 - RNA, 19 nt, Artificial Sequence
  Oligomer
gcaugaccaagaaugugga

SEQ ID NO: 84072 - RNA, 19 nt, Artificial Sequence
  Oligomer
ccauggcaagccauuuaca

SEQ ID NO: 84073 - RNA, 19 nt, Artificial Sequence
  Oligomer
agaagguaacgucauucca

SEQ ID NO: 84074 - RNA, 19 nt, Artificial Sequence
  Oligomer
uggcaagaagguaacguca

SEQ ID NO: 84075 - RNA, 19 nt, Artificial Sequence
  Oligomer
gagguuuggcaagaaggua

SEQ ID NO: 84076 - RNA, 19 nt, Artificial Sequence
  Oligomer
cacgcagcucugugucaaa

SEQ ID NO: 84077 - RNA, 19 nt, Artificial Sequence
  Oligomer
caugaccaagaauguggaa

SEQ ID NO: 84078 - RNA, 19 nt, Artificial Sequence
  Oligomer
cagacggugcaacaguuca

SEQ ID NO: 84079 - RNA, 19 nt, Artificial Sequence
  Oligomer
ggcuguucuccaagaagga

SEQ ID NO: 84080 - RNA, 19 nt, Artificial Sequence
  Oligomer
aacaaaucucagaagacaa

SEQ ID NO: 84081 - RNA, 19 nt, Artificial Sequence
  Oligomer
gugucucagccuggagaaa

SEQ ID NO: 84082 - RNA, 19 nt, Artificial Sequence
  Oligomer
gauuugaugggugguacaa

SEQ ID NO: 84083 - RNA, 19 nt, Artificial Sequence
  Oligomer
gguucugaaccggagucua

SEQ ID NO: 84084 - RNA, 19 nt, Artificial Sequence
  Oligomer
guuugaggugucaguguua

SEQ ID NO: 84085 - RNA, 19 nt, Artificial Sequence
  Oligomer
ccuacaucagccaggauau

SEQ ID NO: 84086 - RNA, 19 nt, Artificial Sequence
  Oligomer
guuugagaacaccaggaau

SEQ ID NO: 84087 - RNA, 19 nt, Artificial Sequence
  Oligomer
aacccucccuacucccaua

SEQ ID NO: 84088 - RNA, 19 nt, Artificial Sequence
  Oligomer
ggaugcuggcaucuuagaa

SEQ ID NO: 84089 - RNA, 19 nt, Artificial Sequence
  Oligomer
caaccucauggagcacaga

SEQ ID NO: 84090 - RNA, 19 nt, Artificial Sequence
  Oligomer
uuugaugggugguacaaca

SEQ ID NO: 84091 - RNA, 19 nt, Artificial Sequence
  Oligomer
aaguguucuguaagaagau

SEQ ID NO: 84092 - RNA, 19 nt, Artificial Sequence
  Oligomer
cagaugugccagauaccca

SEQ ID NO: 84093 - RNA, 19 nt, Artificial Sequence
  Oligomer
guagcuuugcccugaucca

SEQ ID NO: 84094 - RNA, 19 nt, Artificial Sequence
  Oligomer
gaagcuuuggaauggcaag

SEQ ID NO: 84095 - RNA, 19 nt, Artificial Sequence
  Oligomer
cuuuugccuccauccucaa

SEQ ID NO: 84096 - RNA, 19 nt, Artificial Sequence
  Oligomer
cccagggcuuugaguacaa

SEQ ID NO: 84097 - RNA, 19 nt, Artificial Sequence
  Oligomer
gggaauggccucauuucca

SEQ ID NO: 84098 - RNA, 19 nt, Artificial Sequence
  Oligomer
caggauaccggccauuucu

SEQ ID NO: 84099 - RNA, 19 nt, Artificial Sequence
  Oligomer
agaacaucgcuguguauga

SEQ ID NO: 84100 - RNA, 19 nt, Artificial Sequence
  Oligomer
guucugaaccggagucuau

SEQ ID NO: 84101 - RNA, 19 nt, Artificial Sequence
  Oligomer
ucaugaaaggcucuccuga

SEQ ID NO: 84102 - RNA, 19 nt, Artificial Sequence
  Oligomer
cuuugucuggcauaaagga

SEQ ID NO: 84103 - RNA, 19 nt, Artificial Sequence
  Oligomer
ugaaguuuucccgcacaga

SEQ ID NO: 84104 - RNA, 19 nt, Artificial Sequence
  Oligomer
ucugguuccgcuaccacaa

SEQ ID NO: 84105 - RNA, 19 nt, Artificial Sequence
  Oligomer
cagucuaacaccacaacua

SEQ ID NO: 84106 - RNA, 19 nt, Artificial Sequence
  Oligomer
agccauuuacagaaaccca

SEQ ID NO: 84107 - RNA, 19 nt, Artificial Sequence
  Oligomer
cagaagguucugaaccgga

SEQ ID NO: 84108 - RNA, 19 nt, Artificial Sequence
  Oligomer
aauuugugcggcuacggga

SEQ ID NO: 84109 - RNA, 19 nt, Artificial Sequence
  Oligomer
caaucggaacucaaguguc

SEQ ID NO: 84110 - RNA, 19 nt, Artificial Sequence
  Oligomer
uaauuucacccaagguuuu

SEQ ID NO: 84111 - RNA, 19 nt, Artificial Sequence
  Oligomer
acaccacaacuaauuucac

SEQ ID NO: 84112 - RNA, 19 nt, Artificial Sequence
  Oligomer
gaagguucugaaccggagu

SEQ ID NO: 84113 - RNA, 19 nt, Artificial Sequence
  Oligomer
caugguagcuuugcccuga

SEQ ID NO: 84114 - RNA, 19 nt, Artificial Sequence
  Oligomer
uggagagggccuacuacua

SEQ ID NO: 84115 - RNA, 19 nt, Artificial Sequence
  Oligomer
gugcuuucagaccugguga

SEQ ID NO: 84116 - RNA, 19 nt, Artificial Sequence
  Oligomer
aguagucucccuuccaaau

SEQ ID NO: 84117 - RNA, 19 nt, Artificial Sequence
  Oligomer
ccuuagcaacaccaucuca

SEQ ID NO: 84118 - RNA, 19 nt, Artificial Sequence
  Oligomer
gcugaccugacaaguacua

SEQ ID NO: 84119 - RNA, 19 nt, Artificial Sequence
  Oligomer
cugcuuccagacuucagaa

SEQ ID NO: 84120 - RNA, 19 nt, Artificial Sequence
  Oligomer
uggucccagcaaucaucua

SEQ ID NO: 84121 - RNA, 19 nt, Artificial Sequence
  Oligomer
gaagguaacgucauuccag

SEQ ID NO: 84122 - RNA, 19 nt, Artificial Sequence
  Oligomer
aggaugaguucaucaggau

SEQ ID NO: 84123 - RNA, 19 nt, Artificial Sequence
  Oligomer
aaggaugaguucaucagga

SEQ ID NO: 84124 - RNA, 19 nt, Artificial Sequence
  Oligomer
ccauguucucucuggcuga

SEQ ID NO: 84125 - RNA, 19 nt, Artificial Sequence
  Oligomer
gaaauaccacccugcagga

SEQ ID NO: 84126 - RNA, 19 nt, Artificial Sequence
  Oligomer
ucaucgccaccuaccagaa

SEQ ID NO: 84127 - RNA, 19 nt, Artificial Sequence
  Oligomer
cuauguaugcaaugcuccu

SEQ ID NO: 84128 - RNA, 19 nt, Artificial Sequence
  Oligomer
aacaccacaacuaauuuca

SEQ ID NO: 84129 - RNA, 19 nt, Artificial Sequence
  Oligomer
ccuuugagcccuucuucaa

SEQ ID NO: 84130 - RNA, 19 nt, Artificial Sequence
  Oligomer
uguacaucugugagcggca

SEQ ID NO: 84131 - RNA, 19 nt, Artificial Sequence
  Oligomer
gugucugugcacaucuaca

SEQ ID NO: 84132 - RNA, 19 nt, Artificial Sequence
  Oligomer
gacaaggaggaacugacau

SEQ ID NO: 84133 - RNA, 19 nt, Artificial Sequence
  Oligomer
aaggcucuccugaggaaaa

SEQ ID NO: 84134 - RNA, 19 nt, Artificial Sequence
  Oligomer
ccuugaacaauuugugcgg

SEQ ID NO: 84135 - RNA, 19 nt, Artificial Sequence
  Oligomer
cucuguucagcaccaucgu

SEQ ID NO: 84136 - RNA, 19 nt, Artificial Sequence
  Oligomer
aguuuucccgcacagacca

SEQ ID NO: 84137 - RNA, 19 nt, Artificial Sequence
  Oligomer
aagugcugaagauguggau

SEQ ID NO: 84138 - RNA, 19 nt, Artificial Sequence
  Oligomer
aagccuacaaagugcugaa

SEQ ID NO: 84139 - RNA, 19 nt, Artificial Sequence
  Oligomer
gugaguguaaggaugcagu

SEQ ID NO: 84140 - RNA, 19 nt, Artificial Sequence
  Oligomer
caaguacuaugugugugca

SEQ ID NO: 84141 - RNA, 19 nt, Artificial Sequence
  Oligomer
ggugucaguguuaguggga

SEQ ID NO: 84142 - RNA, 19 nt, Artificial Sequence
  Oligomer
uccugauccuggccaucau

SEQ ID NO: 84143 - RNA, 19 nt, Artificial Sequence
  Oligomer
ucguccucacagucuuaca

SEQ ID NO: 84144 - RNA, 19 nt, Artificial Sequence
  Oligomer
agcccuugcuguucacuga

SEQ ID NO: 84145 - RNA, 19 nt, Artificial Sequence
  Oligomer
gaaaagucucgccuuaugu

SEQ ID NO: 84146 - RNA, 19 nt, Artificial Sequence
  Oligomer
caaggauggcaauggcuac

SEQ ID NO: 84147 - RNA, 19 nt, Artificial Sequence
  Oligomer
ccuuuuucaggcaccuuuu

SEQ ID NO: 84148 - RNA, 19 nt, Artificial Sequence
  Oligomer
augccuugcaggagguaga

SEQ ID NO: 84149 - RNA, 19 nt, Artificial Sequence
  Oligomer
cuuguuccagguggccaua

SEQ ID NO: 84150 - RNA, 19 nt, Artificial Sequence
  Oligomer
acaucauccgagaggugga

SEQ ID NO: 84151 - RNA, 19 nt, Artificial Sequence
  Oligomer
uggcugacaucauccgaga

SEQ ID NO: 84152 - RNA, 19 nt, Artificial Sequence
  Oligomer
gccagauacccaaagcugu

SEQ ID NO: 84153 - RNA, 19 nt, Artificial Sequence
  Oligomer
cuuccaugaugaugggucu

SEQ ID NO: 84154 - RNA, 19 nt, Artificial Sequence
  Oligomer
aguucaagcgcuucauuga

SEQ ID NO: 84155 - RNA, 19 nt, Artificial Sequence
  Oligomer
acaaggauggcaauggcua

SEQ ID NO: 84156 - RNA, 19 nt, Artificial Sequence
  Oligomer
uauuuugagggcaguggau

SEQ ID NO: 84157 - RNA, 19 nt, Artificial Sequence
  Oligomer
aacuaauuucacccaaggu

SEQ ID NO: 84158 - RNA, 19 nt, Artificial Sequence
  Oligomer
ccugacaaguacuaugugu

SEQ ID NO: 84159 - RNA, 19 nt, Artificial Sequence
  Oligomer
agcugaccugacaaguacu

SEQ ID NO: 84160 - RNA, 19 nt, Artificial Sequence
  Oligomer
caccauuaugagaacuucu

SEQ ID NO: 84161 - RNA, 19 nt, Artificial Sequence
  Oligomer
cccuggcaugaccaagaau

SEQ ID NO: 84162 - RNA, 19 nt, Artificial Sequence
  Oligomer
gugacagaugugccagaua

SEQ ID NO: 84163 - RNA, 19 nt, Artificial Sequence
  Oligomer
ugauccuggccaucaugua

SEQ ID NO: 84164 - RNA, 19 nt, Artificial Sequence
  Oligomer
aaguauuacuggugguucu

SEQ ID NO: 84165 - RNA, 19 nt, Artificial Sequence
  Oligomer
aucacacgggcaucacaga

SEQ ID NO: 84166 - RNA, 19 nt, Artificial Sequence
  Oligomer
agacugaguugacaccuca

SEQ ID NO: 84167 - RNA, 19 nt, Artificial Sequence
  Oligomer
aacugacaugggaagauuu

SEQ ID NO: 84168 - RNA, 19 nt, Artificial Sequence
  Oligomer
aguuccucaacauucgcau

SEQ ID NO: 84169 - RNA, 19 nt, Artificial Sequence
  Oligomer
ucuucucccugcuccagua

SEQ ID NO: 84170 - RNA, 19 nt, Artificial Sequence
  Oligomer
uggaugcuggcaucuuaga

SEQ ID NO: 84171 - RNA, 19 nt, Artificial Sequence
  Oligomer
cuaugugugugcaugucug

SEQ ID NO: 84172 - RNA, 19 nt, Artificial Sequence
  Oligomer
uugaugggugguacaacaa

SEQ ID NO: 84173 - RNA, 19 nt, Artificial Sequence
  Oligomer
acuuccagaagguucugaa

SEQ ID NO: 84174 - RNA, 19 nt, Artificial Sequence
  Oligomer
cucuauguccugcucauca

SEQ ID NO: 84175 - RNA, 19 nt, Artificial Sequence
  Oligomer
cugcgagaaaccuuccuca

SEQ ID NO: 84176 - RNA, 19 nt, Artificial Sequence
  Oligomer
caccgagagaaguuccaac

SEQ ID NO: 84177 - RNA, 19 nt, Artificial Sequence
  Oligomer
uccugguggucuucaugaa

SEQ ID NO: 84178 - RNA, 19 nt, Artificial Sequence
  Oligomer
acauccugguggucuucau

SEQ ID NO: 84179 - RNA, 19 nt, Artificial Sequence
  Oligomer
ugcuggucgcuguuaucaa

SEQ ID NO: 84180 - RNA, 19 nt, Artificial Sequence
  Oligomer
gaagaugugcgggauuucu

SEQ ID NO: 84181 - RNA, 19 nt, Artificial Sequence
  Oligomer
cuaacaccacaacuaauuu

SEQ ID NO: 84182 - RNA, 19 nt, Artificial Sequence
  Oligomer
agacaagcugaccugacaa

SEQ ID NO: 84183 - RNA, 19 nt, Artificial Sequence
  Oligomer
aggagaaugaccaccagga

SEQ ID NO: 84184 - RNA, 19 nt, Artificial Sequence
  Oligomer
aguuugaguggcuggcuga

SEQ ID NO: 84185 - RNA, 19 nt, Artificial Sequence
  Oligomer
uccuggucccagcaaucau

SEQ ID NO: 84186 - RNA, 19 nt, Artificial Sequence
  Oligomer
uggugaauguguaccuguu

SEQ ID NO: 84187 - RNA, 19 nt, Artificial Sequence
  Oligomer
aggacaaggaggaacugac

SEQ ID NO: 84188 - RNA, 19 nt, Artificial Sequence
  Oligomer
ugcugagauccuucaucga

SEQ ID NO: 84189 - RNA, 19 nt, Artificial Sequence
  Oligomer
cuuuggaauggcaaggcca

SEQ ID NO: 84190 - RNA, 19 nt, Artificial Sequence
  Oligomer
gagcaucgugucugagaag

SEQ ID NO: 84191 - RNA, 19 nt, Artificial Sequence
  Oligomer
cagagcaucgugucugaga

SEQ ID NO: 84192 - RNA, 19 nt, Artificial Sequence
  Oligomer
cuccaagaaggagauugaa

SEQ ID NO: 84193 - RNA, 19 nt, Artificial Sequence
  Oligomer
agaugugcgggauuucugg

SEQ ID NO: 84194 - RNA, 19 nt, Artificial Sequence
  Oligomer
aucagacccuggcccaaua

SEQ ID NO: 84195 - RNA, 19 nt, Artificial Sequence
  Oligomer
gcaugucuguauguguguu

SEQ ID NO: 84196 - RNA, 19 nt, Artificial Sequence
  Oligomer
agcuggcugagaaguucga

SEQ ID NO: 84197 - RNA, 19 nt, Artificial Sequence
  Oligomer
agguggaggagaaugacca

SEQ ID NO: 84198 - RNA, 19 nt, Artificial Sequence
  Oligomer
cuuacacagugugggccau

SEQ ID NO: 84199 - RNA, 19 nt, Artificial Sequence
  Oligomer
uggaggugccugaagucau

SEQ ID NO: 84200 - RNA, 19 nt, Artificial Sequence
  Oligomer
gaauggccucauuuccaag

SEQ ID NO: 84201 - RNA, 19 nt, Artificial Sequence
  Oligomer
ccuuauguuccgcauguac

SEQ ID NO: 84202 - RNA, 19 nt, Artificial Sequence
  Oligomer
caugaaaggcucuccugag

SEQ ID NO: 84203 - RNA, 19 nt, Artificial Sequence
  Oligomer
uugucuggcauaaaggaga

SEQ ID NO: 84204 - RNA, 19 nt, Artificial Sequence
  Oligomer
gaaguuuucccgcacagac

SEQ ID NO: 84205 - RNA, 19 nt, Artificial Sequence
  Oligomer
uauacaggauaccggccau

SEQ ID NO: 84206 - RNA, 19 nt, Artificial Sequence
  Oligomer
ugcagaaaacacucccgga

SEQ ID NO: 84207 - RNA, 19 nt, Artificial Sequence
  Oligomer
ugugcaugucuguaugugu

SEQ ID NO: 84208 - RNA, 19 nt, Artificial Sequence
  Oligomer
guacuaugugugugcaugu

SEQ ID NO: 84209 - RNA, 19 nt, Artificial Sequence
  Oligomer
ucuagggacuagagugaga

SEQ ID NO: 84210 - RNA, 19 nt, Artificial Sequence
  Oligomer
aguggcuggcugacaucau

SEQ ID NO: 84211 - RNA, 19 nt, Artificial Sequence
  Oligomer
cagggcuuugaguacaagu

SEQ ID NO: 84212 - RNA, 19 nt, Artificial Sequence
  Oligomer
uacuggugguucuuccaga

SEQ ID NO: 84213 - RNA, 19 nt, Artificial Sequence
  Oligomer
cucucuggcugacaaggau

SEQ ID NO: 84214 - RNA, 19 nt, Artificial Sequence
  Oligomer
gagcaaugacacuguacug

SEQ ID NO: 84215 - RNA, 19 nt, Artificial Sequence
  Oligomer
guugaagaugugcgggauu

SEQ ID NO: 84216 - RNA, 19 nt, Artificial Sequence
  Oligomer
uaugguuccucgcauuccu

SEQ ID NO: 84217 - RNA, 19 nt, Artificial Sequence
  Oligomer
uuuuaagcacguucuuuca

SEQ ID NO: 84218 - RNA, 19 nt, Artificial Sequence
  Oligomer
ugugucucagccuggagaa

SEQ ID NO: 84219 - RNA, 19 nt, Artificial Sequence
  Oligomer
cuggcaugaccaagaaugu

SEQ ID NO: 84220 - RNA, 19 nt, Artificial Sequence
  Oligomer
aaagcuguaccuugaugga

SEQ ID NO: 84221 - RNA, 19 nt, Artificial Sequence
  Oligomer
aguucaucaggaugcugag

SEQ ID NO: 84222 - RNA, 19 nt, Artificial Sequence
  Oligomer
ugaugagagcagcugugac

SEQ ID NO: 84223 - RNA, 19 nt, Artificial Sequence
  Oligomer
cugaugagagcagcuguga

SEQ ID NO: 84224 - RNA, 19 nt, Artificial Sequence
  Oligomer
auuugugcggcuacgggau

SEQ ID NO: 84225 - RNA, 19 nt, Artificial Sequence
  Oligomer
ucccauaccuccuccucuu

SEQ ID NO: 84226 - RNA, 19 nt, Artificial Sequence
  Oligomer
acuucagaaacaaaucuca

SEQ ID NO: 84227 - RNA, 19 nt, Artificial Sequence
  Oligomer
ugucuagggacuagaguga

SEQ ID NO: 84228 - RNA, 19 nt, Artificial Sequence
  Oligomer
uguuccagguggccauagu

SEQ ID NO: 84229 - RNA, 19 nt, Artificial Sequence
  Oligomer
guucuuccagaccguacca

SEQ ID NO: 84230 - RNA, 19 nt, Artificial Sequence
  Oligomer
gaugggaauggccucauuu

SEQ ID NO: 84231 - RNA, 19 nt, Artificial Sequence
  Oligomer
uuauguuccgcauguacga

SEQ ID NO: 84232 - RNA, 19 nt, Artificial Sequence
  Oligomer
gagaguuccuggacauccu

SEQ ID NO: 84233 - RNA, 19 nt, Artificial Sequence
  Oligomer
cuccggaugagaaauuuca

SEQ ID NO: 84234 - RNA, 19 nt, Artificial Sequence
  Oligomer
agggcaguggauuuggcuu

SEQ ID NO: 84235 - RNA, 19 nt, Artificial Sequence
  Oligomer
uccaguagucucccuucca

SEQ ID NO: 84236 - RNA, 19 nt, Artificial Sequence
  Oligomer
acccuggcccaauaccuau

SEQ ID NO: 84237 - RNA, 19 nt, Artificial Sequence
  Oligomer
auuucacccaagguuuuaa

SEQ ID NO: 84238 - RNA, 19 nt, Artificial Sequence
  Oligomer
caccacaacuaauuucacc

SEQ ID NO: 84239 - RNA, 19 nt, Artificial Sequence
  Oligomer
gacccauggcaagccauuu

SEQ ID NO: 84240 - RNA, 19 nt, Artificial Sequence
  Oligomer
uggcaaaugccuugcagga

SEQ ID NO: 84241 - RNA, 19 nt, Artificial Sequence
  Oligomer
uguggaaaaggccugucag

SEQ ID NO: 84242 - RNA, 19 nt, Artificial Sequence
  Oligomer
gaauguggaaaaggccugu

SEQ ID NO: 84243 - RNA, 19 nt, Artificial Sequence
  Oligomer
cacuaugcuguacaucugu

SEQ ID NO: 84244 - RNA, 19 nt, Artificial Sequence
  Oligomer
gagaaguucgaccucagga

SEQ ID NO: 84245 - RNA, 19 nt, Artificial Sequence
  Oligomer
uugaguggcuggcugacau

SEQ ID NO: 84246 - RNA, 19 nt, Artificial Sequence
  Oligomer
gacggugcaacaguucaag

SEQ ID NO: 84247 - RNA, 19 nt, Artificial Sequence
  Oligomer
cauuccagcccuugcuguu

SEQ ID NO: 84248 - RNA, 19 nt, Artificial Sequence
  Oligomer
cagcgacauugagacugag

SEQ ID NO: 84249 - RNA, 19 nt, Artificial Sequence
  Oligomer
gauuccaggacaaggagga

SEQ ID NO: 84250 - RNA, 19 nt, Artificial Sequence
  Oligomer
aggugguggaguccauguu

SEQ ID NO: 84251 - RNA, 19 nt, Artificial Sequence
  Oligomer
aaaagucucgccuuauguu

SEQ ID NO: 84252 - RNA, 19 nt, Artificial Sequence
  Oligomer
ggugcugcuguuuaacuug

SEQ ID NO: 84253 - RNA, 19 nt, Artificial Sequence
  Oligomer
ugaagauguggaugcacug

SEQ ID NO: 84254 - RNA, 19 nt, Artificial Sequence
  Oligomer
gucugcaacagcuacugga

SEQ ID NO: 84255 - RNA, 19 nt, Artificial Sequence
  Oligomer
uggcuaucacgugcuuuca

SEQ ID NO: 84256 - RNA, 19 nt, Artificial Sequence
  Oligomer
cugagaaaccgcacagugu

SEQ ID NO: 84257 - RNA, 19 nt, Artificial Sequence
  Oligomer
gcauggaugcuggcaucuu

SEQ ID NO: 84258 - RNA, 19 nt, Artificial Sequence
  Oligomer
cugaccugacaaguacuau

SEQ ID NO: 84259 - RNA, 19 nt, Artificial Sequence
  Oligomer
ucugcuuccagacuucaga

SEQ ID NO: 84260 - RNA, 19 nt, Artificial Sequence
  Oligomer
ccucugcuuccagacuuca

SEQ ID NO: 84261 - RNA, 19 nt, Artificial Sequence
  Oligomer
ucugauuucccaccuccca

SEQ ID NO: 84262 - RNA, 19 nt, Artificial Sequence
  Oligomer
ugaugggugguacaacaac

SEQ ID NO: 84263 - RNA, 19 nt, Artificial Sequence
  Oligomer
aaaaggccugucagcucau

SEQ ID NO: 84264 - RNA, 19 nt, Artificial Sequence
  Oligomer
uguaugucuuugccuccca

SEQ ID NO: 84265 - RNA, 19 nt, Artificial Sequence
  Oligomer
acaugggaagauuuucacu

SEQ ID NO: 84266 - RNA, 19 nt, Artificial Sequence
  Oligomer
caaggaugaguucaucagg

SEQ ID NO: 84267 - RNA, 19 nt, Artificial Sequence
  Oligomer
aaaggcucuccugaggaaa

SEQ ID NO: 84268 - RNA, 19 nt, Artificial Sequence
  Oligomer
aggacuuauccuggcuaga

SEQ ID NO: 84269 - RNA, 19 nt, Artificial Sequence
  Oligomer
gccuacaaagugcugaaga

SEQ ID NO: 84270 - RNA, 19 nt, Artificial Sequence
  Oligomer
agaagacaagcugaccuga

SEQ ID NO: 84271 - RNA, 19 nt, Artificial Sequence
  Oligomer
accucaggaccacuaugcu

SEQ ID NO: 84272 - RNA, 19 nt, Artificial Sequence
  Oligomer
cauggacacuucugguugg

SEQ ID NO: 84273 - RNA, 19 nt, Artificial Sequence
  Oligomer
ucuuccuggucccagcaau

SEQ ID NO: 84274 - RNA, 19 nt, Artificial Sequence
  Oligomer
aauguguaccuguucucca

SEQ ID NO: 84275 - RNA, 19 nt, Artificial Sequence
  Oligomer
guccucacagucuuacaca

SEQ ID NO: 84276 - RNA, 19 nt, Artificial Sequence
  Oligomer
gagaaguuccaacgcagcu

SEQ ID NO: 84277 - RNA, 19 nt, Artificial Sequence
  Oligomer
ugaguugacaccucagaga

SEQ ID NO: 84278 - RNA, 19 nt, Artificial Sequence
  Oligomer
acugacaugggaagauuuu

SEQ ID NO: 84279 - RNA, 19 nt, Artificial Sequence
  Oligomer
aggaacugacaugggaaga

SEQ ID NO: 84280 - RNA, 19 nt, Artificial Sequence
  Oligomer
aggugcuggacaucaacca

SEQ ID NO: 84281 - RNA, 19 nt, Artificial Sequence
  Oligomer
uuuugagggcaguggauuu

SEQ ID NO: 84282 - RNA, 19 nt, Artificial Sequence
  Oligomer
aaugggcuguucuccaaga

SEQ ID NO: 84283 - RNA, 19 nt, Artificial Sequence
  Oligomer
cccagucuaacaccacaac

SEQ ID NO: 84284 - RNA, 19 nt, Artificial Sequence
  Oligomer
caaagugaaaccucugcuu

SEQ ID NO: 84285 - RNA, 19 nt, Artificial Sequence
  Oligomer
uagggacuagagugagaag

SEQ ID NO: 84286 - RNA, 19 nt, Artificial Sequence
  Oligomer
acaccucaccucuguucuu

SEQ ID NO: 84287 - RNA, 19 nt, Artificial Sequence
  Oligomer
aguugagcagagguuugag

SEQ ID NO: 84288 - RNA, 19 nt, Artificial Sequence
  Oligomer
cagcgauuugauggguggu

SEQ ID NO: 84289 - RNA, 19 nt, Artificial Sequence
  Oligomer
gaggugcagcgauuugaug

SEQ ID NO: 84290 - RNA, 19 nt, Artificial Sequence
  Oligomer
cugccaaguguucuguaag

SEQ ID NO: 84291 - RNA, 19 nt, Artificial Sequence
  Oligomer
aggugucaguguuaguggg

SEQ ID NO: 84292 - RNA, 19 nt, Artificial Sequence
  Oligomer
auaaguuugaggugucagu

SEQ ID NO: 84293 - RNA, 19 nt, Artificial Sequence
  Oligomer
cuugauggaccauuuggag

SEQ ID NO: 84294 - RNA, 19 nt, Artificial Sequence
  Oligomer
augucuuugccucccacca

SEQ ID NO: 84295 - RNA, 19 nt, Artificial Sequence
  Oligomer
ccuuccugcgagaaaccuu

SEQ ID NO: 84296 - RNA, 19 nt, Artificial Sequence
  Oligomer
gaguucaucaggaugcuga

SEQ ID NO: 84297 - RNA, 19 nt, Artificial Sequence
  Oligomer
ugaaaggcucuccugagga

SEQ ID NO: 84298 - RNA, 19 nt, Artificial Sequence
  Oligomer
gauggcaauggcuaccugu

SEQ ID NO: 84299 - RNA, 19 nt, Artificial Sequence
  Oligomer
uguucgugacuauuuugag

SEQ ID NO: 84300 - RNA, 19 nt, Artificial Sequence
  Oligomer
gauaccggccauuucugga

SEQ ID NO: 84301 - RNA, 19 nt, Artificial Sequence
  Oligomer
gaguuccucaacauucgca

SEQ ID NO: 84302 - RNA, 19 nt, Artificial Sequence
  Oligomer
gugugugcaugucuguaug

SEQ ID NO: 84303 - RNA, 19 nt, Artificial Sequence
  Oligomer
aaguacuaugugugugcau

SEQ ID NO: 84304 - RNA, 19 nt, Artificial Sequence
  Oligomer
uguccugcucaucauccau

SEQ ID NO: 84305 - RNA, 19 nt, Artificial Sequence
  Oligomer
ugcucuauguccugcucau

SEQ ID NO: 84306 - RNA, 19 nt, Artificial Sequence
  Oligomer
ccucacagucuuacacagu

SEQ ID NO: 84307 - RNA, 19 nt, Artificial Sequence
  Oligomer
gaaaccuuccucaaccgcu

SEQ ID NO: 84308 - RNA, 19 nt, Artificial Sequence
  Oligomer
agcugaugagagcagcugu

SEQ ID NO: 84309 - RNA, 19 nt, Artificial Sequence
  Oligomer
uccgaaauaccacccugca

SEQ ID NO: 84310 - RNA, 19 nt, Artificial Sequence
  Oligomer
uguguugguugaagaugug

SEQ ID NO: 84311 - RNA, 19 nt, Artificial Sequence
  Oligomer
caagccuacaaagugcuga

SEQ ID NO: 84312 - RNA, 19 nt, Artificial Sequence
  Oligomer
acaggauaccggccauuuc

SEQ ID NO: 84313 - RNA, 19 nt, Artificial Sequence
  Oligomer
cuaucacgugcuuucagac

SEQ ID NO: 84314 - RNA, 19 nt, Artificial Sequence
  Oligomer
gggcaaagugaaaccucug

SEQ ID NO: 84315 - RNA, 19 nt, Artificial Sequence
  Oligomer
gcagugucuagggacuaga

SEQ ID NO: 84316 - RNA, 19 nt, Artificial Sequence
  Oligomer
cucaccucuguucuuccua

SEQ ID NO: 84317 - RNA, 19 nt, Artificial Sequence
  Oligomer
uucugaaccggagucuauu

SEQ ID NO: 84318 - RNA, 19 nt, Artificial Sequence
  Oligomer
caggaguggcauaaguuug

SEQ ID NO: 84319 - RNA, 19 nt, Artificial Sequence
  Oligomer
uuauuuucaucaugggcuu

SEQ ID NO: 84320 - RNA, 19 nt, Artificial Sequence
  Oligomer
auguccugcucaucaucca

SEQ ID NO: 84321 - RNA, 19 nt, Artificial Sequence
  Oligomer
caucaccuuccugcgagaa

SEQ ID NO: 84322 - RNA, 19 nt, Artificial Sequence
  Oligomer
aguugacaccucagagacu

SEQ ID NO: 84323 - RNA, 19 nt, Artificial Sequence
  Oligomer
gacugaguugacaccucag

SEQ ID NO: 84324 - RNA, 19 nt, Artificial Sequence
  Oligomer
ggaugaguucaucaggaug

SEQ ID NO: 84325 - RNA, 19 nt, Artificial Sequence
  Oligomer
ggucuucaugaaaggcucu

SEQ ID NO: 84326 - RNA, 19 nt, Artificial Sequence
  Oligomer
uggagaccuuuuucaggca

SEQ ID NO: 84327 - RNA, 19 nt, Artificial Sequence
  Oligomer
ugaagaaauccgaaauacc

SEQ ID NO: 84328 - RNA, 19 nt, Artificial Sequence
  Oligomer
acgugcuuucagaccuggu

SEQ ID NO: 84329 - RNA, 19 nt, Artificial Sequence
  Oligomer
aggaccaggaugugucuca

SEQ ID NO: 84330 - RNA, 19 nt, Artificial Sequence
  Oligomer
ccucaccucuguucuuccu

SEQ ID NO: 84331 - RNA, 19 nt, Artificial Sequence
  Oligomer
aaggccugucagcucauca

SEQ ID NO: 84332 - RNA, 19 nt, Artificial Sequence
  Oligomer
gagucuauucacaggccug

SEQ ID NO: 84333 - RNA, 19 nt, Artificial Sequence
  Oligomer
agaagguggagaucagcgu

SEQ ID NO: 84334 - RNA, 19 nt, Artificial Sequence
  Oligomer
caggacaaggaggaacuga

SEQ ID NO: 84335 - RNA, 19 nt, Artificial Sequence
  Oligomer
auuccaggacaaggaggaa

SEQ ID NO: 84336 - RNA, 19 nt, Artificial Sequence
  Oligomer
guucgugacuauuuugagg

SEQ ID NO: 84337 - RNA, 19 nt, Artificial Sequence
  Oligomer
ucugcagcccaaugucuuu

SEQ ID NO: 84338 - RNA, 19 nt, Artificial Sequence
  Oligomer
cucugcagcccaaugucuu

SEQ ID NO: 84339 - RNA, 19 nt, Artificial Sequence
  Oligomer
auguguugguugaagaugu

SEQ ID NO: 84340 - RNA, 19 nt, Artificial Sequence
  Oligomer
ucuucuuuggcuaucacgu

SEQ ID NO: 84341 - RNA, 19 nt, Artificial Sequence
  Oligomer
uguaugcaaugcuccucag

SEQ ID NO: 84342 - RNA, 19 nt, Artificial Sequence
  Oligomer
auguaugcaaugcuccuca

SEQ ID NO: 84343 - RNA, 19 nt, Artificial Sequence
  Oligomer
cauaccuccuccucuucug

SEQ ID NO: 84344 - RNA, 19 nt, Artificial Sequence
  Oligomer
ugaccugacaaguacuaug

SEQ ID NO: 84345 - RNA, 19 nt, Artificial Sequence
  Oligomer
gacuagagugagaaguagg

SEQ ID NO: 84346 - RNA, 19 nt, Artificial Sequence
  Oligomer
accucccaaccuuguucca

SEQ ID NO: 84347 - RNA, 19 nt, Artificial Sequence
  Oligomer
cauuaugagaacuucuagg

SEQ ID NO: 84348 - RNA, 19 nt, Artificial Sequence
  Oligomer
agcucaucaacaggcagga

SEQ ID NO: 84349 - RNA, 19 nt, Artificial Sequence
  Oligomer
auguggaaaaggccuguca

SEQ ID NO: 84350 - RNA, 19 nt, Artificial Sequence
  Oligomer
agagguggaggagaaugac

SEQ ID NO: 84351 - RNA, 19 nt, Artificial Sequence
  Oligomer
uugaggugucaguguuagu

SEQ ID NO: 84352 - RNA, 19 nt, Artificial Sequence
  Oligomer
caucuucuuccugguccca

SEQ ID NO: 84353 - RNA, 19 nt, Artificial Sequence
  Oligomer
cauccugcucuauguccug

SEQ ID NO: 84354 - RNA, 19 nt, Artificial Sequence
  Oligomer
caguucaagcgcuucauug

SEQ ID NO: 84355 - RNA, 19 nt, Artificial Sequence
  Oligomer
cagccaggauaugaucugu

SEQ ID NO: 84356 - RNA, 19 nt, Artificial Sequence
  Oligomer
ggugccugaagucaucaag

SEQ ID NO: 84357 - RNA, 19 nt, Artificial Sequence
  Oligomer
aauagcgagcuccgcuuca

SEQ ID NO: 84358 - RNA, 19 nt, Artificial Sequence
  Oligomer
uucacuucaugcugcggga

SEQ ID NO: 84359 - RNA, 19 nt, Artificial Sequence
  Oligomer
ugguggucuucaugaaagg

SEQ ID NO: 84360 - RNA, 19 nt, Artificial Sequence
  Oligomer
aagaaauccgaaauaccac

SEQ ID NO: 84361 - RNA, 19 nt, Artificial Sequence
  Oligomer
guugguugaagaugugcgg

SEQ ID NO: 84362 - RNA, 19 nt, Artificial Sequence
  Oligomer
aaagugcugaagaugugga

SEQ ID NO: 84363 - RNA, 19 nt, Artificial Sequence
  Oligomer
ccauaccuccuccucuucu

SEQ ID NO: 84364 - RNA, 19 nt, Artificial Sequence
  Oligomer
ggugaguguaaggaugcag

SEQ ID NO: 84365 - RNA, 19 nt, Artificial Sequence
  Oligomer
gugcaugucuguaugugug

SEQ ID NO: 84366 - RNA, 19 nt, Artificial Sequence
  Oligomer
aucucagaagacaagcuga

SEQ ID NO: 84367 - RNA, 19 nt, Artificial Sequence
  Oligomer
agugaaaccucugcuucca

SEQ ID NO: 84368 - RNA, 19 nt, Artificial Sequence
  Oligomer
acuucucccaccauuauga

SEQ ID NO: 84369 - RNA, 19 nt, Artificial Sequence
  Oligomer
cugagaaguucgaccucag

SEQ ID NO: 84370 - RNA, 19 nt, Artificial Sequence
  Oligomer
gugucaguguuagugggag

SEQ ID NO: 84371 - RNA, 19 nt, Artificial Sequence
  Oligomer
uugaguacaagucagggca

SEQ ID NO: 84372 - RNA, 19 nt, Artificial Sequence
  Oligomer
ucuccuacaucuugcucac

SEQ ID NO: 84373 - RNA, 19 nt, Artificial Sequence
  Oligomer
ggcucuccugaggaaaagu

SEQ ID NO: 84374 - RNA, 19 nt, Artificial Sequence
  Oligomer
agaccuuuuucaggcaccu

SEQ ID NO: 84375 - RNA, 19 nt, Artificial Sequence
  Oligomer
aguaugaccuggugcugcu

SEQ ID NO: 84376 - RNA, 19 nt, Artificial Sequence
  Oligomer
cacucugcugcucaagauc

SEQ ID NO: 84377 - RNA, 19 nt, Artificial Sequence
  Oligomer
ucuccaagaaggagauuga

SEQ ID NO: 84378 - RNA, 19 nt, Artificial Sequence
  Oligomer
gaaugggcuguucuccaag

SEQ ID NO: 84379 - RNA, 19 nt, Artificial Sequence
  Oligomer
aggaaugggcuguucucca

SEQ ID NO: 84380 - RNA, 19 nt, Artificial Sequence
  Oligomer
uauccuggcuagagcugcu

SEQ ID NO: 84381 - RNA, 19 nt, Artificial Sequence
  Oligomer
cugaagauguggaugcacu

SEQ ID NO: 84382 - RNA, 19 nt, Artificial Sequence
  Oligomer
agaccuuagcaacaccauc

SEQ ID NO: 84383 - RNA, 19 nt, Artificial Sequence
  Oligomer
uacagaaacccacucggca

SEQ ID NO: 84384 - RNA, 19 nt, Artificial Sequence
  Oligomer
agugucuagggacuagagu

SEQ ID NO: 84385 - RNA, 19 nt, Artificial Sequence
  Oligomer
ucuucaacucccugcagga

SEQ ID NO: 84386 - RNA, 19 nt, Artificial Sequence
  Oligomer
aaguuugaggugucagugu

SEQ ID NO: 84387 - RNA, 19 nt, Artificial Sequence
  Oligomer
cuauguccugcucaucauc

SEQ ID NO: 84388 - RNA, 19 nt, Artificial Sequence
  Oligomer
gugguucuuccagaccgua

SEQ ID NO: 84389 - RNA, 19 nt, Artificial Sequence
  Oligomer
guggugaauguguaccugu

SEQ ID NO: 84390 - RNA, 19 nt, Artificial Sequence
  Oligomer
ucuuacacagugugggcca

SEQ ID NO: 84391 - RNA, 19 nt, Artificial Sequence
  Oligomer
ccuggugcugcuguuuaac

SEQ ID NO: 84392 - RNA, 19 nt, Artificial Sequence
  Oligomer
gucaacuucguccugucca

SEQ ID NO: 84393 - RNA, 19 nt, Artificial Sequence
  Oligomer
aauggcaaggccacaagga

SEQ ID NO: 84394 - RNA, 19 nt, Artificial Sequence
  Oligomer
uguugcuucccuuugguga

SEQ ID NO: 84395 - RNA, 19 nt, Artificial Sequence
  Oligomer
caaaugccuugcaggaggu

SEQ ID NO: 84396 - RNA, 19 nt, Artificial Sequence
  Oligomer
ugaguguaaggaugcagug

SEQ ID NO: 84397 - RNA, 19 nt, Artificial Sequence
  Oligomer
ugaaaccucugcuuccaga

SEQ ID NO: 84398 - RNA, 19 nt, Artificial Sequence
  Oligomer
uggaggagaaugaccacca

SEQ ID NO: 84399 - RNA, 19 nt, Artificial Sequence
  Oligomer
cucuagcauggacacuucu

SEQ ID NO: 84400 - RNA, 19 nt, Artificial Sequence
  Oligomer
uugugcugcuccugauccu

SEQ ID NO: 84401 - RNA, 19 nt, Artificial Sequence
  Oligomer
agagaaguuccaacgcagc

SEQ ID NO: 84402 - RNA, 19 nt, Artificial Sequence
  Oligomer
aagguaacgucauuccagc

SEQ ID NO: 84403 - RNA, 19 nt, Artificial Sequence
  Oligomer
acugaguugacaccucaga

SEQ ID NO: 84404 - RNA, 19 nt, Artificial Sequence
  Oligomer
uuuccaaggaugaguucau

SEQ ID NO: 84405 - RNA, 19 nt, Artificial Sequence
  Oligomer
gacaaggauggcaauggcu

SEQ ID NO: 84406 - RNA, 19 nt, Artificial Sequence
  Oligomer
cuggugcugcuguuuaacu

SEQ ID NO: 84407 - RNA, 19 nt, Artificial Sequence
  Oligomer
uggugaccgcuacugguuu

SEQ ID NO: 84408 - RNA, 19 nt, Artificial Sequence
  Oligomer
uugaacaauuugugcggcu

SEQ ID NO: 84409 - RNA, 19 nt, Artificial Sequence
  Oligomer
acugggcuugucucccauu

SEQ ID NO: 84410 - RNA, 19 nt, Artificial Sequence
  Oligomer
caaagugcugaagaugugg

SEQ ID NO: 84411 - RNA, 19 nt, Artificial Sequence
  Oligomer
agaaaugccagcugccacu

SEQ ID NO: 84412 - RNA, 19 nt, Artificial Sequence
  Oligomer
ugagaaaugccagcugcca

SEQ ID NO: 84413 - RNA, 19 nt, Artificial Sequence
  Oligomer
ccagucuaacaccacaacu

SEQ ID NO: 84414 - RNA, 19 nt, Artificial Sequence
  Oligomer
aaaugccuugcaggaggua

SEQ ID NO: 84415 - RNA, 19 nt, Artificial Sequence
  Oligomer
cagugucuagggacuagag

SEQ ID NO: 84416 - RNA, 19 nt, Artificial Sequence
  Oligomer
cucagccuggagaaauggu

SEQ ID NO: 84417 - RNA, 19 nt, Artificial Sequence
  Oligomer
uuuugccuccauccucaaa

SEQ ID NO: 84418 - RNA, 19 nt, Artificial Sequence
  Oligomer
ugaguacaagucagggcag

SEQ ID NO: 84419 - RNA, 19 nt, Artificial Sequence
  Oligomer
cuuuccuggccucuuccau

SEQ ID NO: 84420 - RNA, 19 nt, Artificial Sequence
  Oligomer
uguucuccuacaucuugcu

SEQ ID NO: 84421 - RNA, 19 nt, Artificial Sequence
  Oligomer
cugaguugacaccucagag

SEQ ID NO: 84422 - RNA, 19 nt, Artificial Sequence
  Oligomer
agcgacauugagacugagu

SEQ ID NO: 84423 - RNA, 19 nt, Artificial Sequence
  Oligomer
augaucugucccucuccca

SEQ ID NO: 84424 - RNA, 19 nt, Artificial Sequence
  Oligomer
cugaagucaucaaggaccu

SEQ ID NO: 84425 - RNA, 19 nt, Artificial Sequence
  Oligomer
gccugaagucaucaaggac

SEQ ID NO: 84426 - RNA, 19 nt, Artificial Sequence
  Oligomer
caaggaggaacugacaugg

SEQ ID NO: 84427 - RNA, 19 nt, Artificial Sequence
  Oligomer
gcugagauccuucaucgag

SEQ ID NO: 84428 - RNA, 19 nt, Artificial Sequence
  Oligomer
guuuaacuuggaggaagag

SEQ ID NO: 84429 - RNA, 19 nt, Artificial Sequence
  Oligomer
gaugagaaauuucaagagg

SEQ ID NO: 84430 - RNA, 19 nt, Artificial Sequence
  Oligomer
ucuguuguucgugacuauu

SEQ ID NO: 84431 - RNA, 19 nt, Artificial Sequence
  Oligomer
augggcuguucuccaagaa

SEQ ID NO: 84432 - RNA, 19 nt, Artificial Sequence
  Oligomer
uguucagcaccaucguccu

SEQ ID NO: 84433 - RNA, 19 nt, Artificial Sequence
  Oligomer
uguacaaccaggacuuauc

SEQ ID NO: 84434 - RNA, 19 nt, Artificial Sequence
  Oligomer
cagcuuccugcagaaaaca

SEQ ID NO: 84435 - RNA, 19 nt, Artificial Sequence
  Oligomer
ggcuaucacgugcuuucag

SEQ ID NO: 84436 - RNA, 19 nt, Artificial Sequence
  Oligomer
aauuucacccaagguuuua

SEQ ID NO: 84437 - RNA, 19 nt, Artificial Sequence
  Oligomer
auggaugcuggcaucuuag

SEQ ID NO: 84438 - RNA, 19 nt, Artificial Sequence
  Oligomer
gugucuagggacuagagug

SEQ ID NO: 84439 - RNA, 19 nt, Artificial Sequence
  Oligomer
cacaccucaccucuguucu

SEQ ID NO: 84440 - RNA, 19 nt, Artificial Sequence
  Oligomer
cacuucucccaccauuaug

SEQ ID NO: 84441 - RNA, 19 nt, Artificial Sequence
  Oligomer
gcugagaaguucgaccuca

SEQ ID NO: 84442 - RNA, 19 nt, Artificial Sequence
  Oligomer
ggucuucaagucauccguc

SEQ ID NO: 84443 - RNA, 19 nt, Artificial Sequence
  Oligomer
caaagaccuggucuucaag

SEQ ID NO: 84444 - RNA, 19 nt, Artificial Sequence
  Oligomer
gaguggcauaaguuugagg

SEQ ID NO: 84445 - RNA, 19 nt, Artificial Sequence
  Oligomer
aguauuacuggugguucuu

SEQ ID NO: 84446 - RNA, 19 nt, Artificial Sequence
  Oligomer
gcuucauugagaacuaccg

SEQ ID NO: 84447 - RNA, 19 nt, Artificial Sequence
  Oligomer
ugacaccucagagacugca

SEQ ID NO: 84448 - RNA, 19 nt, Artificial Sequence
  Oligomer
augcugcgggaccacaaua

SEQ ID NO: 84449 - RNA, 19 nt, Artificial Sequence
  Oligomer
guuccgcauguacgacuuu

SEQ ID NO: 84450 - RNA, 19 nt, Artificial Sequence
  Oligomer
caccuccuggagaccuuuu

SEQ ID NO: 84451 - RNA, 19 nt, Artificial Sequence
  Oligomer
aaugucuuugucuggcaua

SEQ ID NO: 84452 - RNA, 19 nt, Artificial Sequence
  Oligomer
uacaaagugcugaagaugu

SEQ ID NO: 84453 - RNA, 19 nt, Artificial Sequence
  Oligomer
uuucagaccuggugagcgu

SEQ ID NO: 84454 - RNA, 19 nt, Artificial Sequence
  Oligomer
aagguuuuaagcacguucu

SEQ ID NO: 84455 - RNA, 19 nt, Artificial Sequence
  Oligomer
augugugugcaugucugua

SEQ ID NO: 84456 - RNA, 19 nt, Artificial Sequence
  Oligomer
augugucucagccuggaga

SEQ ID NO: 84457 - RNA, 19 nt, Artificial Sequence
  Oligomer
ugucugugcacaucuacau

SEQ ID NO: 84458 - RNA, 19 nt, Artificial Sequence
  Oligomer
cugacaucauccgagaggu

SEQ ID NO: 84459 - RNA, 19 nt, Artificial Sequence
  Oligomer
ccucagggagaucuacuca

SEQ ID NO: 84460 - RNA, 19 nt, Artificial Sequence
  Oligomer
ccugcucaucauccauggu

SEQ ID NO: 84461 - RNA, 19 nt, Artificial Sequence
  Oligomer
ucuuugccucccaccacuu

SEQ ID NO: 84462 - RNA, 19 nt, Artificial Sequence
  Oligomer
cucucuugccucuuuccug

SEQ ID NO: 84463 - RNA, 19 nt, Artificial Sequence
  Oligomer
ccucucuugccucuuuccu

SEQ ID NO: 84464 - RNA, 19 nt, Artificial Sequence
  Oligomer
acauugagacugaguugac

SEQ ID NO: 84465 - RNA, 19 nt, Artificial Sequence
  Oligomer
augaccuggugcugcuguu

SEQ ID NO: 84466 - RNA, 19 nt, Artificial Sequence
  Oligomer
aacuucguccuguccagca

SEQ ID NO: 84467 - RNA, 19 nt, Artificial Sequence
  Oligomer
agauccgugugguagaugg

SEQ ID NO: 84468 - RNA, 19 nt, Artificial Sequence
  Oligomer
acaucaacccugcacucuc

SEQ ID NO: 84469 - RNA, 19 nt, Artificial Sequence
  Oligomer
caccuaccagaacaucgcu

SEQ ID NO: 84470 - RNA, 19 nt, Artificial Sequence
  Oligomer
aaugcuccucagcccucuu

SEQ ID NO: 84471 - RNA, 19 nt, Artificial Sequence
  Oligomer
uucagaaacaaaucucaga

SEQ ID NO: 84472 - RNA, 19 nt, Artificial Sequence
  Oligomer
ugucucagccuggagaaau

SEQ ID NO: 84473 - RNA, 19 nt, Artificial Sequence
  Oligomer
gaugggugguacaacaacc

SEQ ID NO: 84474 - RNA, 19 nt, Artificial Sequence
  Oligomer
ggugucugugcacaucuac

SEQ ID NO: 84475 - RNA, 19 nt, Artificial Sequence
  Oligomer
ucuucaagucauccgucag

SEQ ID NO: 84476 - RNA, 19 nt, Artificial Sequence
  Oligomer
guggcauaaguuugaggug

SEQ ID NO: 84477 - RNA, 19 nt, Artificial Sequence
  Oligomer
gauggaccauuuggagagg

SEQ ID NO: 84478 - RNA, 19 nt, Artificial Sequence
  Oligomer
gaggugccugaagucauca

SEQ ID NO: 84479 - RNA, 19 nt, Artificial Sequence
  Oligomer
cugacaugggaagauuuuc

SEQ ID NO: 84480 - RNA, 19 nt, Artificial Sequence
  Oligomer
ugacaaggauggcaauggc

SEQ ID NO: 84481 - RNA, 19 nt, Artificial Sequence
  Oligomer
ccuggagaccuuuuucagg

SEQ ID NO: 84482 - RNA, 19 nt, Artificial Sequence
  Oligomer
uguucuccaagaaggagau

SEQ ID NO: 84483 - RNA, 19 nt, Artificial Sequence
  Oligomer
aucguccuugaacaauuug

SEQ ID NO: 84484 - RNA, 19 nt, Artificial Sequence
  Oligomer
cacugaaguuuucccgcac

SEQ ID NO: 84485 - RNA, 19 nt, Artificial Sequence
  Oligomer
ugaagaugugcgggauuuc

SEQ ID NO: 84486 - RNA, 19 nt, Artificial Sequence
  Oligomer
aaaacacucccggaguaua

SEQ ID NO: 84487 - RNA, 19 nt, Artificial Sequence
  Oligomer
auggcaagccauuuacaga

SEQ ID NO: 84488 - RNA, 19 nt, Artificial Sequence
  Oligomer
ugcaugucuguaugugugu

SEQ ID NO: 84489 - RNA, 19 nt, Artificial Sequence
  Oligomer
cagacuucagaaacaaauc

SEQ ID NO: 84490 - RNA, 19 nt, Artificial Sequence
  Oligomer
ccaagaauguggaaaaggc

SEQ ID NO: 84491 - RNA, 19 nt, Artificial Sequence
  Oligomer
cuuccagaagguucugaac

SEQ ID NO: 84492 - RNA, 19 nt, Artificial Sequence
  Oligomer
cuagcauggacacuucugg

SEQ ID NO: 84493 - RNA, 19 nt, Artificial Sequence
  Oligomer
ugucaguguuagugggagg

SEQ ID NO: 84494 - RNA, 19 nt, Artificial Sequence
  Oligomer
gaggugucaguguuagugg

SEQ ID NO: 84495 - RNA, 19 nt, Artificial Sequence
  Oligomer
aguggcauaaguuugaggu

SEQ ID NO: 84496 - RNA, 19 nt, Artificial Sequence
  Oligomer
gaagaagguggagaucagc

SEQ ID NO: 84497 - RNA, 19 nt, Artificial Sequence
  Oligomer
cauucuaaucccugagccc

SEQ ID NO: 84498 - RNA, 19 nt, Artificial Sequence
  Oligomer
aucaccuuccugcgagaaa

SEQ ID NO: 84499 - RNA, 19 nt, Artificial Sequence
  Oligomer
cuacaucuugcucaccaug

SEQ ID NO: 84500 - RNA, 19 nt, Artificial Sequence
  Oligomer
cuccuacaucagccaggau

SEQ ID NO: 84501 - RNA, 19 nt, Artificial Sequence
  Oligomer
caucgagaucuccaacaac

SEQ ID NO: 84502 - RNA, 19 nt, Artificial Sequence
  Oligomer
augaguucaucaggaugcu

SEQ ID NO: 84503 - RNA, 19 nt, Artificial Sequence
  Oligomer
cugaggaaaagucucgccu

SEQ ID NO: 84504 - RNA, 19 nt, Artificial Sequence
  Oligomer
cucuccugaggaaaagucu

SEQ ID NO: 84505 - RNA, 19 nt, Artificial Sequence
  Oligomer
ugggugaaauuaguugugg

SEQ ID NO: 84506 - RNA, 19 nt, Artificial Sequence
  Oligomer
uaagaugccagcauccaug

SEQ ID NO: 84507 - RNA, 19 nt, Artificial Sequence
  Oligomer
uucagugcugagcugucuc

SEQ ID NO: 84508 - RNA, 19 nt, Artificial Sequence
  Oligomer
uuaguugugguguuagacu

SEQ ID NO: 84509 - RNA, 19 nt, Artificial Sequence
  Oligomer
acuugaguuccgauugaug

SEQ ID NO: 84510 - RNA, 19 nt, Artificial Sequence
  Oligomer
ucccacugcauccuuacac

SEQ ID NO: 84511 - RNA, 19 nt, Artificial Sequence
  Oligomer
ugcauccuuacacucaccg

SEQ ID NO: 84512 - RNA, 19 nt, Artificial Sequence
  Oligomer
uucaccacgcugaucucca

SEQ ID NO: 84513 - RNA, 19 nt, Artificial Sequence
  Oligomer
ugucaacucagucucaaug

SEQ ID NO: 84514 - RNA, 19 nt, Artificial Sequence
  Oligomer
uaagacugugaggacgaug

SEQ ID NO: 84515 - RNA, 19 nt, Artificial Sequence
  Oligomer
cuugaguuccgauugauga

SEQ ID NO: 84516 - RNA, 19 nt, Artificial Sequence
  Oligomer
uuuggguaucuggcacauc

SEQ ID NO: 84517 - RNA, 19 nt, Artificial Sequence
  Oligomer
uccacugcccucaaaauag

SEQ ID NO: 84518 - RNA, 19 nt, Artificial Sequence
  Oligomer
ugaggcagccagaaauagg

SEQ ID NO: 84519 - RNA, 19 nt, Artificial Sequence
  Oligomer
uucggauuucuucaaucuc

SEQ ID NO: 84520 - RNA, 19 nt, Artificial Sequence
  Oligomer
gcacaaauuguucaaggac

SEQ ID NO: 84521 - RNA, 19 nt, Artificial Sequence
  Oligomer
uugcauacauagguauugg

SEQ ID NO: 84522 - RNA, 19 nt, Artificial Sequence
  Oligomer
ugugaugcccgugugaugu

SEQ ID NO: 84523 - RNA, 19 nt, Artificial Sequence
  Oligomer
auuaguugugguguuagac

SEQ ID NO: 84524 - RNA, 19 nt, Artificial Sequence
  Oligomer
uugggaggugggaaaucag

SEQ ID NO: 84525 - RNA, 19 nt, Artificial Sequence
  Oligomer
uccacauucuuggucaugc

SEQ ID NO: 84526 - RNA, 19 nt, Artificial Sequence
  Oligomer
uguaaauggcuugccaugg

SEQ ID NO: 84527 - RNA, 19 nt, Artificial Sequence
  Oligomer
uggaaugacguuaccuucu

SEQ ID NO: 84528 - RNA, 19 nt, Artificial Sequence
  Oligomer
ugacguuaccuucuugcca

SEQ ID NO: 84529 - RNA, 19 nt, Artificial Sequence
  Oligomer
uaccuucuugccaaaccuc

SEQ ID NO: 84530 - RNA, 19 nt, Artificial Sequence
  Oligomer
uuugacacagagcugcgug

SEQ ID NO: 84531 - RNA, 19 nt, Artificial Sequence
  Oligomer
uuccacauucuuggucaug

SEQ ID NO: 84532 - RNA, 19 nt, Artificial Sequence
  Oligomer
ugaacuguugcaccgucug

SEQ ID NO: 84533 - RNA, 19 nt, Artificial Sequence
  Oligomer
uccuucuuggagaacagcc

SEQ ID NO: 84534 - RNA, 19 nt, Artificial Sequence
  Oligomer
uugucuucugagauuuguu

SEQ ID NO: 84535 - RNA, 19 nt, Artificial Sequence
  Oligomer
uuucuccaggcugagacac

SEQ ID NO: 84536 - RNA, 19 nt, Artificial Sequence
  Oligomer
uuguaccacccaucaaauc

SEQ ID NO: 84537 - RNA, 19 nt, Artificial Sequence
  Oligomer
uagacuccgguucagaacc

SEQ ID NO: 84538 - RNA, 19 nt, Artificial Sequence
  Oligomer
uaacacugacaccucaaac

SEQ ID NO: 84539 - RNA, 19 nt, Artificial Sequence
  Oligomer
auauccuggcugauguagg

SEQ ID NO: 84540 - RNA, 19 nt, Artificial Sequence
  Oligomer
auuccugguguucucaaac

SEQ ID NO: 84541 - RNA, 19 nt, Artificial Sequence
  Oligomer
uaugggaguagggaggguu

SEQ ID NO: 84542 - RNA, 19 nt, Artificial Sequence
  Oligomer
uucuaagaugccagcaucc

SEQ ID NO: 84543 - RNA, 19 nt, Artificial Sequence
  Oligomer
ucugugcuccaugagguug

SEQ ID NO: 84544 - RNA, 19 nt, Artificial Sequence
  Oligomer
uguuguaccacccaucaaa

SEQ ID NO: 84545 - RNA, 19 nt, Artificial Sequence
  Oligomer
aucuucuuacagaacacuu

SEQ ID NO: 84546 - RNA, 19 nt, Artificial Sequence
  Oligomer
uggguaucuggcacaucug

SEQ ID NO: 84547 - RNA, 19 nt, Artificial Sequence
  Oligomer
uggaucagggcaaagcuac

SEQ ID NO: 84548 - RNA, 19 nt, Artificial Sequence
  Oligomer
cuugccauuccaaagcuuc

SEQ ID NO: 84549 - RNA, 19 nt, Artificial Sequence
  Oligomer
uugaggauggaggcaaaag

SEQ ID NO: 84550 - RNA, 19 nt, Artificial Sequence
  Oligomer
uuguacucaaagcccuggg

SEQ ID NO: 84551 - RNA, 19 nt, Artificial Sequence
  Oligomer
uggaaaugaggccauuccc

SEQ ID NO: 84552 - RNA, 19 nt, Artificial Sequence
  Oligomer
agaaauggccgguauccug

SEQ ID NO: 84553 - RNA, 19 nt, Artificial Sequence
  Oligomer
ucauacacagcgauguucu

SEQ ID NO: 84554 - RNA, 19 nt, Artificial Sequence
  Oligomer
auagacuccgguucagaac

SEQ ID NO: 84555 - RNA, 19 nt, Artificial Sequence
  Oligomer
ucaggagagccuuucauga

SEQ ID NO: 84556 - RNA, 19 nt, Artificial Sequence
  Oligomer
uccuuuaugccagacaaag

SEQ ID NO: 84557 - RNA, 19 nt, Artificial Sequence
  Oligomer
ucugugcgggaaaacuuca

SEQ ID NO: 84558 - RNA, 19 nt, Artificial Sequence
  Oligomer
uugugguagcggaaccaga

SEQ ID NO: 84559 - RNA, 19 nt, Artificial Sequence
  Oligomer
uaguugugguguuagacug

SEQ ID NO: 84560 - RNA, 19 nt, Artificial Sequence
  Oligomer
uggguuucuguaaauggcu

SEQ ID NO: 84561 - RNA, 19 nt, Artificial Sequence
  Oligomer
uccgguucagaaccuucug

SEQ ID NO: 84562 - RNA, 19 nt, Artificial Sequence
  Oligomer
ucccguagccgcacaaauu

SEQ ID NO: 84563 - RNA, 19 nt, Artificial Sequence
  Oligomer
gacacuugaguuccgauug

SEQ ID NO: 84564 - RNA, 19 nt, Artificial Sequence
  Oligomer
aaaaccuugggugaaauua

SEQ ID NO: 84565 - RNA, 19 nt, Artificial Sequence
  Oligomer
gugaaauuaguuguggugu

SEQ ID NO: 84566 - RNA, 19 nt, Artificial Sequence
  Oligomer
acuccgguucagaaccuuc

SEQ ID NO: 84567 - RNA, 19 nt, Artificial Sequence
  Oligomer
ucagggcaaagcuaccaug

SEQ ID NO: 84568 - RNA, 19 nt, Artificial Sequence
  Oligomer
uaguaguaggcccucucca

SEQ ID NO: 84569 - RNA, 19 nt, Artificial Sequence
  Oligomer
ucaccaggucugaaagcac

SEQ ID NO: 84570 - RNA, 19 nt, Artificial Sequence
  Oligomer
auuuggaagggagacuacu

SEQ ID NO: 84571 - RNA, 19 nt, Artificial Sequence
  Oligomer
ugagaugguguugcuaagg

SEQ ID NO: 84572 - RNA, 19 nt, Artificial Sequence
  Oligomer
uaguacuugucaggucagc

SEQ ID NO: 84573 - RNA, 19 nt, Artificial Sequence
  Oligomer
uucugaagucuggaagcag

SEQ ID NO: 84574 - RNA, 19 nt, Artificial Sequence
  Oligomer
uagaugauugcugggacca

SEQ ID NO: 84575 - RNA, 19 nt, Artificial Sequence
  Oligomer
cuggaaugacguuaccuuc

SEQ ID NO: 84576 - RNA, 19 nt, Artificial Sequence
  Oligomer
auccugaugaacucauccu

SEQ ID NO: 84577 - RNA, 19 nt, Artificial Sequence
  Oligomer
uccugaugaacucauccuu

SEQ ID NO: 84578 - RNA, 19 nt, Artificial Sequence
  Oligomer
ucagccagagagaacaugg

SEQ ID NO: 84579 - RNA, 19 nt, Artificial Sequence
  Oligomer
uccugcagggugguauuuc

SEQ ID NO: 84580 - RNA, 19 nt, Artificial Sequence
  Oligomer
uucugguagguggcgauga

SEQ ID NO: 84581 - RNA, 19 nt, Artificial Sequence
  Oligomer
aggagcauugcauacauag

SEQ ID NO: 84582 - RNA, 19 nt, Artificial Sequence
  Oligomer
ugaaauuaguugugguguu

SEQ ID NO: 84583 - RNA, 19 nt, Artificial Sequence
  Oligomer
uugaagaagggcucaaagg

SEQ ID NO: 84584 - RNA, 19 nt, Artificial Sequence
  Oligomer
ugccgcucacagauguaca

SEQ ID NO: 84585 - RNA, 19 nt, Artificial Sequence
  Oligomer
uguagaugugcacagacac

SEQ ID NO: 84586 - RNA, 19 nt, Artificial Sequence
  Oligomer
augucaguuccuccuuguc

SEQ ID NO: 84587 - RNA, 19 nt, Artificial Sequence
  Oligomer
uuuuccucaggagagccuu

SEQ ID NO: 84588 - RNA, 19 nt, Artificial Sequence
  Oligomer
ccgcacaaauuguucaagg

SEQ ID NO: 84589 - RNA, 19 nt, Artificial Sequence
  Oligomer
acgauggugcugaacagag

SEQ ID NO: 84590 - RNA, 19 nt, Artificial Sequence
  Oligomer
uggucugugcgggaaaacu

SEQ ID NO: 84591 - RNA, 19 nt, Artificial Sequence
  Oligomer
auccacaucuucagcacuu

SEQ ID NO: 84592 - RNA, 19 nt, Artificial Sequence
  Oligomer
uucagcacuuuguaggcuu

SEQ ID NO: 84593 - RNA, 19 nt, Artificial Sequence
  Oligomer
acugcauccuuacacucac

SEQ ID NO: 84594 - RNA, 19 nt, Artificial Sequence
  Oligomer
ugcacacacauaguacuug

SEQ ID NO: 84595 - RNA, 19 nt, Artificial Sequence
  Oligomer
ucccacuaacacugacacc

SEQ ID NO: 84596 - RNA, 19 nt, Artificial Sequence
  Oligomer
augauggccaggaucagga

SEQ ID NO: 84597 - RNA, 19 nt, Artificial Sequence
  Oligomer
uguaagacugugaggacga

SEQ ID NO: 84598 - RNA, 19 nt, Artificial Sequence
  Oligomer
ucagugaacagcaagggcu

SEQ ID NO: 84599 - RNA, 19 nt, Artificial Sequence
  Oligomer
acauaaggcgagacuuuuc

SEQ ID NO: 84600 - RNA, 19 nt, Artificial Sequence
  Oligomer
guagccauugccauccuug

SEQ ID NO: 84601 - RNA, 19 nt, Artificial Sequence
  Oligomer
aaaaggugccugaaaaagg

SEQ ID NO: 84602 - RNA, 19 nt, Artificial Sequence
  Oligomer
ucuaccuccugcaaggcau

SEQ ID NO: 84603 - RNA, 19 nt, Artificial Sequence
  Oligomer
uauggccaccuggaacaag

SEQ ID NO: 84604 - RNA, 19 nt, Artificial Sequence
  Oligomer
uccaccucucggaugaugu

SEQ ID NO: 84605 - RNA, 19 nt, Artificial Sequence
  Oligomer
ucucggaugaugucagcca

SEQ ID NO: 84606 - RNA, 19 nt, Artificial Sequence
  Oligomer
acagcuuuggguaucuggc

SEQ ID NO: 84607 - RNA, 19 nt, Artificial Sequence
  Oligomer
agacccaucaucauggaag

SEQ ID NO: 84608 - RNA, 19 nt, Artificial Sequence
  Oligomer
ucaaugaagcgcuugaacu

SEQ ID NO: 84609 - RNA, 19 nt, Artificial Sequence
  Oligomer
uagccauugccauccuugu

SEQ ID NO: 84610 - RNA, 19 nt, Artificial Sequence
  Oligomer
auccacugcccucaaaaua

SEQ ID NO: 84611 - RNA, 19 nt, Artificial Sequence
  Oligomer
accuugggugaaauuaguu

SEQ ID NO: 84612 - RNA, 19 nt, Artificial Sequence
  Oligomer
acacauaguacuugucagg

SEQ ID NO: 84613 - RNA, 19 nt, Artificial Sequence
  Oligomer
aguacuugucaggucagcu

SEQ ID NO: 84614 - RNA, 19 nt, Artificial Sequence
  Oligomer
agaaguucucauaauggug

SEQ ID NO: 84615 - RNA, 19 nt, Artificial Sequence
  Oligomer
auucuuggucaugccaggg

SEQ ID NO: 84616 - RNA, 19 nt, Artificial Sequence
  Oligomer
uaucuggcacaucugucac

SEQ ID NO: 84617 - RNA, 19 nt, Artificial Sequence
  Oligomer
uacaugauggccaggauca

SEQ ID NO: 84618 - RNA, 19 nt, Artificial Sequence
  Oligomer
agaaccaccaguaauacuu

SEQ ID NO: 84619 - RNA, 19 nt, Artificial Sequence
  Oligomer
ucugugaugcccgugugau

SEQ ID NO: 84620 - RNA, 19 nt, Artificial Sequence
  Oligomer
ugaggugucaacucagucu

SEQ ID NO: 84621 - RNA, 19 nt, Artificial Sequence
  Oligomer
aaaucuucccaugucaguu

SEQ ID NO: 84622 - RNA, 19 nt, Artificial Sequence
  Oligomer
augcgaauguugaggaacu

SEQ ID NO: 84623 - RNA, 19 nt, Artificial Sequence
  Oligomer
uacuggagcagggagaaga

SEQ ID NO: 84624 - RNA, 19 nt, Artificial Sequence
  Oligomer
ucuaagaugccagcaucca

SEQ ID NO: 84625 - RNA, 19 nt, Artificial Sequence
  Oligomer
cagacaugcacacacauag

SEQ ID NO: 84626 - RNA, 19 nt, Artificial Sequence
  Oligomer
uuguuguaccacccaucaa

SEQ ID NO: 84627 - RNA, 19 nt, Artificial Sequence
  Oligomer
uucagaaccuucuggaagu

SEQ ID NO: 84628 - RNA, 19 nt, Artificial Sequence
  Oligomer
ugaugagcaggacauagag

SEQ ID NO: 84629 - RNA, 19 nt, Artificial Sequence
  Oligomer
ugaggaagguuucucgcag

SEQ ID NO: 84630 - RNA, 19 nt, Artificial Sequence
  Oligomer
guuggaacuucucucggug

SEQ ID NO: 84631 - RNA, 19 nt, Artificial Sequence
  Oligomer
uucaugaagaccaccagga

SEQ ID NO: 84632 - RNA, 19 nt, Artificial Sequence
  Oligomer
augaagaccaccaggaugu

SEQ ID NO: 84633 - RNA, 19 nt, Artificial Sequence
  Oligomer
uugauaacagcgaccagca

SEQ ID NO: 84634 - RNA, 19 nt, Artificial Sequence
  Oligomer
agaaaucccgcacaucuuc

SEQ ID NO: 84635 - RNA, 19 nt, Artificial Sequence
  Oligomer
aaauuaguugugguguuag

SEQ ID NO: 84636 - RNA, 19 nt, Artificial Sequence
  Oligomer
uugucaggucagcuugucu

SEQ ID NO: 84637 - RNA, 19 nt, Artificial Sequence
  Oligomer
uccugguggucauucuccu

SEQ ID NO: 84638 - RNA, 19 nt, Artificial Sequence
  Oligomer
ucagccagccacucaaacu

SEQ ID NO: 84639 - RNA, 19 nt, Artificial Sequence
  Oligomer
augauugcugggaccagga

SEQ ID NO: 84640 - RNA, 19 nt, Artificial Sequence
  Oligomer
aacagguacacauucacca

SEQ ID NO: 84641 - RNA, 19 nt, Artificial Sequence
  Oligomer
gucaguuccuccuuguccu

SEQ ID NO: 84642 - RNA, 19 nt, Artificial Sequence
  Oligomer
ucgaugaaggaucucagca

SEQ ID NO: 84643 - RNA, 19 nt, Artificial Sequence
  Oligomer
uggccuugccauuccaaag

SEQ ID NO: 84644 - RNA, 19 nt, Artificial Sequence
  Oligomer
cuucucagacacgaugcuc

SEQ ID NO: 84645 - RNA, 19 nt, Artificial Sequence
  Oligomer
ucucagacacgaugcucug

SEQ ID NO: 84646 - RNA, 19 nt, Artificial Sequence
  Oligomer
uucaaucuccuucuuggag

SEQ ID NO: 84647 - RNA, 19 nt, Artificial Sequence
  Oligomer
ccagaaaucccgcacaucu

SEQ ID NO: 84648 - RNA, 19 nt, Artificial Sequence
  Oligomer
uauugggccagggucugau

SEQ ID NO: 84649 - RNA, 19 nt, Artificial Sequence
  Oligomer
aacacacauacagacaugc

SEQ ID NO: 84650 - RNA, 19 nt, Artificial Sequence
  Oligomer
ucgaacuucucagccagcu

SEQ ID NO: 84651 - RNA, 19 nt, Artificial Sequence
  Oligomer
uggucauucuccuccaccu

SEQ ID NO: 84652 - RNA, 19 nt, Artificial Sequence
  Oligomer
auggcccacacuguguaag

SEQ ID NO: 84653 - RNA, 19 nt, Artificial Sequence
  Oligomer
augacuucaggcaccucca

SEQ ID NO: 84654 - RNA, 19 nt, Artificial Sequence
  Oligomer
cuuggaaaugaggccauuc

SEQ ID NO: 84655 - RNA, 19 nt, Artificial Sequence
  Oligomer
guacaugcggaacauaagg

SEQ ID NO: 84656 - RNA, 19 nt, Artificial Sequence
  Oligomer
cucaggagagccuuucaug

SEQ ID NO: 84657 - RNA, 19 nt, Artificial Sequence
  Oligomer
ucuccuuuaugccagacaa

SEQ ID NO: 84658 - RNA, 19 nt, Artificial Sequence
  Oligomer
gucugugcgggaaaacuuc

SEQ ID NO: 84659 - RNA, 19 nt, Artificial Sequence
  Oligomer
auggccgguauccuguaua

SEQ ID NO: 84660 - RNA, 19 nt, Artificial Sequence
  Oligomer
uccgggaguguuuucugca

SEQ ID NO: 84661 - RNA, 19 nt, Artificial Sequence
  Oligomer
acacauacagacaugcaca

SEQ ID NO: 84662 - RNA, 19 nt, Artificial Sequence
  Oligomer
acaugcacacacauaguac

SEQ ID NO: 84663 - RNA, 19 nt, Artificial Sequence
  Oligomer
ucucacucuagucccuaga

SEQ ID NO: 84664 - RNA, 19 nt, Artificial Sequence
  Oligomer
augaugucagccagccacu

SEQ ID NO: 84665 - RNA, 19 nt, Artificial Sequence
  Oligomer
acuuguacucaaagcccug

SEQ ID NO: 84666 - RNA, 19 nt, Artificial Sequence
  Oligomer
ucuggaagaaccaccagua

SEQ ID NO: 84667 - RNA, 19 nt, Artificial Sequence
  Oligomer
auccuugucagccagagag

SEQ ID NO: 84668 - RNA, 19 nt, Artificial Sequence
  Oligomer
caguacagugucauugcuc

SEQ ID NO: 84669 - RNA, 19 nt, Artificial Sequence
  Oligomer
aaucccgcacaucuucaac

SEQ ID NO: 84670 - RNA, 19 nt, Artificial Sequence
  Oligomer
aggaaugcgaggaaccaua

SEQ ID NO: 84671 - RNA, 19 nt, Artificial Sequence
  Oligomer
ugaaagaacgugcuuaaaa

SEQ ID NO: 84672 - RNA, 19 nt, Artificial Sequence
  Oligomer
uucuccaggcugagacaca

SEQ ID NO: 84673 - RNA, 19 nt, Artificial Sequence
  Oligomer
acauucuuggucaugccag

SEQ ID NO: 84674 - RNA, 19 nt, Artificial Sequence
  Oligomer
uccaucaagguacagcuuu

SEQ ID NO: 84675 - RNA, 19 nt, Artificial Sequence
  Oligomer
cucagcauccugaugaacu

SEQ ID NO: 84676 - RNA, 19 nt, Artificial Sequence
  Oligomer
gucacagcugcucucauca

SEQ ID NO: 84677 - RNA, 19 nt, Artificial Sequence
  Oligomer
ucacagcugcucucaucag

SEQ ID NO: 84678 - RNA, 19 nt, Artificial Sequence
  Oligomer
aucccguagccgcacaaau

SEQ ID NO: 84679 - RNA, 19 nt, Artificial Sequence
  Oligomer
aagaggaggagguauggga

SEQ ID NO: 84680 - RNA, 19 nt, Artificial Sequence
  Oligomer
ugagauuuguuucugaagu

SEQ ID NO: 84681 - RNA, 19 nt, Artificial Sequence
  Oligomer
ucacucuagucccuagaca

SEQ ID NO: 84682 - RNA, 19 nt, Artificial Sequence
  Oligomer
acuauggccaccuggaaca

SEQ ID NO: 84683 - RNA, 19 nt, Artificial Sequence
  Oligomer
ugguacggucuggaagaac

SEQ ID NO: 84684 - RNA, 19 nt, Artificial Sequence
  Oligomer
aaaugaggccauucccauc

SEQ ID NO: 84685 - RNA, 19 nt, Artificial Sequence
  Oligomer
ucguacaugcggaacauaa

SEQ ID NO: 84686 - RNA, 19 nt, Artificial Sequence
  Oligomer
aggauguccaggaacucuc

SEQ ID NO: 84687 - RNA, 19 nt, Artificial Sequence
  Oligomer
ugaaauuucucauccggag

SEQ ID NO: 84688 - RNA, 19 nt, Artificial Sequence
  Oligomer
aagccaaauccacugcccu

SEQ ID NO: 84689 - RNA, 19 nt, Artificial Sequence
  Oligomer
uggaagggagacuacugga

SEQ ID NO: 84690 - RNA, 19 nt, Artificial Sequence
  Oligomer
auagguauugggccagggu

SEQ ID NO: 84691 - RNA, 19 nt, Artificial Sequence
  Oligomer
uuaaaaccuugggugaaau

SEQ ID NO: 84692 - RNA, 19 nt, Artificial Sequence
  Oligomer
ggugaaauuaguuguggug

SEQ ID NO: 84693 - RNA, 19 nt, Artificial Sequence
  Oligomer
aaauggcuugccauggguc

SEQ ID NO: 84694 - RNA, 19 nt, Artificial Sequence
  Oligomer
uccugcaaggcauuugcca

SEQ ID NO: 84695 - RNA, 19 nt, Artificial Sequence
  Oligomer
cugacaggccuuuuccaca

SEQ ID NO: 84696 - RNA, 19 nt, Artificial Sequence
  Oligomer
acaggccuuuuccacauuc

SEQ ID NO: 84697 - RNA, 19 nt, Artificial Sequence
  Oligomer
acagauguacagcauagug

SEQ ID NO: 84698 - RNA, 19 nt, Artificial Sequence
  Oligomer
uccugaggucgaacuucuc

SEQ ID NO: 84699 - RNA, 19 nt, Artificial Sequence
  Oligomer
augucagccagccacucaa

SEQ ID NO: 84700 - RNA, 19 nt, Artificial Sequence
  Oligomer
cuugaacuguugcaccguc

SEQ ID NO: 84701 - RNA, 19 nt, Artificial Sequence
  Oligomer
aacagcaagggcuggaaug

SEQ ID NO: 84702 - RNA, 19 nt, Artificial Sequence
  Oligomer
cucagucucaaugucgcug

SEQ ID NO: 84703 - RNA, 19 nt, Artificial Sequence
  Oligomer
uccuccuuguccuggaauc

SEQ ID NO: 84704 - RNA, 19 nt, Artificial Sequence
  Oligomer
aacauggacuccaccaccu

SEQ ID NO: 84705 - RNA, 19 nt, Artificial Sequence
  Oligomer
aacauaaggcgagacuuuu

SEQ ID NO: 84706 - RNA, 19 nt, Artificial Sequence
  Oligomer
caaguuaaacagcagcacc

SEQ ID NO: 84707 - RNA, 19 nt, Artificial Sequence
  Oligomer
cagugcauccacaucuuca

SEQ ID NO: 84708 - RNA, 19 nt, Artificial Sequence
  Oligomer
uccaguagcuguugcagac

SEQ ID NO: 84709 - RNA, 19 nt, Artificial Sequence
  Oligomer
ugaaagcacgugauagcca

SEQ ID NO: 84710 - RNA, 19 nt, Artificial Sequence
  Oligomer
acacugugcgguuucucag

SEQ ID NO: 84711 - RNA, 19 nt, Artificial Sequence
  Oligomer
aagaugccagcauccaugc

SEQ ID NO: 84712 - RNA, 19 nt, Artificial Sequence
  Oligomer
auaguacuugucaggucag

SEQ ID NO: 84713 - RNA, 19 nt, Artificial Sequence
  Oligomer
ucugaagucuggaagcaga

SEQ ID NO: 84714 - RNA, 19 nt, Artificial Sequence
  Oligomer
ugaagucuggaagcagagg

SEQ ID NO: 84715 - RNA, 19 nt, Artificial Sequence
  Oligomer
ugggaggugggaaaucaga

SEQ ID NO: 84716 - RNA, 19 nt, Artificial Sequence
  Oligomer
guuguuguaccacccauca

SEQ ID NO: 84717 - RNA, 19 nt, Artificial Sequence
  Oligomer
augagcugacaggccuuuu

SEQ ID NO: 84718 - RNA, 19 nt, Artificial Sequence
  Oligomer
ugggaggcaaagacauaca

SEQ ID NO: 84719 - RNA, 19 nt, Artificial Sequence
  Oligomer
agugaaaaucuucccaugu

SEQ ID NO: 84720 - RNA, 19 nt, Artificial Sequence
  Oligomer
ccugaugaacucauccuug

SEQ ID NO: 84721 - RNA, 19 nt, Artificial Sequence
  Oligomer
uuuccucaggagagccuuu

SEQ ID NO: 84722 - RNA, 19 nt, Artificial Sequence
  Oligomer
ucuagccaggauaaguccu

SEQ ID NO: 84723 - RNA, 19 nt, Artificial Sequence
  Oligomer
ucuucagcacuuuguaggc

SEQ ID NO: 84724 - RNA, 19 nt, Artificial Sequence
  Oligomer
ucaggucagcuugucuucu

SEQ ID NO: 84725 - RNA, 19 nt, Artificial Sequence
  Oligomer
agcauagugguccugaggu

SEQ ID NO: 84726 - RNA, 19 nt, Artificial Sequence
  Oligomer
ccaaccagaaguguccaug

SEQ ID NO: 84727 - RNA, 19 nt, Artificial Sequence
  Oligomer
auugcugggaccaggaaga

SEQ ID NO: 84728 - RNA, 19 nt, Artificial Sequence
  Oligomer
uggagaacagguacacauu

SEQ ID NO: 84729 - RNA, 19 nt, Artificial Sequence
  Oligomer
uguguaagacugugaggac

SEQ ID NO: 84730 - RNA, 19 nt, Artificial Sequence
  Oligomer
agcugcguuggaacuucuc

SEQ ID NO: 84731 - RNA, 19 nt, Artificial Sequence
  Oligomer
ucucugaggugucaacuca

SEQ ID NO: 84732 - RNA, 19 nt, Artificial Sequence
  Oligomer
aaaaucuucccaugucagu

SEQ ID NO: 84733 - RNA, 19 nt, Artificial Sequence
  Oligomer
ucuucccaugucaguuccu

SEQ ID NO: 84734 - RNA, 19 nt, Artificial Sequence
  Oligomer
ugguugauguccagcaccu

SEQ ID NO: 84735 - RNA, 19 nt, Artificial Sequence
  Oligomer
aaauccacugcccucaaaa

SEQ ID NO: 84736 - RNA, 19 nt, Artificial Sequence
  Oligomer
ucuuggagaacagcccauu

SEQ ID NO: 84737 - RNA, 19 nt, Artificial Sequence
  Oligomer
guugugguguuagacuggg

SEQ ID NO: 84738 - RNA, 19 nt, Artificial Sequence
  Oligomer
aagcagagguuucacuuug

SEQ ID NO: 84739 - RNA, 19 nt, Artificial Sequence
  Oligomer
cuucucacucuagucccua

SEQ ID NO: 84740 - RNA, 19 nt, Artificial Sequence
  Oligomer
aagaacagaggugaggugu

SEQ ID NO: 84741 - RNA, 19 nt, Artificial Sequence
  Oligomer
cucaaaccucugcucaacu

SEQ ID NO: 84742 - RNA, 19 nt, Artificial Sequence
  Oligomer
accacccaucaaaucgcug

SEQ ID NO: 84743 - RNA, 19 nt, Artificial Sequence
  Oligomer
caucaaaucgcugcaccuc

SEQ ID NO: 84744 - RNA, 19 nt, Artificial Sequence
  Oligomer
cuuacagaacacuuggcag

SEQ ID NO: 84745 - RNA, 19 nt, Artificial Sequence
  Oligomer
cccacuaacacugacaccu

SEQ ID NO: 84746 - RNA, 19 nt, Artificial Sequence
  Oligomer
acugacaccucaaacuuau

SEQ ID NO: 84747 - RNA, 19 nt, Artificial Sequence
  Oligomer
cuccaaaugguccaucaag

SEQ ID NO: 84748 - RNA, 19 nt, Artificial Sequence
  Oligomer
uggugggaggcaaagacau

SEQ ID NO: 84749 - RNA, 19 nt, Artificial Sequence
  Oligomer
aagguuucucgcaggaagg

SEQ ID NO: 84750 - RNA, 19 nt, Artificial Sequence
  Oligomer
ucagcauccugaugaacuc

SEQ ID NO: 84751 - RNA, 19 nt, Artificial Sequence
  Oligomer
uccucaggagagccuuuca

SEQ ID NO: 84752 - RNA, 19 nt, Artificial Sequence
  Oligomer
acagguagccauugccauc

SEQ ID NO: 84753 - RNA, 19 nt, Artificial Sequence
  Oligomer
cucaaaauagucacgaaca

SEQ ID NO: 84754 - RNA, 19 nt, Artificial Sequence
  Oligomer
uccagaaauggccgguauc

SEQ ID NO: 84755 - RNA, 19 nt, Artificial Sequence
  Oligomer
ugcgaauguugaggaacuc

SEQ ID NO: 84756 - RNA, 19 nt, Artificial Sequence
  Oligomer
cauacagacaugcacacac

SEQ ID NO: 84757 - RNA, 19 nt, Artificial Sequence
  Oligomer
augcacacacauaguacuu

SEQ ID NO: 84758 - RNA, 19 nt, Artificial Sequence
  Oligomer
auggaugaugagcaggaca

SEQ ID NO: 84759 - RNA, 19 nt, Artificial Sequence
  Oligomer
augagcaggacauagagca

SEQ ID NO: 84760 - RNA, 19 nt, Artificial Sequence
  Oligomer
acuguguaagacugugagg

SEQ ID NO: 84761 - RNA, 19 nt, Artificial Sequence
  Oligomer
agcgguugaggaagguuuc

SEQ ID NO: 84762 - RNA, 19 nt, Artificial Sequence
  Oligomer
acagcugcucucaucagcu

SEQ ID NO: 84763 - RNA, 19 nt, Artificial Sequence
  Oligomer
ugcagggugguauuucgga

SEQ ID NO: 84764 - RNA, 19 nt, Artificial Sequence
  Oligomer
cacaucuucaaccaacaca

SEQ ID NO: 84765 - RNA, 19 nt, Artificial Sequence
  Oligomer
ucagcacuuuguaggcuug

SEQ ID NO: 84766 - RNA, 19 nt, Artificial Sequence
  Oligomer
gaaauggccgguauccugu

SEQ ID NO: 84767 - RNA, 19 nt, Artificial Sequence
  Oligomer
gucugaaagcacgugauag

SEQ ID NO: 84768 - RNA, 19 nt, Artificial Sequence
  Oligomer
cagagguuucacuuugccc

SEQ ID NO: 84769 - RNA, 19 nt, Artificial Sequence
  Oligomer
ucuagucccuagacacugc

SEQ ID NO: 84770 - RNA, 19 nt, Artificial Sequence
  Oligomer
uaggaagaacagaggugag

SEQ ID NO: 84771 - RNA, 19 nt, Artificial Sequence
  Oligomer
aauagacuccgguucagaa

SEQ ID NO: 84772 - RNA, 19 nt, Artificial Sequence
  Oligomer
caaacuuaugccacuccug

SEQ ID NO: 84773 - RNA, 19 nt, Artificial Sequence
  Oligomer
aagcccaugaugaaaauaa

SEQ ID NO: 84774 - RNA, 19 nt, Artificial Sequence
  Oligomer
uggaugaugagcaggacau

SEQ ID NO: 84775 - RNA, 19 nt, Artificial Sequence
  Oligomer
uucucgcaggaaggugaug

SEQ ID NO: 84776 - RNA, 19 nt, Artificial Sequence
  Oligomer
agucucugaggugucaacu

SEQ ID NO: 84777 - RNA, 19 nt, Artificial Sequence
  Oligomer
cugaggugucaacucaguc

SEQ ID NO: 84778 - RNA, 19 nt, Artificial Sequence
  Oligomer
cauccugaugaacucaucc

SEQ ID NO: 84779 - RNA, 19 nt, Artificial Sequence
  Oligomer
agagccuuucaugaagacc

SEQ ID NO: 84780 - RNA, 19 nt, Artificial Sequence
  Oligomer
ugccugaaaaaggucucca

SEQ ID NO: 84781 - RNA, 19 nt, Artificial Sequence
  Oligomer
gguauuucggauuucuuca

SEQ ID NO: 84782 - RNA, 19 nt, Artificial Sequence
  Oligomer
accaggucugaaagcacgu

SEQ ID NO: 84783 - RNA, 19 nt, Artificial Sequence
  Oligomer
ugagacacauccugguccu

SEQ ID NO: 84784 - RNA, 19 nt, Artificial Sequence
  Oligomer
aggaagaacagaggugagg

SEQ ID NO: 84785 - RNA, 19 nt, Artificial Sequence
  Oligomer
ugaugagcugacaggccuu

SEQ ID NO: 84786 - RNA, 19 nt, Artificial Sequence
  Oligomer
caggccugugaauagacuc

SEQ ID NO: 84787 - RNA, 19 nt, Artificial Sequence
  Oligomer
acgcugaucuccaccuucu

SEQ ID NO: 84788 - RNA, 19 nt, Artificial Sequence
  Oligomer
ucaguuccuccuuguccug

SEQ ID NO: 84789 - RNA, 19 nt, Artificial Sequence
  Oligomer
uuccuccuuguccuggaau

SEQ ID NO: 84790 - RNA, 19 nt, Artificial Sequence
  Oligomer
ccucaaaauagucacgaac

SEQ ID NO: 84791 - RNA, 19 nt, Artificial Sequence
  Oligomer
aaagacauugggcugcaga

SEQ ID NO: 84792 - RNA, 19 nt, Artificial Sequence
  Oligomer
aagacauugggcugcagag

SEQ ID NO: 84793 - RNA, 19 nt, Artificial Sequence
  Oligomer
acaucuucaaccaacacau

SEQ ID NO: 84794 - RNA, 19 nt, Artificial Sequence
  Oligomer
acgugauagccaaagaaga

SEQ ID NO: 84795 - RNA, 19 nt, Artificial Sequence
  Oligomer
cugaggagcauugcauaca

SEQ ID NO: 84796 - RNA, 19 nt, Artificial Sequence
  Oligomer
ugaggagcauugcauacau

SEQ ID NO: 84797 - RNA, 19 nt, Artificial Sequence
  Oligomer
cagaagaggaggagguaug

SEQ ID NO: 84798 - RNA, 19 nt, Artificial Sequence
  Oligomer
cauaguacuugucagguca

SEQ ID NO: 84799 - RNA, 19 nt, Artificial Sequence
  Oligomer
ccuacuucucacucuaguc

SEQ ID NO: 84800 - RNA, 19 nt, Artificial Sequence
  Oligomer
uggaacaagguugggaggu

SEQ ID NO: 84801 - RNA, 19 nt, Artificial Sequence
  Oligomer
ccuagaaguucucauaaug

SEQ ID NO: 84802 - RNA, 19 nt, Artificial Sequence
  Oligomer
uccugccuguugaugagcu

SEQ ID NO: 84803 - RNA, 19 nt, Artificial Sequence
  Oligomer
ugacaggccuuuuccacau

SEQ ID NO: 84804 - RNA, 19 nt, Artificial Sequence
  Oligomer
gucauucuccuccaccucu

SEQ ID NO: 84805 - RNA, 19 nt, Artificial Sequence
  Oligomer
acuaacacugacaccucaa

SEQ ID NO: 84806 - RNA, 19 nt, Artificial Sequence
  Oligomer
ugggaccaggaagaagaug

SEQ ID NO: 84807 - RNA, 19 nt, Artificial Sequence
  Oligomer
caggacauagagcaggaug

SEQ ID NO: 84808 - RNA, 19 nt, Artificial Sequence
  Oligomer
caaugaagcgcuugaacug

SEQ ID NO: 84809 - RNA, 19 nt, Artificial Sequence
  Oligomer
acagaucauauccuggcug

SEQ ID NO: 84810 - RNA, 19 nt, Artificial Sequence
  Oligomer
cuugaugacuucaggcacc

SEQ ID NO: 84811 - RNA, 19 nt, Artificial Sequence
  Oligomer
ugaagcggagcucgcuauu

SEQ ID NO: 84812 - RNA, 19 nt, Artificial Sequence
  Oligomer
ucccgcagcaugaagugaa

SEQ ID NO: 84813 - RNA, 19 nt, Artificial Sequence
  Oligomer
ccuuucaugaagaccacca

SEQ ID NO: 84814 - RNA, 19 nt, Artificial Sequence
  Oligomer
gugguauuucggauuucuu

SEQ ID NO: 84815 - RNA, 19 nt, Artificial Sequence
  Oligomer
ccgcacaucuucaaccaac

SEQ ID NO: 84816 - RNA, 19 nt, Artificial Sequence
  Oligomer
uccacaucuucagcacuuu

SEQ ID NO: 84817 - RNA, 19 nt, Artificial Sequence
  Oligomer
agaagaggaggagguaugg

SEQ ID NO: 84818 - RNA, 19 nt, Artificial Sequence
  Oligomer
cugcauccuuacacucacc

SEQ ID NO: 84819 - RNA, 19 nt, Artificial Sequence
  Oligomer
cacacauacagacaugcac

SEQ ID NO: 84820 - RNA, 19 nt, Artificial Sequence
  Oligomer
ucagcuugucuucugagau

SEQ ID NO: 84821 - RNA, 19 nt, Artificial Sequence
  Oligomer
uggaagcagagguuucacu

SEQ ID NO: 84822 - RNA, 19 nt, Artificial Sequence
  Oligomer
ucauaauggugggagaagu

SEQ ID NO: 84823 - RNA, 19 nt, Artificial Sequence
  Oligomer
cugaggucgaacuucucag

SEQ ID NO: 84824 - RNA, 19 nt, Artificial Sequence
  Oligomer
cucccacuaacacugacac

SEQ ID NO: 84825 - RNA, 19 nt, Artificial Sequence
  Oligomer
ugcccugacuuguacucaa

SEQ ID NO: 84826 - RNA, 19 nt, Artificial Sequence
  Oligomer
gugagcaagauguaggaga

SEQ ID NO: 84827 - RNA, 19 nt, Artificial Sequence
  Oligomer
acuuuuccucaggagagcc

SEQ ID NO: 84828 - RNA, 19 nt, Artificial Sequence
  Oligomer
aggugccugaaaaaggucu

SEQ ID NO: 84829 - RNA, 19 nt, Artificial Sequence
  Oligomer
agcagcaccaggucauacu

SEQ ID NO: 84830 - RNA, 19 nt, Artificial Sequence
  Oligomer
gaucuugagcagcagagug

SEQ ID NO: 84831 - RNA, 19 nt, Artificial Sequence
  Oligomer
ucaaucuccuucuuggaga

SEQ ID NO: 84832 - RNA, 19 nt, Artificial Sequence
  Oligomer
cuuggagaacagcccauuc

SEQ ID NO: 84833 - RNA, 19 nt, Artificial Sequence
  Oligomer
uggagaacagcccauuccu

SEQ ID NO: 84834 - RNA, 19 nt, Artificial Sequence
  Oligomer
agcagcucuagccaggaua

SEQ ID NO: 84835 - RNA, 19 nt, Artificial Sequence
  Oligomer
agugcauccacaucuucag

SEQ ID NO: 84836 - RNA, 19 nt, Artificial Sequence
  Oligomer
gaugguguugcuaaggucu

SEQ ID NO: 84837 - RNA, 19 nt, Artificial Sequence
  Oligomer
ugccgaguggguuucugua

SEQ ID NO: 84838 - RNA, 19 nt, Artificial Sequence
  Oligomer
acucuagucccuagacacu

SEQ ID NO: 84839 - RNA, 19 nt, Artificial Sequence
  Oligomer
uccugcagggaguugaaga

SEQ ID NO: 84840 - RNA, 19 nt, Artificial Sequence
  Oligomer
acacugacaccucaaacuu

SEQ ID NO: 84841 - RNA, 19 nt, Artificial Sequence
  Oligomer
gaugaugagcaggacauag

SEQ ID NO: 84842 - RNA, 19 nt, Artificial Sequence
  Oligomer
uacggucuggaagaaccac

SEQ ID NO: 84843 - RNA, 19 nt, Artificial Sequence
  Oligomer
acagguacacauucaccac

SEQ ID NO: 84844 - RNA, 19 nt, Artificial Sequence
  Oligomer
uggcccacacuguguaaga

SEQ ID NO: 84845 - RNA, 19 nt, Artificial Sequence
  Oligomer
guuaaacagcagcaccagg

SEQ ID NO: 84846 - RNA, 19 nt, Artificial Sequence
  Oligomer
uggacaggacgaaguugac

SEQ ID NO: 84847 - RNA, 19 nt, Artificial Sequence
  Oligomer
uccuuguggccuugccauu

SEQ ID NO: 84848 - RNA, 19 nt, Artificial Sequence
  Oligomer
ucaccaaagggaagcaaca

SEQ ID NO: 84849 - RNA, 19 nt, Artificial Sequence
  Oligomer
accuccugcaaggcauuug

SEQ ID NO: 84850 - RNA, 19 nt, Artificial Sequence
  Oligomer
cacugcauccuuacacuca

SEQ ID NO: 84851 - RNA, 19 nt, Artificial Sequence
  Oligomer
ucuggaagcagagguuuca

SEQ ID NO: 84852 - RNA, 19 nt, Artificial Sequence
  Oligomer
ugguggucauucuccucca

SEQ ID NO: 84853 - RNA, 19 nt, Artificial Sequence
  Oligomer
agaaguguccaugcuagag

SEQ ID NO: 84854 - RNA, 19 nt, Artificial Sequence
  Oligomer
aggaucaggagcagcacaa

SEQ ID NO: 84855 - RNA, 19 nt, Artificial Sequence
  Oligomer
gcugcguuggaacuucucu

SEQ ID NO: 84856 - RNA, 19 nt, Artificial Sequence
  Oligomer
gcuggaaugacguuaccuu

SEQ ID NO: 84857 - RNA, 19 nt, Artificial Sequence
  Oligomer
ucugaggugucaacucagu

SEQ ID NO: 84858 - RNA, 19 nt, Artificial Sequence
  Oligomer
augaacucauccuuggaaa

SEQ ID NO: 84859 - RNA, 19 nt, Artificial Sequence
  Oligomer
agccauugccauccuuguc

SEQ ID NO: 84860 - RNA, 19 nt, Artificial Sequence
  Oligomer
aguuaaacagcagcaccag

SEQ ID NO: 84861 - RNA, 19 nt, Artificial Sequence
  Oligomer
aaaccaguagcggucacca

SEQ ID NO: 84862 - RNA, 19 nt, Artificial Sequence
  Oligomer
agccgcacaaauuguucaa

SEQ ID NO: 84863 - RNA, 19 nt, Artificial Sequence
  Oligomer
aaugggagacaagcccagu

SEQ ID NO: 84864 - RNA, 19 nt, Artificial Sequence
  Oligomer
ccacaucuucagcacuuug

SEQ ID NO: 84865 - RNA, 19 nt, Artificial Sequence
  Oligomer
aguggcagcuggcauuucu

SEQ ID NO: 84866 - RNA, 19 nt, Artificial Sequence
  Oligomer
uggcagcuggcauuucuca

SEQ ID NO: 84867 - RNA, 19 nt, Artificial Sequence
  Oligomer
aguugugguguuagacugg

SEQ ID NO: 84868 - RNA, 19 nt, Artificial Sequence
  Oligomer
uaccuccugcaaggcauuu

SEQ ID NO: 84869 - RNA, 19 nt, Artificial Sequence
  Oligomer
cucuagucccuagacacug

SEQ ID NO: 84870 - RNA, 19 nt, Artificial Sequence
  Oligomer
accauuucuccaggcugag

SEQ ID NO: 84871 - RNA, 19 nt, Artificial Sequence
  Oligomer
uuugaggauggaggcaaaa

SEQ ID NO: 84872 - RNA, 19 nt, Artificial Sequence
  Oligomer
cugcccugacuuguacuca

SEQ ID NO: 84873 - RNA, 19 nt, Artificial Sequence
  Oligomer
auggaagaggccaggaaag

SEQ ID NO: 84874 - RNA, 19 nt, Artificial Sequence
  Oligomer
agcaagauguaggagaaca

SEQ ID NO: 84875 - RNA, 19 nt, Artificial Sequence
  Oligomer
cucugaggugucaacucag

SEQ ID NO: 84876 - RNA, 19 nt, Artificial Sequence
  Oligomer
acucagucucaaugucgcu

SEQ ID NO: 84877 - RNA, 19 nt, Artificial Sequence
  Oligomer
ugggagagggacagaucau

SEQ ID NO: 84878 - RNA, 19 nt, Artificial Sequence
  Oligomer
agguccuugaugacuucag

SEQ ID NO: 84879 - RNA, 19 nt, Artificial Sequence
  Oligomer
guccuugaugacuucaggc

SEQ ID NO: 84880 - RNA, 19 nt, Artificial Sequence
  Oligomer
ccaugucaguuccuccuug

SEQ ID NO: 84881 - RNA, 19 nt, Artificial Sequence
  Oligomer
cucgaugaaggaucucagc

SEQ ID NO: 84882 - RNA, 19 nt, Artificial Sequence
  Oligomer
cucuuccuccaaguuaaac

SEQ ID NO: 84883 - RNA, 19 nt, Artificial Sequence
  Oligomer
ccucuugaaauuucucauc

SEQ ID NO: 84884 - RNA, 19 nt, Artificial Sequence
  Oligomer
aauagucacgaacaacaga

SEQ ID NO: 84885 - RNA, 19 nt, Artificial Sequence
  Oligomer
uucuuggagaacagcccau

SEQ ID NO: 84886 - RNA, 19 nt, Artificial Sequence
  Oligomer
aggacgauggugcugaaca

SEQ ID NO: 84887 - RNA, 19 nt, Artificial Sequence
  Oligomer
gauaaguccugguuguaca

SEQ ID NO: 84888 - RNA, 19 nt, Artificial Sequence
  Oligomer
uguuuucugcaggaagcug

SEQ ID NO: 84889 - RNA, 19 nt, Artificial Sequence
  Oligomer
cugaaagcacgugauagcc

SEQ ID NO: 84890 - RNA, 19 nt, Artificial Sequence
  Oligomer
uaaaaccuugggugaaauu

SEQ ID NO: 84891 - RNA, 19 nt, Artificial Sequence
  Oligomer
cuaagaugccagcauccau

SEQ ID NO: 84892 - RNA, 19 nt, Artificial Sequence
  Oligomer
cacucuagucccuagacac

SEQ ID NO: 84893 - RNA, 19 nt, Artificial Sequence
  Oligomer
agaacagaggugaggugug

SEQ ID NO: 84894 - RNA, 19 nt, Artificial Sequence
  Oligomer
cauaauggugggagaagug

SEQ ID NO: 84895 - RNA, 19 nt, Artificial Sequence
  Oligomer
ugaggucgaacuucucagc

SEQ ID NO: 84896 - RNA, 19 nt, Artificial Sequence
  Oligomer
gacggaugacuugaagacc

SEQ ID NO: 84897 - RNA, 19 nt, Artificial Sequence
  Oligomer
cuugaagaccaggucuuug

SEQ ID NO: 84898 - RNA, 19 nt, Artificial Sequence
  Oligomer
ccucaaacuuaugccacuc

SEQ ID NO: 84899 - RNA, 19 nt, Artificial Sequence
  Oligomer
aagaaccaccaguaauacu

SEQ ID NO: 84900 - RNA, 19 nt, Artificial Sequence
  Oligomer
cgguaguucucaaugaagc

SEQ ID NO: 84901 - RNA, 19 nt, Artificial Sequence
  Oligomer
ugcagucucugagguguca

SEQ ID NO: 84902 - RNA, 19 nt, Artificial Sequence
  Oligomer
uauuguggucccgcagcau

SEQ ID NO: 84903 - RNA, 19 nt, Artificial Sequence
  Oligomer
aaagucguacaugcggaac

SEQ ID NO: 84904 - RNA, 19 nt, Artificial Sequence
  Oligomer
aaaaggucuccaggaggug

SEQ ID NO: 84905 - RNA, 19 nt, Artificial Sequence
  Oligomer
uaugccagacaaagacauu

SEQ ID NO: 84906 - RNA, 19 nt, Artificial Sequence
  Oligomer
acaucuucagcacuuugua

SEQ ID NO: 84907 - RNA, 19 nt, Artificial Sequence
  Oligomer
acgcucaccaggucugaaa

SEQ ID NO: 84908 - RNA, 19 nt, Artificial Sequence
  Oligomer
agaacgugcuuaaaaccuu

SEQ ID NO: 84909 - RNA, 19 nt, Artificial Sequence
  Oligomer
uacagacaugcacacacau

SEQ ID NO: 84910 - RNA, 19 nt, Artificial Sequence
  Oligomer
ucuccaggcugagacacau

SEQ ID NO: 84911 - RNA, 19 nt, Artificial Sequence
  Oligomer
auguagaugugcacagaca

SEQ ID NO: 84912 - RNA, 19 nt, Artificial Sequence
  Oligomer
accucucggaugaugucag

SEQ ID NO: 84913 - RNA, 19 nt, Artificial Sequence
  Oligomer
ugaguagaucucccugagg

SEQ ID NO: 84914 - RNA, 19 nt, Artificial Sequence
  Oligomer
accauggaugaugagcagg

SEQ ID NO: 84915 - RNA, 19 nt, Artificial Sequence
  Oligomer
aaguggugggaggcaaaga

SEQ ID NO: 84916 - RNA, 19 nt, Artificial Sequence
  Oligomer
caggaaagaggcaagagag

SEQ ID NO: 84917 - RNA, 19 nt, Artificial Sequence
  Oligomer
aggaaagaggcaagagagg

SEQ ID NO: 84918 - RNA, 19 nt, Artificial Sequence
  Oligomer
gucaacucagucucaaugu

SEQ ID NO: 84919 - RNA, 19 nt, Artificial Sequence
  Oligomer
aacagcagcaccaggucau

SEQ ID NO: 84920 - RNA, 19 nt, Artificial Sequence
  Oligomer
ugcuggacaggacgaaguu

SEQ ID NO: 84921 - RNA, 19 nt, Artificial Sequence
  Oligomer
ccaucuaccacacggaucu

SEQ ID NO: 84922 - RNA, 19 nt, Artificial Sequence
  Oligomer
gagagugcaggguugaugu

SEQ ID NO: 84923 - RNA, 19 nt, Artificial Sequence
  Oligomer
agcgauguucugguaggug

SEQ ID NO: 84924 - RNA, 19 nt, Artificial Sequence
  Oligomer
aagagggcugaggagcauu

SEQ ID NO: 84925 - RNA, 19 nt, Artificial Sequence
  Oligomer
ucugagauuuguuucugaa

SEQ ID NO: 84926 - RNA, 19 nt, Artificial Sequence
  Oligomer
auuucuccaggcugagaca

SEQ ID NO: 84927 - RNA, 19 nt, Artificial Sequence
  Oligomer
gguuguuguaccacccauc

SEQ ID NO: 84928 - RNA, 19 nt, Artificial Sequence
  Oligomer
guagaugugcacagacacc

SEQ ID NO: 84929 - RNA, 19 nt, Artificial Sequence
  Oligomer
cugacggaugacuugaaga

SEQ ID NO: 84930 - RNA, 19 nt, Artificial Sequence
  Oligomer
caccucaaacuuaugccac

SEQ ID NO: 84931 - RNA, 19 nt, Artificial Sequence
  Oligomer
ccucuccaaaugguccauc

SEQ ID NO: 84932 - RNA, 19 nt, Artificial Sequence
  Oligomer
ugaugacuucaggcaccuc

SEQ ID NO: 84933 - RNA, 19 nt, Artificial Sequence
  Oligomer
gaaaaucuucccaugucag

SEQ ID NO: 84934 - RNA, 19 nt, Artificial Sequence
  Oligomer
gccauugccauccuuguca

SEQ ID NO: 84935 - RNA, 19 nt, Artificial Sequence
  Oligomer
ccugaaaaaggucuccagg

SEQ ID NO: 84936 - RNA, 19 nt, Artificial Sequence
  Oligomer
aucuccuucuuggagaaca

SEQ ID NO: 84937 - RNA, 19 nt, Artificial Sequence
  Oligomer
caaauuguucaaggacgau

SEQ ID NO: 84938 - RNA, 19 nt, Artificial Sequence
  Oligomer
gugcgggaaaacuucagug

SEQ ID NO: 84939 - RNA, 19 nt, Artificial Sequence
  Oligomer
gaaaucccgcacaucuuca

SEQ ID NO: 84940 - RNA, 19 nt, Artificial Sequence
  Oligomer
uauacuccgggaguguuuu

SEQ ID NO: 84941 - RNA, 19 nt, Artificial Sequence
  Oligomer
ucuguaaauggcuugccau

SEQ ID NO: 84942 - RNA, 19 nt, Artificial Sequence
  Oligomer
acacacauacagacaugca

SEQ ID NO: 84943 - RNA, 19 nt, Artificial Sequence
  Oligomer
gauuuguuucugaagucug

SEQ ID NO: 84944 - RNA, 19 nt, Artificial Sequence
  Oligomer
gccuuuuccacauucuugg

SEQ ID NO: 84945 - RNA, 19 nt, Artificial Sequence
  Oligomer
guucagaaccuucuggaag

SEQ ID NO: 84946 - RNA, 19 nt, Artificial Sequence
  Oligomer
ccagaaguguccaugcuag

SEQ ID NO: 84947 - RNA, 19 nt, Artificial Sequence
  Oligomer
ccucccacuaacacugaca

SEQ ID NO: 84948 - RNA, 19 nt, Artificial Sequence
  Oligomer
ccacuaacacugacaccuc

SEQ ID NO: 84949 - RNA, 19 nt, Artificial Sequence
  Oligomer
accucaaacuuaugccacu

SEQ ID NO: 84950 - RNA, 19 nt, Artificial Sequence
  Oligomer
gcugaucuccaccuucuuc

SEQ ID NO: 84951 - RNA, 19 nt, Artificial Sequence
  Oligomer
gggcucagggauuagaaug

SEQ ID NO: 84952 - RNA, 19 nt, Artificial Sequence
  Oligomer
uuucucgcaggaaggugau

SEQ ID NO: 84953 - RNA, 19 nt, Artificial Sequence
  Oligomer
cauggugagcaagauguag

SEQ ID NO: 84954 - RNA, 19 nt, Artificial Sequence
  Oligomer
auccuggcugauguaggag

SEQ ID NO: 84955 - RNA, 19 nt, Artificial Sequence
  Oligomer
guuguuggagaucucgaug

SEQ ID NO: 84956 - RNA, 19 nt, Artificial Sequence
  Oligomer
agcauccugaugaacucau

SEQ ID NO: 84957 - RNA, 19 nt, Artificial Sequence
  Oligomer
aggcgagacuuuuccucag

SEQ ID NO: 84958 - RNA, 19 nt, Artificial Sequence
  Oligomer
agacuuuuccucaggagag

SEQ ID NO: 84959 - RNA, 21 nt, Artificial Sequence
  Oligomer
gggugacagaugugccagaua

SEQ ID NO: 84960 - RNA, 21 nt, Artificial Sequence
  Oligomer
caucguccuugaacaauuugu

SEQ ID NO: 84961 - RNA, 21 nt, Artificial Sequence
  Oligomer
cauggaugcuggcaucuuaga

SEQ ID NO: 84962 - RNA, 21 nt, Artificial Sequence
  Oligomer
caccacaacuaauuucaccca

SEQ ID NO: 84963 - RNA, 21 nt, Artificial Sequence
  Oligomer
ggucaucaaucggaacucaag

SEQ ID NO: 84964 - RNA, 21 nt, Artificial Sequence
  Oligomer
aagucauccgucagcugccaa

SEQ ID NO: 84965 - RNA, 21 nt, Artificial Sequence
  Oligomer
caaggaggaacugacauggga

SEQ ID NO: 84966 - RNA, 21 nt, Artificial Sequence
  Oligomer
cauggaagcuuuggaauggca

SEQ ID NO: 84967 - RNA, 21 nt, Artificial Sequence
  Oligomer
ccuugauggaccauuuggaga

SEQ ID NO: 84968 - RNA, 21 nt, Artificial Sequence
  Oligomer
auuugaugggugguacaacaa

SEQ ID NO: 84969 - RNA, 21 nt, Artificial Sequence
  Oligomer
cucugauuucccaccucccaa

SEQ ID NO: 84970 - RNA, 21 nt, Artificial Sequence
  Oligomer
gaaaggcucuccugaggaaaa

SEQ ID NO: 84971 - RNA, 21 nt, Artificial Sequence
  Oligomer
cuaacaccacaacuaauuuca

SEQ ID NO: 84972 - RNA, 21 nt, Artificial Sequence
  Oligomer
cguccuugaacaauuugugcg

SEQ ID NO: 84973 - RNA, 21 nt, Artificial Sequence
  Oligomer
cagucuaacaccacaacuaau

SEQ ID NO: 84974 - RNA, 21 nt, Artificial Sequence
  Oligomer
acaucacacgggcaucacaga

SEQ ID NO: 84975 - RNA, 21 nt, Artificial Sequence
  Oligomer
acaaguacuaugugugugcau

SEQ ID NO: 84976 - RNA, 21 nt, Artificial Sequence
  Oligomer
caugaaaggcucuccugagga

SEQ ID NO: 84977 - RNA, 21 nt, Artificial Sequence
  Oligomer
gaaguuuucccgcacagacca

SEQ ID NO: 84978 - RNA, 21 nt, Artificial Sequence
  Oligomer
guugguugaagaugugcggga

SEQ ID NO: 84979 - RNA, 21 nt, Artificial Sequence
  Oligomer
cggugaguguaaggaugcagu

SEQ ID NO: 84980 - RNA, 21 nt, Artificial Sequence
  Oligomer
aggacaaggaggaacugacau

SEQ ID NO: 84981 - RNA, 21 nt, Artificial Sequence
  Oligomer
gaguguaaggaugcaguggga

SEQ ID NO: 84982 - RNA, 21 nt, Artificial Sequence
  Oligomer
caucguccucacagucuuaca

SEQ ID NO: 84983 - RNA, 21 nt, Artificial Sequence
  Oligomer
ugggaauggccucauuuccaa

SEQ ID NO: 84984 - RNA, 21 nt, Artificial Sequence
  Oligomer
aguagucucccuuccaaauaa

SEQ ID NO: 84985 - RNA, 21 nt, Artificial Sequence
  Oligomer
gcauggaugcuggcaucuuag

SEQ ID NO: 84986 - RNA, 21 nt, Artificial Sequence
  Oligomer
gaagacaagcugaccugacaa

SEQ ID NO: 84987 - RNA, 21 nt, Artificial Sequence
  Oligomer
aguucaagcgcuucauugaga

SEQ ID NO: 84988 - RNA, 21 nt, Artificial Sequence
  Oligomer
uguuguucgugacuauuuuga

SEQ ID NO: 84989 - RNA, 21 nt, Artificial Sequence
  Oligomer
gcugccaaguguucuguaaga

SEQ ID NO: 84990 - RNA, 21 nt, Artificial Sequence
  Oligomer
ccuacaucagccaggauauga

SEQ ID NO: 84991 - RNA, 21 nt, Artificial Sequence
  Oligomer
ggugccugaagucaucaagga

SEQ ID NO: 84992 - RNA, 21 nt, Artificial Sequence
  Oligomer
ucaggaugcugagauccuuca

SEQ ID NO: 84993 - RNA, 21 nt, Artificial Sequence
  Oligomer
ugacaaggauggcaauggcua

SEQ ID NO: 84994 - RNA, 21 nt, Artificial Sequence
  Oligomer
ggcuguucuccaagaaggaga

SEQ ID NO: 84995 - RNA, 21 nt, Artificial Sequence
  Oligomer
aggccugucagcucaucaaca

SEQ ID NO: 84996 - RNA, 21 nt, Artificial Sequence
  Oligomer
gauuugaugggugguacaaca

SEQ ID NO: 84997 - RNA, 21 nt, Artificial Sequence
  Oligomer
auaugaucugucccucuccca

SEQ ID NO: 84998 - RNA, 21 nt, Artificial Sequence
  Oligomer
acaauuugugcggcuacggga

SEQ ID NO: 84999 - RNA, 21 nt, Artificial Sequence
  Oligomer
ccuacaaagugcugaagaugu

SEQ ID NO: 85000 - RNA, 21 nt, Artificial Sequence
  Oligomer
ccauggcaagccauuuacaga

SEQ ID NO: 85001 - RNA, 21 nt, Artificial Sequence
  Oligomer
gcacuuccagaagguucugaa

SEQ ID NO: 85002 - RNA, 21 nt, Artificial Sequence
  Oligomer
ccuuauguuccgcauguacga

SEQ ID NO: 85003 - RNA, 21 nt, Artificial Sequence
  Oligomer
cauccugguggucuucaugaa

SEQ ID NO: 85004 - RNA, 21 nt, Artificial Sequence
  Oligomer
acuaauuucacccaagguuuu

SEQ ID NO: 85005 - RNA, 21 nt, Artificial Sequence
  Oligomer
cagcuaugcagauggcgugua

SEQ ID NO: 85006 - RNA, 21 nt, Artificial Sequence
  Oligomer
guuugaggugucaguguuagu

SEQ ID NO: 85007 - RNA, 21 nt, Artificial Sequence
  Oligomer
ccgaguuccucaacauucgca

SEQ ID NO: 85008 - RNA, 21 nt, Artificial Sequence
  Oligomer
guuuuaagcacguucuuucau

SEQ ID NO: 85009 - RNA, 21 nt, Artificial Sequence
  Oligomer
ccagucuaacaccacaacuaa

SEQ ID NO: 85010 - RNA, 21 nt, Artificial Sequence
  Oligomer
ugugcaugucuguaugugugu

SEQ ID NO: 85011 - RNA, 21 nt, Artificial Sequence
  Oligomer
ucuccauuuugggacauucua

SEQ ID NO: 85012 - RNA, 21 nt, Artificial Sequence
  Oligomer
gagagaaguuccaacgcagcu

SEQ ID NO: 85013 - RNA, 21 nt, Artificial Sequence
  Oligomer
gaugcugagauccuucaucga

SEQ ID NO: 85014 - RNA, 21 nt, Artificial Sequence
  Oligomer
cuuugucuggcauaaaggaga

SEQ ID NO: 85015 - RNA, 21 nt, Artificial Sequence
  Oligomer
agaggaccauguguugguuga

SEQ ID NO: 85016 - RNA, 21 nt, Artificial Sequence
  Oligomer
uggcuaucacgugcuuucaga

SEQ ID NO: 85017 - RNA, 21 nt, Artificial Sequence
  Oligomer
caggaaugggcuguucuccaa

SEQ ID NO: 85018 - RNA, 21 nt, Artificial Sequence
  Oligomer
caagcugaccugacaaguacu

SEQ ID NO: 85019 - RNA, 21 nt, Artificial Sequence
  Oligomer
agaugugccagauacccaaag

SEQ ID NO: 85020 - RNA, 21 nt, Artificial Sequence
  Oligomer
gacagaugugccagauaccca

SEQ ID NO: 85021 - RNA, 21 nt, Artificial Sequence
  Oligomer
ugucuagggacuagagugaga

SEQ ID NO: 85022 - RNA, 21 nt, Artificial Sequence
  Oligomer
gaugugucucagccuggagaa

SEQ ID NO: 85023 - RNA, 21 nt, Artificial Sequence
  Oligomer
uuggcaagaagguaacgucau

SEQ ID NO: 85024 - RNA, 21 nt, Artificial Sequence
  Oligomer
cugaugagagcagcugugaca

SEQ ID NO: 85025 - RNA, 21 nt, Artificial Sequence
  Oligomer
ucaacuucguccuguccagca

SEQ ID NO: 85026 - RNA, 21 nt, Artificial Sequence
  Oligomer
ucuucuuccuggucccagcaa

SEQ ID NO: 85027 - RNA, 21 nt, Artificial Sequence
  Oligomer
ucaugcugcgggaccacaaua

SEQ ID NO: 85028 - RNA, 21 nt, Artificial Sequence
  Oligomer
ccuucaucgagaucuccaaca

SEQ ID NO: 85029 - RNA, 21 nt, Artificial Sequence
  Oligomer
augaaaggcucuccugaggaa

SEQ ID NO: 85030 - RNA, 21 nt, Artificial Sequence
  Oligomer
cauguucucucuggcugacaa

SEQ ID NO: 85031 - RNA, 21 nt, Artificial Sequence
  Oligomer
ccuggagaccuuuuucaggca

SEQ ID NO: 85032 - RNA, 21 nt, Artificial Sequence
  Oligomer
gucaucaaucggaacucaagu

SEQ ID NO: 85033 - RNA, 21 nt, Artificial Sequence
  Oligomer
aaaggccugucagcucaucaa

SEQ ID NO: 85034 - RNA, 21 nt, Artificial Sequence
  Oligomer
gguucugaaccggagucuauu

SEQ ID NO: 85035 - RNA, 21 nt, Artificial Sequence
  Oligomer
uccagaagguucugaaccgga

SEQ ID NO: 85036 - RNA, 21 nt, Artificial Sequence
  Oligomer
ugaauguguaccuguucucca

SEQ ID NO: 85037 - RNA, 21 nt, Artificial Sequence
  Oligomer
cagcagccagcaucucuuuca

SEQ ID NO: 85038 - RNA, 21 nt, Artificial Sequence
  Oligomer
ccaaggaugaguucaucagga

SEQ ID NO: 85039 - RNA, 21 nt, Artificial Sequence
  Oligomer
guuccgcauguacgacuuuga

SEQ ID NO: 85040 - RNA, 21 nt, Artificial Sequence
  Oligomer
acaaagugcugaagaugugga

SEQ ID NO: 85041 - RNA, 21 nt, Artificial Sequence
  Oligomer
agucuaacaccacaacuaauu

SEQ ID NO: 85042 - RNA, 21 nt, Artificial Sequence
  Oligomer
guacuaugugugugcaugucu

SEQ ID NO: 85043 - RNA, 21 nt, Artificial Sequence
  Oligomer
uggugucugugcacaucuaca

SEQ ID NO: 85044 - RNA, 21 nt, Artificial Sequence
  Oligomer
guaugucuuugccucccacca

SEQ ID NO: 85045 - RNA, 21 nt, Artificial Sequence
  Oligomer
gucuuugucuggcauaaagga

SEQ ID NO: 85046 - RNA, 21 nt, Artificial Sequence
  Oligomer
cccagucuaacaccacaacua

SEQ ID NO: 85047 - RNA, 21 nt, Artificial Sequence
  Oligomer
aagcugaccugacaaguacua

SEQ ID NO: 85048 - RNA, 21 nt, Artificial Sequence
  Oligomer
acuucagaaacaaaucucaga

SEQ ID NO: 85049 - RNA, 21 nt, Artificial Sequence
  Oligomer
ucugcuuccagacuucagaaa

SEQ ID NO: 85050 - RNA, 21 nt, Artificial Sequence
  Oligomer
ccucugcuuccagacuucaga

SEQ ID NO: 85051 - RNA, 21 nt, Artificial Sequence
  Oligomer
cccaguugagcagagguuuga

SEQ ID NO: 85052 - RNA, 21 nt, Artificial Sequence
  Oligomer
aaaaggccugucagcucauca

SEQ ID NO: 85053 - RNA, 21 nt, Artificial Sequence
  Oligomer
cagccagcaucucuuucaugu

SEQ ID NO: 85054 - RNA, 21 nt, Artificial Sequence
  Oligomer
acaauagcgagcuccgcuuca

SEQ ID NO: 85055 - RNA, 21 nt, Artificial Sequence
  Oligomer
caugggaagauuuucacuuca

SEQ ID NO: 85056 - RNA, 21 nt, Artificial Sequence
  Oligomer
ugcugagauccuucaucgaga

SEQ ID NO: 85057 - RNA, 21 nt, Artificial Sequence
  Oligomer
cauggcaagccauuuacagaa

SEQ ID NO: 85058 - RNA, 21 nt, Artificial Sequence
  Oligomer
cuauguccugcucaucaucca

SEQ ID NO: 85059 - RNA, 21 nt, Artificial Sequence
  Oligomer
gauccuucaucgagaucucca

SEQ ID NO: 85060 - RNA, 21 nt, Artificial Sequence
  Oligomer
aggucaacuucguccugucca

SEQ ID NO: 85061 - RNA, 21 nt, Artificial Sequence
  Oligomer
acuauuuugagggcaguggau

SEQ ID NO: 85062 - RNA, 21 nt, Artificial Sequence
  Oligomer
ccagaacaucgcuguguauga

SEQ ID NO: 85063 - RNA, 21 nt, Artificial Sequence
  Oligomer
agacccuggcccaauaccuau

SEQ ID NO: 85064 - RNA, 21 nt, Artificial Sequence
  Oligomer
augggugguacaacaaccuca

SEQ ID NO: 85065 - RNA, 21 nt, Artificial Sequence
  Oligomer
aaguguucuguaagaagaucu

SEQ ID NO: 85066 - RNA, 21 nt, Artificial Sequence
  Oligomer
uggucuucaagucauccguca

SEQ ID NO: 85067 - RNA, 21 nt, Artificial Sequence
  Oligomer
gugccagauacccaaagcugu

SEQ ID NO: 85068 - RNA, 21 nt, Artificial Sequence
  Oligomer
cuuccaugaugaugggucuga

SEQ ID NO: 85069 - RNA, 21 nt, Artificial Sequence
  Oligomer
ucucuuucauguucuccuaca

SEQ ID NO: 85070 - RNA, 21 nt, Artificial Sequence
  Oligomer
gagacugaguugacaccucag

SEQ ID NO: 85071 - RNA, 21 nt, Artificial Sequence
  Oligomer
agcuuuggaauggcaaggcca

SEQ ID NO: 85072 - RNA, 21 nt, Artificial Sequence
  Oligomer
ugaagaaauccgaaauaccac

SEQ ID NO: 85073 - RNA, 21 nt, Artificial Sequence
  Oligomer
cuaugugugugcaugucugua

SEQ ID NO: 85074 - RNA, 21 nt, Artificial Sequence
  Oligomer
cagcugccaaguguucuguaa

SEQ ID NO: 85075 - RNA, 21 nt, Artificial Sequence
  Oligomer
auguguaccuguucuccauca

SEQ ID NO: 85076 - RNA, 21 nt, Artificial Sequence
  Oligomer
agucuuacacagugugggcca

SEQ ID NO: 85077 - RNA, 21 nt, Artificial Sequence
  Oligomer
uguucuccuacaucuugcuca

SEQ ID NO: 85078 - RNA, 21 nt, Artificial Sequence
  Oligomer
ggucuucuuuggcuaucacgu

SEQ ID NO: 85079 - RNA, 21 nt, Artificial Sequence
  Oligomer
aguucgaccucaggaccacua

SEQ ID NO: 85080 - RNA, 21 nt, Artificial Sequence
  Oligomer
guuugaguggcuggcugacau

SEQ ID NO: 85081 - RNA, 21 nt, Artificial Sequence
  Oligomer
cuuccuggucccagcaaucau

SEQ ID NO: 85082 - RNA, 21 nt, Artificial Sequence
  Oligomer
ccugcucuauguccugcucau

SEQ ID NO: 85083 - RNA, 21 nt, Artificial Sequence
  Oligomer
auguggugaauguguaccugu

SEQ ID NO: 85084 - RNA, 21 nt, Artificial Sequence
  Oligomer
cguccucacagucuuacacag

SEQ ID NO: 85085 - RNA, 21 nt, Artificial Sequence
  Oligomer
aggaggaacugacaugggaag

SEQ ID NO: 85086 - RNA, 21 nt, Artificial Sequence
  Oligomer
cgacuuugaugggaauggccu

SEQ ID NO: 85087 - RNA, 21 nt, Artificial Sequence
  Oligomer
gucuagggacuagagugagaa

SEQ ID NO: 85088 - RNA, 21 nt, Artificial Sequence
  Oligomer
augugucucagccuggagaaa

SEQ ID NO: 85089 - RNA, 21 nt, Artificial Sequence
  Oligomer
ggcacuuccagaagguucuga

SEQ ID NO: 85090 - RNA, 21 nt, Artificial Sequence
  Oligomer
gacauugagacugaguugaca

SEQ ID NO: 85091 - RNA, 21 nt, Artificial Sequence
  Oligomer
cauuuccaaggaugaguucau

SEQ ID NO: 85092 - RNA, 21 nt, Artificial Sequence
  Oligomer
uaacuuggaggaagagcggca

SEQ ID NO: 85093 - RNA, 21 nt, Artificial Sequence
  Oligomer
ugaagaugugcgggauuucug

SEQ ID NO: 85094 - RNA, 21 nt, Artificial Sequence
  Oligomer
caucaaucggaacucaagugu

SEQ ID NO: 85095 - RNA, 21 nt, Artificial Sequence
  Oligomer
cuccaguagucucccuuccaa

SEQ ID NO: 85096 - RNA, 21 nt, Artificial Sequence
  Oligomer
aaaugccuugcaggagguaga

SEQ ID NO: 85097 - RNA, 21 nt, Artificial Sequence
  Oligomer
acaacaaccucauggagcaca

SEQ ID NO: 85098 - RNA, 21 nt, Artificial Sequence
  Oligomer
ggacuagagugagaaguaggg

SEQ ID NO: 85099 - RNA, 21 nt, Artificial Sequence
  Oligomer
cugagaaguucgaccucagga

SEQ ID NO: 85100 - RNA, 21 nt, Artificial Sequence
  Oligomer
ggugucugugcacaucuacau

SEQ ID NO: 85101 - RNA, 21 nt, Artificial Sequence
  Oligomer
ugacaucauccgagaggugga

SEQ ID NO: 85102 - RNA, 21 nt, Artificial Sequence
  Oligomer
ucagcugccaaguguucugua

SEQ ID NO: 85103 - RNA, 21 nt, Artificial Sequence
  Oligomer
gaagaagguggagaucagcgu

SEQ ID NO: 85104 - RNA, 21 nt, Artificial Sequence
  Oligomer
uccugauccuggccaucaugu

SEQ ID NO: 85105 - RNA, 21 nt, Artificial Sequence
  Oligomer
uggaggugccugaagucauca

SEQ ID NO: 85106 - RNA, 21 nt, Artificial Sequence
  Oligomer
caggacaaggaggaacugaca

SEQ ID NO: 85107 - RNA, 21 nt, Artificial Sequence
  Oligomer
aguucaucaggaugcugagau

SEQ ID NO: 85108 - RNA, 21 nt, Artificial Sequence
  Oligomer
acauccugguggucuucauga

SEQ ID NO: 85109 - RNA, 21 nt, Artificial Sequence
  Oligomer
uuuggaauggcaaggccacaa

SEQ ID NO: 85110 - RNA, 21 nt, Artificial Sequence
  Oligomer
ugaagauguggaugcacugcu

SEQ ID NO: 85111 - RNA, 21 nt, Artificial Sequence
  Oligomer
uggaaaaggccugucagcuca

SEQ ID NO: 85112 - RNA, 21 nt, Artificial Sequence
  Oligomer
cccagggcuuugaguacaagu

SEQ ID NO: 85113 - RNA, 21 nt, Artificial Sequence
  Oligomer
uucacgcagcucugugucaaa

SEQ ID NO: 85114 - RNA, 21 nt, Artificial Sequence
  Oligomer
cuucaugaaaggcucuccuga

SEQ ID NO: 85115 - RNA, 21 nt, Artificial Sequence
  Oligomer
ucuggcugacaaggauggcaa

SEQ ID NO: 85116 - RNA, 21 nt, Artificial Sequence
  Oligomer
ugcuggucgcuguuaucaaca

SEQ ID NO: 85117 - RNA, 21 nt, Artificial Sequence
  Oligomer
gauggugaccgcuacugguuu

SEQ ID NO: 85118 - RNA, 21 nt, Artificial Sequence
  Oligomer
aggaguggcauaaguuugagg

SEQ ID NO: 85119 - RNA, 21 nt, Artificial Sequence
  Oligomer
ccuacaucuugcucaccaugu

SEQ ID NO: 85120 - RNA, 21 nt, Artificial Sequence
  Oligomer
ucuccuacaucuugcucacca

SEQ ID NO: 85121 - RNA, 21 nt, Artificial Sequence
  Oligomer
agacugaguugacaccucaga

SEQ ID NO: 85122 - RNA, 21 nt, Artificial Sequence
  Oligomer
caucgugucugagaagcucgu

SEQ ID NO: 85123 - RNA, 21 nt, Artificial Sequence
  Oligomer
gcuggucgcuguuaucaacau

SEQ ID NO: 85124 - RNA, 21 nt, Artificial Sequence
  Oligomer
ugggcuguucuccaagaagga

SEQ ID NO: 85125 - RNA, 21 nt, Artificial Sequence
  Oligomer
gaagaugugcgggauuucugg

SEQ ID NO: 85126 - RNA, 21 nt, Artificial Sequence
  Oligomer
gagaggaccauguguugguug

SEQ ID NO: 85127 - RNA, 21 nt, Artificial Sequence
  Oligomer
agauguggaugcacugcugcu

SEQ ID NO: 85128 - RNA, 21 nt, Artificial Sequence
  Oligomer
agcauggaugcuggcaucuua

SEQ ID NO: 85129 - RNA, 21 nt, Artificial Sequence
  Oligomer
ggugaguguaaggaugcagug

SEQ ID NO: 85130 - RNA, 21 nt, Artificial Sequence
  Oligomer
acuucucccaccauuaugaga

SEQ ID NO: 85131 - RNA, 21 nt, Artificial Sequence
  Oligomer
acucacuucucccaccauuau

SEQ ID NO: 85132 - RNA, 21 nt, Artificial Sequence
  Oligomer
agguucugaaccggagucuau

SEQ ID NO: 85133 - RNA, 21 nt, Artificial Sequence
  Oligomer
ugccagauacccaaagcugua

SEQ ID NO: 85134 - RNA, 21 nt, Artificial Sequence
  Oligomer
cuuucauguucuccuacaucu

SEQ ID NO: 85135 - RNA, 21 nt, Artificial Sequence
  Oligomer
accagacggugcaacaguuca

SEQ ID NO: 85136 - RNA, 21 nt, Artificial Sequence
  Oligomer
agcugaugagagcagcuguga

SEQ ID NO: 85137 - RNA, 21 nt, Artificial Sequence
  Oligomer
ugagggcaguggauuuggcuu

SEQ ID NO: 85138 - RNA, 21 nt, Artificial Sequence
  Oligomer
guccuugaacaauuugugcgg

SEQ ID NO: 85139 - RNA, 21 nt, Artificial Sequence
  Oligomer
caucuuagaacccucccuacu

SEQ ID NO: 85140 - RNA, 21 nt, Artificial Sequence
  Oligomer
aaguacuaugugugugcaugu

SEQ ID NO: 85141 - RNA, 21 nt, Artificial Sequence
  Oligomer
uuccagacuucagaaacaaau

SEQ ID NO: 85142 - RNA, 21 nt, Artificial Sequence
  Oligomer
agugaaaccucugcuuccaga

SEQ ID NO: 85143 - RNA, 21 nt, Artificial Sequence
  Oligomer
gcagugucuagggacuagagu

SEQ ID NO: 85144 - RNA, 21 nt, Artificial Sequence
  Oligomer
gucucagccuggagaaauggu

SEQ ID NO: 85145 - RNA, 21 nt, Artificial Sequence
  Oligomer
ggugguacaacaaccucaugg

SEQ ID NO: 85146 - RNA, 21 nt, Artificial Sequence
  Oligomer
agaaguucgaccucaggacca

SEQ ID NO: 85147 - RNA, 21 nt, Artificial Sequence
  Oligomer
ugugcacaucuacaucaccca

SEQ ID NO: 85148 - RNA, 21 nt, Artificial Sequence
  Oligomer
agagguggaggagaaugacca

SEQ ID NO: 85149 - RNA, 21 nt, Artificial Sequence
  Oligomer
uugggacauucuaaucccuga

SEQ ID NO: 85150 - RNA, 21 nt, Artificial Sequence
  Oligomer
ccaucguccucacagucuuac

SEQ ID NO: 85151 - RNA, 21 nt, Artificial Sequence
  Oligomer
acugacaugggaagauuuuca

SEQ ID NO: 85152 - RNA, 21 nt, Artificial Sequence
  Oligomer
cuuccgagaguuccuggacau

SEQ ID NO: 85153 - RNA, 21 nt, Artificial Sequence
  Oligomer
caaggaguaugaccuggugcu

SEQ ID NO: 85154 - RNA, 21 nt, Artificial Sequence
  Oligomer
cuuuggaauggcaaggccaca

SEQ ID NO: 85155 - RNA, 21 nt, Artificial Sequence
  Oligomer
uugaagaaauccgaaauacca

SEQ ID NO: 85156 - RNA, 21 nt, Artificial Sequence
  Oligomer
aaaugccagcugccacuucca

SEQ ID NO: 85157 - RNA, 21 nt, Artificial Sequence
  Oligomer
aggauaccggccauuucugga

SEQ ID NO: 85158 - RNA, 21 nt, Artificial Sequence
  Oligomer
aucacacgggcaucacagaca

SEQ ID NO: 85159 - RNA, 21 nt, Artificial Sequence
  Oligomer
gguuuggcaagaagguaacgu

SEQ ID NO: 85160 - RNA, 21 nt, Artificial Sequence
  Oligomer
ugaggugguggaguccauguu

SEQ ID NO: 85161 - RNA, 21 nt, Artificial Sequence
  Oligomer
uuuccaaggaugaguucauca

SEQ ID NO: 85162 - RNA, 21 nt, Artificial Sequence
  Oligomer
agauccgugugguagauggca

SEQ ID NO: 85163 - RNA, 21 nt, Artificial Sequence
  Oligomer
cacugaaguuuucccgcacag

SEQ ID NO: 85164 - RNA, 21 nt, Artificial Sequence
  Oligomer
gcugaagauguggaugcacug

SEQ ID NO: 85165 - RNA, 21 nt, Artificial Sequence
  Oligomer
aagccuacaaagugcugaaga

SEQ ID NO: 85166 - RNA, 21 nt, Artificial Sequence
  Oligomer
acccauggcaagccauuuaca

SEQ ID NO: 85167 - RNA, 21 nt, Artificial Sequence
  Oligomer
ccugacaaguacuaugugugu

SEQ ID NO: 85168 - RNA, 21 nt, Artificial Sequence
  Oligomer
aaaucucagaagacaagcuga

SEQ ID NO: 85169 - RNA, 21 nt, Artificial Sequence
  Oligomer
ucaguuugaguggcuggcuga

SEQ ID NO: 85170 - RNA, 21 nt, Artificial Sequence
  Oligomer
gcucuagcauggacacuucug

SEQ ID NO: 85171 - RNA, 21 nt, Artificial Sequence
  Oligomer
uggugguucuuccagaccgua

SEQ ID NO: 85172 - RNA, 21 nt, Artificial Sequence
  Oligomer
cagcgacauugagacugaguu

SEQ ID NO: 85173 - RNA, 21 nt, Artificial Sequence
  Oligomer
augggaauggccucauuucca

SEQ ID NO: 85174 - RNA, 21 nt, Artificial Sequence
  Oligomer
gaagaaauccgaaauaccacc

SEQ ID NO: 85175 - RNA, 21 nt, Artificial Sequence
  Oligomer
aaggagauugaagaaauccga

SEQ ID NO: 85176 - RNA, 21 nt, Artificial Sequence
  Oligomer
cuccaagaaggagauugaaga

SEQ ID NO: 85177 - RNA, 21 nt, Artificial Sequence
  Oligomer
ucguccuugaacaauuugugc

SEQ ID NO: 85178 - RNA, 21 nt, Artificial Sequence
  Oligomer
cguucuuucaucagacccugg

SEQ ID NO: 85179 - RNA, 21 nt, Artificial Sequence
  Oligomer
gucuaacaccacaacuaauuu

SEQ ID NO: 85180 - RNA, 21 nt, Artificial Sequence
  Oligomer
cuaugcagauggcguguacca

SEQ ID NO: 85181 - RNA, 21 nt, Artificial Sequence
  Oligomer
auggaugcuggcaucuuagaa

SEQ ID NO: 85182 - RNA, 21 nt, Artificial Sequence
  Oligomer
gaccugacaaguacuaugugu

SEQ ID NO: 85183 - RNA, 21 nt, Artificial Sequence
  Oligomer
guacaacaaccucauggagca

SEQ ID NO: 85184 - RNA, 21 nt, Artificial Sequence
  Oligomer
uuccuauuucuggcugccuca

SEQ ID NO: 85185 - RNA, 21 nt, Artificial Sequence
  Oligomer
ccaagaauguggaaaaggccu

SEQ ID NO: 85186 - RNA, 21 nt, Artificial Sequence
  Oligomer
auaaguuugaggugucagugu

SEQ ID NO: 85187 - RNA, 21 nt, Artificial Sequence
  Oligomer
uguggugaauguguaccuguu

SEQ ID NO: 85188 - RNA, 21 nt, Artificial Sequence
  Oligomer
gacaugggaagauuuucacuu

SEQ ID NO: 85189 - RNA, 21 nt, Artificial Sequence
  Oligomer
augaguucaucaggaugcuga

SEQ ID NO: 85190 - RNA, 21 nt, Artificial Sequence
  Oligomer
cuuugaugggaauggccucau

SEQ ID NO: 85191 - RNA, 21 nt, Artificial Sequence
  Oligomer
aggauggcaauggcuaccugu

SEQ ID NO: 85192 - RNA, 21 nt, Artificial Sequence
  Oligomer
aggacauguuuguggagucca

SEQ ID NO: 85193 - RNA, 21 nt, Artificial Sequence
  Oligomer
uggaagcuuuggaauggcaag

SEQ ID NO: 85194 - RNA, 21 nt, Artificial Sequence
  Oligomer
ugcucccucuguuguucguga

SEQ ID NO: 85195 - RNA, 21 nt, Artificial Sequence
  Oligomer
acugaaguuuucccgcacaga

SEQ ID NO: 85196 - RNA, 21 nt, Artificial Sequence
  Oligomer
ucacgugcuuucagaccuggu

SEQ ID NO: 85197 - RNA, 21 nt, Artificial Sequence
  Oligomer
accuauguaugcaaugcuccu

SEQ ID NO: 85198 - RNA, 21 nt, Artificial Sequence
  Oligomer
caagccauuuacagaaaccca

SEQ ID NO: 85199 - RNA, 21 nt, Artificial Sequence
  Oligomer
agugucuagggacuagaguga

SEQ ID NO: 85200 - RNA, 21 nt, Artificial Sequence
  Oligomer
cagccuucucugauuucccac

SEQ ID NO: 85201 - RNA, 21 nt, Artificial Sequence
  Oligomer
uggcaugaccaagaaugugga

SEQ ID NO: 85202 - RNA, 21 nt, Artificial Sequence
  Oligomer
agaucuacuucaucuggguga

SEQ ID NO: 85203 - RNA, 21 nt, Artificial Sequence
  Oligomer
cauccugcucuauguccugcu

SEQ ID NO: 85204 - RNA, 21 nt, Artificial Sequence
  Oligomer
uuuccuggagagggccuacua

SEQ ID NO: 85205 - RNA, 21 nt, Artificial Sequence
  Oligomer
cauuccagcccuugcuguuca

SEQ ID NO: 85206 - RNA, 21 nt, Artificial Sequence
  Oligomer
gaagguaacgucauuccagcc

SEQ ID NO: 85207 - RNA, 21 nt, Artificial Sequence
  Oligomer
acugaguugacaccucagaga

SEQ ID NO: 85208 - RNA, 21 nt, Artificial Sequence
  Oligomer
ucauuuccaaggaugaguuca

SEQ ID NO: 85209 - RNA, 21 nt, Artificial Sequence
  Oligomer
uuauguuccgcauguacgacu

SEQ ID NO: 85210 - RNA, 21 nt, Artificial Sequence
  Oligomer
auccugguggucuucaugaaa

SEQ ID NO: 85211 - RNA, 21 nt, Artificial Sequence
  Oligomer
gaaauuucaagaggcuccagg

SEQ ID NO: 85212 - RNA, 21 nt, Artificial Sequence
  Oligomer
uauuuugagggcaguggauuu

SEQ ID NO: 85213 - RNA, 21 nt, Artificial Sequence
  Oligomer
gugaccgcuacugguuugaga

SEQ ID NO: 85214 - RNA, 21 nt, Artificial Sequence
  Oligomer
cuggcgucuacaugagaaaug

SEQ ID NO: 85215 - RNA, 21 nt, Artificial Sequence
  Oligomer
gaguauacaggauaccggcca

SEQ ID NO: 85216 - RNA, 21 nt, Artificial Sequence
  Oligomer
caucgcuguguaugaguggcu

SEQ ID NO: 85217 - RNA, 21 nt, Artificial Sequence
  Oligomer
ggcuaucacgugcuuucagac

SEQ ID NO: 85218 - RNA, 21 nt, Artificial Sequence
  Oligomer
aagccauuuacagaaacccac

SEQ ID NO: 85219 - RNA, 21 nt, Artificial Sequence
  Oligomer
agaacccucccuacucccaua

SEQ ID NO: 85220 - RNA, 21 nt, Artificial Sequence
  Oligomer
aguguaaggaugcagugggag

SEQ ID NO: 85221 - RNA, 21 nt, Artificial Sequence
  Oligomer
ugugugugcaugucuguaugu

SEQ ID NO: 85222 - RNA, 21 nt, Artificial Sequence
  Oligomer
agaagacaagcugaccugaca

SEQ ID NO: 85223 - RNA, 21 nt, Artificial Sequence
  Oligomer
auccgagagguggaggagaau

SEQ ID NO: 85224 - RNA, 21 nt, Artificial Sequence
  Oligomer
cuuugaguacaagucagggca

SEQ ID NO: 85225 - RNA, 21 nt, Artificial Sequence
  Oligomer
caugguagcuuugcccugauc

SEQ ID NO: 85226 - RNA, 21 nt, Artificial Sequence
  Oligomer
cuauuauuuucaucaugggcu

SEQ ID NO: 85227 - RNA, 21 nt, Artificial Sequence
  Oligomer
ugugggccauguggugaaugu

SEQ ID NO: 85228 - RNA, 21 nt, Artificial Sequence
  Oligomer
accgagagaaguuccaacgca

SEQ ID NO: 85229 - RNA, 21 nt, Artificial Sequence
  Oligomer
cauugagacugaguugacacc

SEQ ID NO: 85230 - RNA, 21 nt, Artificial Sequence
  Oligomer
auccuucaucgagaucuccaa

SEQ ID NO: 85231 - RNA, 21 nt, Artificial Sequence
  Oligomer
ccuuuuucaggcaccuuuucu

SEQ ID NO: 85232 - RNA, 21 nt, Artificial Sequence
  Oligomer
gauugaagaaauccgaaauac

SEQ ID NO: 85233 - RNA, 21 nt, Artificial Sequence
  Oligomer
cagcuuccugcagaaaacacu

SEQ ID NO: 85234 - RNA, 21 nt, Artificial Sequence
  Oligomer
ucaucgccaccuaccagaaca

SEQ ID NO: 85235 - RNA, 21 nt, Artificial Sequence
  Oligomer
caucuaugguuccucgcauuc

SEQ ID NO: 85236 - RNA, 21 nt, Artificial Sequence
  Oligomer
acaccacaacuaauuucaccc

SEQ ID NO: 85237 - RNA, 21 nt, Artificial Sequence
  Oligomer
gggcaaagugaaaccucugcu

SEQ ID NO: 85238 - RNA, 21 nt, Artificial Sequence
  Oligomer
cuagggacuagagugagaagu

SEQ ID NO: 85239 - RNA, 21 nt, Artificial Sequence
  Oligomer
ucucugauuucccaccuccca

SEQ ID NO: 85240 - RNA, 21 nt, Artificial Sequence
  Oligomer
cucacuucucccaccauuaug

SEQ ID NO: 85241 - RNA, 21 nt, Artificial Sequence
  Oligomer
uguacaucugugagcggcacu

SEQ ID NO: 85242 - RNA, 21 nt, Artificial Sequence
  Oligomer
ugucugugcacaucuacauca

SEQ ID NO: 85243 - RNA, 21 nt, Artificial Sequence
  Oligomer
gauccuggccaucauguaugu

SEQ ID NO: 85244 - RNA, 21 nt, Artificial Sequence
  Oligomer
ccaugaugaugggucugagcu

SEQ ID NO: 85245 - RNA, 21 nt, Artificial Sequence
  Oligomer
ggugaauguguaccuguucuc

SEQ ID NO: 85246 - RNA, 21 nt, Artificial Sequence
  Oligomer
ugggccauguggugaaugugu

SEQ ID NO: 85247 - RNA, 21 nt, Artificial Sequence
  Oligomer
gagaaaccuuccucaaccgcu

SEQ ID NO: 85248 - RNA, 21 nt, Artificial Sequence
  Oligomer
accuggugcugcuguuuaacu

SEQ ID NO: 85249 - RNA, 21 nt, Artificial Sequence
  Oligomer
uugagggcaguggauuuggcu

SEQ ID NO: 85250 - RNA, 21 nt, Artificial Sequence
  Oligomer
uugaacaauuugugcggcuac

SEQ ID NO: 85251 - RNA, 21 nt, Artificial Sequence
  Oligomer
uaagcacguucuuucaucaga

SEQ ID NO: 85252 - RNA, 21 nt, Artificial Sequence
  Oligomer
gcugaccugacaaguacuaug

SEQ ID NO: 85253 - RNA, 21 nt, Artificial Sequence
  Oligomer
aacaaccucauggagcacaga

SEQ ID NO: 85254 - RNA, 21 nt, Artificial Sequence
  Oligomer
aagugaaaccucugcuuccag

SEQ ID NO: 85255 - RNA, 21 nt, Artificial Sequence
  Oligomer
ugugucucagccuggagaaau

SEQ ID NO: 85256 - RNA, 21 nt, Artificial Sequence
  Oligomer
gauuucccaccucccaaccuu

SEQ ID NO: 85257 - RNA, 21 nt, Artificial Sequence
  Oligomer
cuucuucaacucccugcagga

SEQ ID NO: 85258 - RNA, 21 nt, Artificial Sequence
  Oligomer
guaagaagaucuacuucaucu

SEQ ID NO: 85259 - RNA, 21 nt, Artificial Sequence
  Oligomer
cuucaagucauccgucagcug

SEQ ID NO: 85260 - RNA, 21 nt, Artificial Sequence
  Oligomer
aagaagguaacgucauuccag

SEQ ID NO: 85261 - RNA, 21 nt, Artificial Sequence
  Oligomer
ugguggucuucaugaaaggcu

SEQ ID NO: 85262 - RNA, 21 nt, Artificial Sequence
  Oligomer
acugguuugagaacaccagga

SEQ ID NO: 85263 - RNA, 21 nt, Artificial Sequence
  Oligomer
cagcaccaucguccuugaaca

SEQ ID NO: 85264 - RNA, 21 nt, Artificial Sequence
  Oligomer
cuaucacgugcuuucagaccu

SEQ ID NO: 85265 - RNA, 21 nt, Artificial Sequence
  Oligomer
gagaccuuagcaacaccaucu

SEQ ID NO: 85266 - RNA, 21 nt, Artificial Sequence
  Oligomer
caugucuguauguguguuggg

SEQ ID NO: 85267 - RNA, 21 nt, Artificial Sequence
  Oligomer
accucugcuuccagacuucag

SEQ ID NO: 85268 - RNA, 21 nt, Artificial Sequence
  Oligomer
ugaccaagaauguggaaaagg

SEQ ID NO: 85269 - RNA, 21 nt, Artificial Sequence
  Oligomer
agggcuuugaguacaagucag

SEQ ID NO: 85270 - RNA, 21 nt, Artificial Sequence
  Oligomer
ugguagcuuugcccugaucca

SEQ ID NO: 85271 - RNA, 21 nt, Artificial Sequence
  Oligomer
cuuuccuggccucuuccauga

SEQ ID NO: 85272 - RNA, 21 nt, Artificial Sequence
  Oligomer
gcuucauugagaacuaccggc

SEQ ID NO: 85273 - RNA, 21 nt, Artificial Sequence
  Oligomer
ucaucaggaugcugagauccu

SEQ ID NO: 85274 - RNA, 21 nt, Artificial Sequence
  Oligomer
aauggccucauuuccaaggau

SEQ ID NO: 85275 - RNA, 21 nt, Artificial Sequence
  Oligomer
ugcuguuuaacuuggaggaag

SEQ ID NO: 85276 - RNA, 21 nt, Artificial Sequence
  Oligomer
augaccuggugcugcuguuua

SEQ ID NO: 85277 - RNA, 21 nt, Artificial Sequence
  Oligomer
ugugcucccucuguuguucgu

SEQ ID NO: 85278 - RNA, 21 nt, Artificial Sequence
  Oligomer
ucagcaccaucguccuugaac

SEQ ID NO: 85279 - RNA, 21 nt, Artificial Sequence
  Oligomer
caaugacacuguacuggaggc

SEQ ID NO: 85280 - RNA, 21 nt, Artificial Sequence
  Oligomer
caugagaaaugccagcugcca

SEQ ID NO: 85281 - RNA, 21 nt, Artificial Sequence
  Oligomer
aaaacacucccggaguauaca

SEQ ID NO: 85282 - RNA, 21 nt, Artificial Sequence
  Oligomer
uaugguuccucgcauuccugg

SEQ ID NO: 85283 - RNA, 21 nt, Artificial Sequence
  Oligomer
agguuuuaagcacguucuuuc

SEQ ID NO: 85284 - RNA, 21 nt, Artificial Sequence
  Oligomer
acuaugugugugcaugucugu

SEQ ID NO: 85285 - RNA, 21 nt, Artificial Sequence
  Oligomer
caaccucauggagcacagaug

SEQ ID NO: 85286 - RNA, 21 nt, Artificial Sequence
  Oligomer
ggcaaagugaaaccucugcuu

SEQ ID NO: 85287 - RNA, 21 nt, Artificial Sequence
  Oligomer
cuucucccaccauuaugagaa

SEQ ID NO: 85288 - RNA, 21 nt, Artificial Sequence
  Oligomer
uuugaugggugguacaacaac

SEQ ID NO: 85289 - RNA, 21 nt, Artificial Sequence
  Oligomer
aguuugaguggcuggcugaca

SEQ ID NO: 85290 - RNA, 21 nt, Artificial Sequence
  Oligomer
ggugacagaugugccagauac

SEQ ID NO: 85291 - RNA, 21 nt, Artificial Sequence
  Oligomer
cuucuuccuggucccagcaau

SEQ ID NO: 85292 - RNA, 21 nt, Artificial Sequence
  Oligomer
uccugcucuauguccugcuca

SEQ ID NO: 85293 - RNA, 21 nt, Artificial Sequence
  Oligomer
augucuuugccucccaccacu

SEQ ID NO: 85294 - RNA, 21 nt, Artificial Sequence
  Oligomer
cagacggugcaacaguucaag

SEQ ID NO: 85295 - RNA, 21 nt, Artificial Sequence
  Oligomer
gaaguuccaacgcagcugucu

SEQ ID NO: 85296 - RNA, 21 nt, Artificial Sequence
  Oligomer
agaagguaacgucauuccagc

SEQ ID NO: 85297 - RNA, 21 nt, Artificial Sequence
  Oligomer
agucucgccuuauguuccgca

SEQ ID NO: 85298 - RNA, 21 nt, Artificial Sequence
  Oligomer
uggacauccugguggucuuca

SEQ ID NO: 85299 - RNA, 21 nt, Artificial Sequence
  Oligomer
guuguucgugacuauuuugag

SEQ ID NO: 85300 - RNA, 21 nt, Artificial Sequence
  Oligomer
ugagcaguuccuguccaccau

SEQ ID NO: 85301 - RNA, 21 nt, Artificial Sequence
  Oligomer
uaacaccacaacuaauuucac

SEQ ID NO: 85302 - RNA, 21 nt, Artificial Sequence
  Oligomer
ugaugggugguacaacaaccu

SEQ ID NO: 85303 - RNA, 21 nt, Artificial Sequence
  Oligomer
cccuggcaugaccaagaaugu

SEQ ID NO: 85304 - RNA, 21 nt, Artificial Sequence
  Oligomer
ccuuugagcccuucuucaacu

SEQ ID NO: 85305 - RNA, 21 nt, Artificial Sequence
  Oligomer
uacccaaagcuguaccuugau

SEQ ID NO: 85306 - RNA, 21 nt, Artificial Sequence
  Oligomer
auuacuggugguucuuccaga

SEQ ID NO: 85307 - RNA, 21 nt, Artificial Sequence
  Oligomer
cugcgagaaaccuuccucaac

SEQ ID NO: 85308 - RNA, 21 nt, Artificial Sequence
  Oligomer
uuuggcaagaagguaacguca

SEQ ID NO: 85309 - RNA, 21 nt, Artificial Sequence
  Oligomer
uccaggacaaggaggaacuga

SEQ ID NO: 85310 - RNA, 21 nt, Artificial Sequence
  Oligomer
gaguucaucaggaugcugaga

SEQ ID NO: 85311 - RNA, 21 nt, Artificial Sequence
  Oligomer
ggaugaguucaucaggaugcu

SEQ ID NO: 85312 - RNA, 21 nt, Artificial Sequence
  Oligomer
aggcauggaagcuuuggaaug

SEQ ID NO: 85313 - RNA, 21 nt, Artificial Sequence
  Oligomer
gacuuauccuggcuagagcug

SEQ ID NO: 85314 - RNA, 21 nt, Artificial Sequence
  Oligomer
ggagcaaugacacuguacugg

SEQ ID NO: 85315 - RNA, 21 nt, Artificial Sequence
  Oligomer
ucaucaaucggaacucaagug

SEQ ID NO: 85316 - RNA, 21 nt, Artificial Sequence
  Oligomer
auggcaagccauuuacagaaa

SEQ ID NO: 85317 - RNA, 21 nt, Artificial Sequence
  Oligomer
ucccauaccuccuccucuucu

SEQ ID NO: 85318 - RNA, 21 nt, Artificial Sequence
  Oligomer
uggcaucuuagaacccucccu

SEQ ID NO: 85319 - RNA, 21 nt, Artificial Sequence
  Oligomer
aaccucugcuuccagacuuca

SEQ ID NO: 85320 - RNA, 21 nt, Artificial Sequence
  Oligomer
cagugucuagggacuagagug

SEQ ID NO: 85321 - RNA, 21 nt, Artificial Sequence
  Oligomer
gugucucagccuggagaaaug

SEQ ID NO: 85322 - RNA, 21 nt, Artificial Sequence
  Oligomer
uguucuguaagaagaucuacu

SEQ ID NO: 85323 - RNA, 21 nt, Artificial Sequence
  Oligomer
cuugauggaccauuuggagag

SEQ ID NO: 85324 - RNA, 21 nt, Artificial Sequence
  Oligomer
uccuggucccagcaaucaucu

SEQ ID NO: 85325 - RNA, 21 nt, Artificial Sequence
  Oligomer
aacaguucaagcgcuucauug

SEQ ID NO: 85326 - RNA, 21 nt, Artificial Sequence
  Oligomer
gaaaagucucgccuuauguuc

SEQ ID NO: 85327 - RNA, 21 nt, Artificial Sequence
  Oligomer
aauggcuaccuguccuuccga

SEQ ID NO: 85328 - RNA, 21 nt, Artificial Sequence
  Oligomer
acauguuuguggaguccaugu

SEQ ID NO: 85329 - RNA, 21 nt, Artificial Sequence
  Oligomer
ccuccuggagaccuuuuucag

SEQ ID NO: 85330 - RNA, 21 nt, Artificial Sequence
  Oligomer
accuccuggagaccuuuuuca

SEQ ID NO: 85331 - RNA, 21 nt, Artificial Sequence
  Oligomer
uccacagaaggucaacuucgu

SEQ ID NO: 85332 - RNA, 21 nt, Artificial Sequence
  Oligomer
gaaggagauugaagaaauccg

SEQ ID NO: 85333 - RNA, 21 nt, Artificial Sequence
  Oligomer
aaccaggacuuauccuggcua

SEQ ID NO: 85334 - RNA, 21 nt, Artificial Sequence
  Oligomer
uguacaaccaggacuuauccu

SEQ ID NO: 85335 - RNA, 21 nt, Artificial Sequence
  Oligomer
ugaccugacaaguacuaugug

SEQ ID NO: 85336 - RNA, 21 nt, Artificial Sequence
  Oligomer
gguacaacaaccucauggagc

SEQ ID NO: 85337 - RNA, 21 nt, Artificial Sequence
  Oligomer
gugucuagggacuagagugag

SEQ ID NO: 85338 - RNA, 21 nt, Artificial Sequence
  Oligomer
ucacuucucccaccauuauga

SEQ ID NO: 85339 - RNA, 21 nt, Artificial Sequence
  Oligomer
caagaauguggaaaaggccug

SEQ ID NO: 85340 - RNA, 21 nt, Artificial Sequence
  Oligomer
aagguucugaaccggagucua

SEQ ID NO: 85341 - RNA, 21 nt, Artificial Sequence
  Oligomer
aggugucaguguuagugggag

SEQ ID NO: 85342 - RNA, 21 nt, Artificial Sequence
  Oligomer
gaguggcauaaguuugaggug

SEQ ID NO: 85343 - RNA, 21 nt, Artificial Sequence
  Oligomer
aagcuguaccuugauggacca

SEQ ID NO: 85344 - RNA, 21 nt, Artificial Sequence
  Oligomer
ucuuccuggucccagcaauca

SEQ ID NO: 85345 - RNA, 21 nt, Artificial Sequence
  Oligomer
gucuuacacagugugggccau

SEQ ID NO: 85346 - RNA, 21 nt, Artificial Sequence
  Oligomer
guugacaccucagagacugca

SEQ ID NO: 85347 - RNA, 21 nt, Artificial Sequence
  Oligomer
acaucagccaggauaugaucu

SEQ ID NO: 85348 - RNA, 21 nt, Artificial Sequence
  Oligomer
gaggaaaagucucgccuuaug

SEQ ID NO: 85349 - RNA, 21 nt, Artificial Sequence
  Oligomer
aauccgaaauaccacccugca

SEQ ID NO: 85350 - RNA, 21 nt, Artificial Sequence
  Oligomer
acaggauaccggccauuucug

SEQ ID NO: 85351 - RNA, 21 nt, Artificial Sequence
  Oligomer
aagguuuuaagcacguucuuu

SEQ ID NO: 85352 - RNA, 21 nt, Artificial Sequence
  Oligomer
uaugugugugcaugucuguau

SEQ ID NO: 85353 - RNA, 21 nt, Artificial Sequence
  Oligomer
ugacaaguacuaugugugugc

SEQ ID NO: 85354 - RNA, 21 nt, Artificial Sequence
  Oligomer
aagacaagcugaccugacaag

SEQ ID NO: 85355 - RNA, 21 nt, Artificial Sequence
  Oligomer
aaacaaaucucagaagacaag

SEQ ID NO: 85356 - RNA, 21 nt, Artificial Sequence
  Oligomer
gaugggugguacaacaaccuc

SEQ ID NO: 85357 - RNA, 21 nt, Artificial Sequence
  Oligomer
ucuguaagaagaucuacuuca

SEQ ID NO: 85358 - RNA, 21 nt, Artificial Sequence
  Oligomer
aagaccuggucuucaagucau

SEQ ID NO: 85359 - RNA, 21 nt, Artificial Sequence
  Oligomer
cauccaugguagcuuugcccu

SEQ ID NO: 85360 - RNA, 21 nt, Artificial Sequence
  Oligomer
aguugacaccucagagacugc

SEQ ID NO: 85361 - RNA, 21 nt, Artificial Sequence
  Oligomer
cuccggaugagaaauuucaag

SEQ ID NO: 85362 - RNA, 21 nt, Artificial Sequence
  Oligomer
guucagcaccaucguccuuga

SEQ ID NO: 85363 - RNA, 21 nt, Artificial Sequence
  Oligomer
cccaagccuacaaagugcuga

SEQ ID NO: 85364 - RNA, 21 nt, Artificial Sequence
  Oligomer
cccauggcaagccauuuacag

SEQ ID NO: 85365 - RNA, 21 nt, Artificial Sequence
  Oligomer
acucccauaccuccuccucuu

SEQ ID NO: 85366 - RNA, 21 nt, Artificial Sequence
  Oligomer
accugacaaguacuaugugug

SEQ ID NO: 85367 - RNA, 21 nt, Artificial Sequence
  Oligomer
ucagaagacaagcugaccuga

SEQ ID NO: 85368 - RNA, 21 nt, Artificial Sequence
  Oligomer
ucugauuucccaccucccaac

SEQ ID NO: 85369 - RNA, 21 nt, Artificial Sequence
  Oligomer
uugaguggcuggcugacauca

SEQ ID NO: 85370 - RNA, 21 nt, Artificial Sequence
  Oligomer
ugcucuauguccugcucauca

SEQ ID NO: 85371 - RNA, 21 nt, Artificial Sequence
  Oligomer
cauguucuccuacaucuugcu

SEQ ID NO: 85372 - RNA, 21 nt, Artificial Sequence
  Oligomer
agcgcuucauugagaacuacc

SEQ ID NO: 85373 - RNA, 21 nt, Artificial Sequence
  Oligomer
caucgagaucuccaacaacug

SEQ ID NO: 85374 - RNA, 21 nt, Artificial Sequence
  Oligomer
gacaaggauggcaauggcuac

SEQ ID NO: 85375 - RNA, 21 nt, Artificial Sequence
  Oligomer
ugaugagagcagcugugacac

SEQ ID NO: 85376 - RNA, 21 nt, Artificial Sequence
  Oligomer
ucuguugcuucccuuugguga

SEQ ID NO: 85377 - RNA, 21 nt, Artificial Sequence
  Oligomer
cucuguugcuucccuuuggug

SEQ ID NO: 85378 - RNA, 21 nt, Artificial Sequence
  Oligomer
acgugcuggucgcuguuauca

SEQ ID NO: 85379 - RNA, 21 nt, Artificial Sequence
  Oligomer
acaccaggaaugggcuguucu

SEQ ID NO: 85380 - RNA, 21 nt, Artificial Sequence
  Oligomer
agcaaugacacuguacuggag

SEQ ID NO: 85381 - RNA, 21 nt, Artificial Sequence
  Oligomer
ugaaguuuucccgcacagacc

SEQ ID NO: 85382 - RNA, 21 nt, Artificial Sequence
  Oligomer
aguuccucaacauucgcaucc

SEQ ID NO: 85383 - RNA, 21 nt, Artificial Sequence
  Oligomer
cugagaaaccgcacaguguug

SEQ ID NO: 85384 - RNA, 21 nt, Artificial Sequence
  Oligomer
gaugcuggcaucuuagaaccc

SEQ ID NO: 85385 - RNA, 21 nt, Artificial Sequence
  Oligomer
ugugugcaugucuguaugugu

SEQ ID NO: 85386 - RNA, 21 nt, Artificial Sequence
  Oligomer
cugaccugacaaguacuaugu

SEQ ID NO: 85387 - RNA, 21 nt, Artificial Sequence
  Oligomer
ugaaccggagucuauucacag

SEQ ID NO: 85388 - RNA, 21 nt, Artificial Sequence
  Oligomer
uggugaauguguaccuguucu

SEQ ID NO: 85389 - RNA, 21 nt, Artificial Sequence
  Oligomer
augaucugucccucucccaga

SEQ ID NO: 85390 - RNA, 21 nt, Artificial Sequence
  Oligomer
aaggaugaguucaucaggaug

SEQ ID NO: 85391 - RNA, 21 nt, Artificial Sequence
  Oligomer
uuuucucccaggugcuggaca

SEQ ID NO: 85392 - RNA, 21 nt, Artificial Sequence
  Oligomer
ugcugcuguuuaacuuggagg

SEQ ID NO: 85393 - RNA, 21 nt, Artificial Sequence
  Oligomer
uggugcugcuguuuaacuugg

SEQ ID NO: 85394 - RNA, 21 nt, Artificial Sequence
  Oligomer
aguaugaccuggugcugcugu

SEQ ID NO: 85395 - RNA, 21 nt, Artificial Sequence
  Oligomer
cacagaaggucaacuucgucc

SEQ ID NO: 85396 - RNA, 21 nt, Artificial Sequence
  Oligomer
ggaagcuuuggaauggcaagg

SEQ ID NO: 85397 - RNA, 21 nt, Artificial Sequence
  Oligomer
ugucuuugucuggcauaaagg

SEQ ID NO: 85398 - RNA, 21 nt, Artificial Sequence
  Oligomer
acugggcuugucucccauuac

SEQ ID NO: 85399 - RNA, 21 nt, Artificial Sequence
  Oligomer
gagcacccaagccuacaaagu

SEQ ID NO: 85400 - RNA, 21 nt, Artificial Sequence
  Oligomer
ucaaucggaacucaagugucu

SEQ ID NO: 85401 - RNA, 21 nt, Artificial Sequence
  Oligomer
cuucuuuggcuaucacgugcu

SEQ ID NO: 85402 - RNA, 21 nt, Artificial Sequence
  Oligomer
uaugcaaugcuccucagcccu

SEQ ID NO: 85403 - RNA, 21 nt, Artificial Sequence
  Oligomer
uuuaagcacguucuuucauca

SEQ ID NO: 85404 - RNA, 21 nt, Artificial Sequence
  Oligomer
agaaacaaaucucagaagaca

SEQ ID NO: 85405 - RNA, 21 nt, Artificial Sequence
  Oligomer
uucccaccucccaaccuuguu

SEQ ID NO: 85406 - RNA, 21 nt, Artificial Sequence
  Oligomer
cugaaccggagucuauucaca

SEQ ID NO: 85407 - RNA, 21 nt, Artificial Sequence
  Oligomer
uaccuugauggaccauuugga

SEQ ID NO: 85408 - RNA, 21 nt, Artificial Sequence
  Oligomer
guaccuugauggaccauuugg

SEQ ID NO: 85409 - RNA, 21 nt, Artificial Sequence
  Oligomer
uuuccuggccucuuccaugau

SEQ ID NO: 85410 - RNA, 21 nt, Artificial Sequence
  Oligomer
cucuuuccuggccucuuccau

SEQ ID NO: 85411 - RNA, 21 nt, Artificial Sequence
  Oligomer
aaaccuuccucaaccgcuacg

SEQ ID NO: 85412 - RNA, 21 nt, Artificial Sequence
  Oligomer
gugccugaagucaucaaggac

SEQ ID NO: 85413 - RNA, 21 nt, Artificial Sequence
  Oligomer
gccuuauguuccgcauguacg

SEQ ID NO: 85414 - RNA, 21 nt, Artificial Sequence
  Oligomer
ucugcagcccaaugucuuugu

SEQ ID NO: 85415 - RNA, 21 nt, Artificial Sequence
  Oligomer
gcucugcagcccaaugucuuu

SEQ ID NO: 85416 - RNA, 21 nt, Artificial Sequence
  Oligomer
ugcucugcagcccaaugucuu

SEQ ID NO: 85417 - RNA, 21 nt, Artificial Sequence
  Oligomer
auugaagaaauccgaaauacc

SEQ ID NO: 85418 - RNA, 21 nt, Artificial Sequence
  Oligomer
uccaagaaggagauugaagaa

SEQ ID NO: 85419 - RNA, 21 nt, Artificial Sequence
  Oligomer
uuuacagaaacccacucggca

SEQ ID NO: 85420 - RNA, 21 nt, Artificial Sequence
  Oligomer
gugcaugucuguauguguguu

SEQ ID NO: 85421 - RNA, 21 nt, Artificial Sequence
  Oligomer
caaagugaaaccucugcuucc

SEQ ID NO: 85422 - RNA, 21 nt, Artificial Sequence
  Oligomer
cuggcaugaccaagaaugugg

SEQ ID NO: 85423 - RNA, 21 nt, Artificial Sequence
  Oligomer
cauccucaaagaccuggucuu

SEQ ID NO: 85424 - RNA, 21 nt, Artificial Sequence
  Oligomer
ugaggugucaguguuaguggg

SEQ ID NO: 85425 - RNA, 21 nt, Artificial Sequence
  Oligomer
gugacagaugugccagauacc

SEQ ID NO: 85426 - RNA, 21 nt, Artificial Sequence
  Oligomer
caugaugaugggucugagcuc

SEQ ID NO: 85427 - RNA, 21 nt, Artificial Sequence
  Oligomer
aucucuuucauguucuccuac

SEQ ID NO: 85428 - RNA, 21 nt, Artificial Sequence
  Oligomer
ugcaacaguucaagcgcuuca

SEQ ID NO: 85429 - RNA, 21 nt, Artificial Sequence
  Oligomer
agaucuccaacaacugccugu

SEQ ID NO: 85430 - RNA, 21 nt, Artificial Sequence
  Oligomer
aaggcucuccugaggaaaagu

SEQ ID NO: 85431 - RNA, 21 nt, Artificial Sequence
  Oligomer
cuggagaccuuuuucaggcac

SEQ ID NO: 85432 - RNA, 21 nt, Artificial Sequence
  Oligomer
augucuuugucuggcauaaag

SEQ ID NO: 85433 - RNA, 21 nt, Artificial Sequence
  Oligomer
aaugggcuguucuccaagaag

SEQ ID NO: 85434 - RNA, 21 nt, Artificial Sequence
  Oligomer
ucaagugucuccagagcucuc

SEQ ID NO: 85435 - RNA, 21 nt, Artificial Sequence
  Oligomer
gaaaacacucccggaguauac

SEQ ID NO: 85436 - RNA, 21 nt, Artificial Sequence
  Oligomer
uuggcuaucacgugcuuucag

SEQ ID NO: 85437 - RNA, 21 nt, Artificial Sequence
  Oligomer
uauguaugcaaugcuccucag

SEQ ID NO: 85438 - RNA, 21 nt, Artificial Sequence
  Oligomer
uuaagcacguucuuucaucag

SEQ ID NO: 85439 - RNA, 21 nt, Artificial Sequence
  Oligomer
ggaugcuggcaucuuagaacc

SEQ ID NO: 85440 - RNA, 21 nt, Artificial Sequence
  Oligomer
agggacuagagugagaaguag

SEQ ID NO: 85441 - RNA, 21 nt, Artificial Sequence
  Oligomer
ucagccuucucugauuuccca

SEQ ID NO: 85442 - RNA, 21 nt, Artificial Sequence
  Oligomer
acaccucaccucuguucuucc

SEQ ID NO: 85443 - RNA, 21 nt, Artificial Sequence
  Oligomer
uucugaaccggagucuauuca

SEQ ID NO: 85444 - RNA, 21 nt, Artificial Sequence
  Oligomer
gaagaucuacuucaucugggu

SEQ ID NO: 85445 - RNA, 21 nt, Artificial Sequence
  Oligomer
accucuacauccugcucuaug

SEQ ID NO: 85446 - RNA, 21 nt, Artificial Sequence
  Oligomer
cuuccugcgagaaaccuuccu

SEQ ID NO: 85447 - RNA, 21 nt, Artificial Sequence
  Oligomer
acaaggaggaacugacauggg

SEQ ID NO: 85448 - RNA, 21 nt, Artificial Sequence
  Oligomer
cucgccuuauguuccgcaugu

SEQ ID NO: 85449 - RNA, 21 nt, Artificial Sequence
  Oligomer
auguucucucuggcugacaag

SEQ ID NO: 85450 - RNA, 21 nt, Artificial Sequence
  Oligomer
uguucgugacuauuuugaggg

SEQ ID NO: 85451 - RNA, 21 nt, Artificial Sequence
  Oligomer
ucuccaagaaggagauugaag

SEQ ID NO: 85452 - RNA, 21 nt, Artificial Sequence
  Oligomer
guucuccaagaaggagauuga

SEQ ID NO: 85453 - RNA, 21 nt, Artificial Sequence
  Oligomer
ugcugaagauguggaugcacu

SEQ ID NO: 85454 - RNA, 21 nt, Artificial Sequence
  Oligomer
aacucaagugucuccagagcu

SEQ ID NO: 85455 - RNA, 21 nt, Artificial Sequence
  Oligomer
ugagaaaugccagcugccacu

SEQ ID NO: 85456 - RNA, 21 nt, Artificial Sequence
  Oligomer
caaaugccuugcaggagguag

SEQ ID NO: 85457 - RNA, 21 nt, Artificial Sequence
  Oligomer
ugcuuccagacuucagaaaca

SEQ ID NO: 85458 - RNA, 21 nt, Artificial Sequence
  Oligomer
aaccuuguuccagguggccau

SEQ ID NO: 85459 - RNA, 21 nt, Artificial Sequence
  Oligomer
uaucuggcacaucugucaccc

SEQ ID NO: 85460 - RNA, 21 nt, Artificial Sequence
  Oligomer
acaaauuguucaaggacgaug

SEQ ID NO: 85461 - RNA, 21 nt, Artificial Sequence
  Oligomer
ucuaagaugccagcauccaug

SEQ ID NO: 85462 - RNA, 21 nt, Artificial Sequence
  Oligomer
ugggugaaauuaguuguggug

SEQ ID NO: 85463 - RNA, 21 nt, Artificial Sequence
  Oligomer
cuugaguuccgauugaugacc

SEQ ID NO: 85464 - RNA, 21 nt, Artificial Sequence
  Oligomer
uuggcagcugacggaugacuu

SEQ ID NO: 85465 - RNA, 21 nt, Artificial Sequence
  Oligomer
ucccaugucaguuccuccuug

SEQ ID NO: 85466 - RNA, 21 nt, Artificial Sequence
  Oligomer
ugccauuccaaagcuuccaug

SEQ ID NO: 85467 - RNA, 21 nt, Artificial Sequence
  Oligomer
ucuccaaaugguccaucaagg

SEQ ID NO: 85468 - RNA, 21 nt, Artificial Sequence
  Oligomer
uuguuguaccacccaucaaau

SEQ ID NO: 85469 - RNA, 21 nt, Artificial Sequence
  Oligomer
uugggaggugggaaaucagag

SEQ ID NO: 85470 - RNA, 21 nt, Artificial Sequence
  Oligomer
uuuuccucaggagagccuuuc

SEQ ID NO: 85471 - RNA, 21 nt, Artificial Sequence
  Oligomer
ugaaauuaguugugguguuag

SEQ ID NO: 85472 - RNA, 21 nt, Artificial Sequence
  Oligomer
cgcacaaauuguucaaggacg

SEQ ID NO: 85473 - RNA, 21 nt, Artificial Sequence
  Oligomer
auuaguugugguguuagacug

SEQ ID NO: 85474 - RNA, 21 nt, Artificial Sequence
  Oligomer
ucugugaugcccgugugaugu

SEQ ID NO: 85475 - RNA, 21 nt, Artificial Sequence
  Oligomer
augcacacacauaguacuugu

SEQ ID NO: 85476 - RNA, 21 nt, Artificial Sequence
  Oligomer
uccucaggagagccuuucaug

SEQ ID NO: 85477 - RNA, 21 nt, Artificial Sequence
  Oligomer
uggucugugcgggaaaacuuc

SEQ ID NO: 85478 - RNA, 21 nt, Artificial Sequence
  Oligomer
ucccgcacaucuucaaccaac

SEQ ID NO: 85479 - RNA, 21 nt, Artificial Sequence
  Oligomer
acugcauccuuacacucaccg

SEQ ID NO: 85480 - RNA, 21 nt, Artificial Sequence
  Oligomer
augucaguuccuccuuguccu

SEQ ID NO: 85481 - RNA, 21 nt, Artificial Sequence
  Oligomer
ucccacugcauccuuacacuc

SEQ ID NO: 85482 - RNA, 21 nt, Artificial Sequence
  Oligomer
uguaagacugugaggacgaug

SEQ ID NO: 85483 - RNA, 21 nt, Artificial Sequence
  Oligomer
uuggaaaugaggccauuccca

SEQ ID NO: 85484 - RNA, 21 nt, Artificial Sequence
  Oligomer
uuauuuggaagggagacuacu

SEQ ID NO: 85485 - RNA, 21 nt, Artificial Sequence
  Oligomer
cuaagaugccagcauccaugc

SEQ ID NO: 85486 - RNA, 21 nt, Artificial Sequence
  Oligomer
uugucaggucagcuugucuuc

SEQ ID NO: 85487 - RNA, 21 nt, Artificial Sequence
  Oligomer
ucucaaugaagcgcuugaacu

SEQ ID NO: 85488 - RNA, 21 nt, Artificial Sequence
  Oligomer
ucaaaauagucacgaacaaca

SEQ ID NO: 85489 - RNA, 21 nt, Artificial Sequence
  Oligomer
ucuuacagaacacuuggcagc

SEQ ID NO: 85490 - RNA, 21 nt, Artificial Sequence
  Oligomer
ucauauccuggcugauguagg

SEQ ID NO: 85491 - RNA, 21 nt, Artificial Sequence
  Oligomer
uccuugaugacuucaggcacc

SEQ ID NO: 85492 - RNA, 21 nt, Artificial Sequence
  Oligomer
ugaaggaucucagcauccuga

SEQ ID NO: 85493 - RNA, 21 nt, Artificial Sequence
  Oligomer
uagccauugccauccuuguca

SEQ ID NO: 85494 - RNA, 21 nt, Artificial Sequence
  Oligomer
ucuccuucuuggagaacagcc

SEQ ID NO: 85495 - RNA, 21 nt, Artificial Sequence
  Oligomer
uguugaugagcugacaggccu

SEQ ID NO: 85496 - RNA, 21 nt, Artificial Sequence
  Oligomer
uguuguaccacccaucaaauc

SEQ ID NO: 85497 - RNA, 21 nt, Artificial Sequence
  Oligomer
ugggagagggacagaucauau

SEQ ID NO: 85498 - RNA, 21 nt, Artificial Sequence
  Oligomer
ucccguagccgcacaaauugu

SEQ ID NO: 85499 - RNA, 21 nt, Artificial Sequence
  Oligomer
acaucuucagcacuuuguagg

SEQ ID NO: 85500 - RNA, 21 nt, Artificial Sequence
  Oligomer
ucuguaaauggcuugccaugg

SEQ ID NO: 85501 - RNA, 21 nt, Artificial Sequence
  Oligomer
uucagaaccuucuggaagugc

SEQ ID NO: 85502 - RNA, 21 nt, Artificial Sequence
  Oligomer
ucguacaugcggaacauaagg

SEQ ID NO: 85503 - RNA, 21 nt, Artificial Sequence
  Oligomer
uucaugaagaccaccaggaug

SEQ ID NO: 85504 - RNA, 21 nt, Artificial Sequence
  Oligomer
aaaaccuugggugaaauuagu

SEQ ID NO: 85505 - RNA, 21 nt, Artificial Sequence
  Oligomer
uacacgccaucugcauagcug

SEQ ID NO: 85506 - RNA, 21 nt, Artificial Sequence
  Oligomer
acuaacacugacaccucaaac

SEQ ID NO: 85507 - RNA, 21 nt, Artificial Sequence
  Oligomer
ugcgaauguugaggaacucgg

SEQ ID NO: 85508 - RNA, 21 nt, Artificial Sequence
  Oligomer
augaaagaacgugcuuaaaac

SEQ ID NO: 85509 - RNA, 21 nt, Artificial Sequence
  Oligomer
uuaguugugguguuagacugg

SEQ ID NO: 85510 - RNA, 21 nt, Artificial Sequence
  Oligomer
acacacauacagacaugcaca

SEQ ID NO: 85511 - RNA, 21 nt, Artificial Sequence
  Oligomer
uagaaugucccaaaauggaga

SEQ ID NO: 85512 - RNA, 21 nt, Artificial Sequence
  Oligomer
agcugcguuggaacuucucuc

SEQ ID NO: 85513 - RNA, 21 nt, Artificial Sequence
  Oligomer
ucgaugaaggaucucagcauc

SEQ ID NO: 85514 - RNA, 21 nt, Artificial Sequence
  Oligomer
ucuccuuuaugccagacaaag

SEQ ID NO: 85515 - RNA, 21 nt, Artificial Sequence
  Oligomer
ucaaccaacacaugguccucu

SEQ ID NO: 85516 - RNA, 21 nt, Artificial Sequence
  Oligomer
ucugaaagcacgugauagcca

SEQ ID NO: 85517 - RNA, 21 nt, Artificial Sequence
  Oligomer
uuggagaacagcccauuccug

SEQ ID NO: 85518 - RNA, 21 nt, Artificial Sequence
  Oligomer
aguacuugucaggucagcuug

SEQ ID NO: 85519 - RNA, 21 nt, Artificial Sequence
  Oligomer
cuuuggguaucuggcacaucu

SEQ ID NO: 85520 - RNA, 21 nt, Artificial Sequence
  Oligomer
uggguaucuggcacaucuguc

SEQ ID NO: 85521 - RNA, 21 nt, Artificial Sequence
  Oligomer
ucucacucuagucccuagaca

SEQ ID NO: 85522 - RNA, 21 nt, Artificial Sequence
  Oligomer
uucuccaggcugagacacauc

SEQ ID NO: 85523 - RNA, 21 nt, Artificial Sequence
  Oligomer
augacguuaccuucuugccaa

SEQ ID NO: 85524 - RNA, 21 nt, Artificial Sequence
  Oligomer
ugucacagcugcucucaucag

SEQ ID NO: 85525 - RNA, 21 nt, Artificial Sequence
  Oligomer
ugcuggacaggacgaaguuga

SEQ ID NO: 85526 - RNA, 21 nt, Artificial Sequence
  Oligomer
uugcugggaccaggaagaaga

SEQ ID NO: 85527 - RNA, 21 nt, Artificial Sequence
  Oligomer
uauuguggucccgcagcauga

SEQ ID NO: 85528 - RNA, 21 nt, Artificial Sequence
  Oligomer
uguuggagaucucgaugaagg

SEQ ID NO: 85529 - RNA, 21 nt, Artificial Sequence
  Oligomer
uuccucaggagagccuuucau

SEQ ID NO: 85530 - RNA, 21 nt, Artificial Sequence
  Oligomer
uugucagccagagagaacaug

SEQ ID NO: 85531 - RNA, 21 nt, Artificial Sequence
  Oligomer
ugccugaaaaaggucuccagg

SEQ ID NO: 85532 - RNA, 21 nt, Artificial Sequence
  Oligomer
acuugaguuccgauugaugac

SEQ ID NO: 85533 - RNA, 21 nt, Artificial Sequence
  Oligomer
uugaugagcugacaggccuuu

SEQ ID NO: 85534 - RNA, 21 nt, Artificial Sequence
  Oligomer
aauagacuccgguucagaacc

SEQ ID NO: 85535 - RNA, 21 nt, Artificial Sequence
  Oligomer
uccgguucagaaccuucugga

SEQ ID NO: 85536 - RNA, 21 nt, Artificial Sequence
  Oligomer
uggagaacagguacacauuca

SEQ ID NO: 85537 - RNA, 21 nt, Artificial Sequence
  Oligomer
ugaaagagaugcuggcugcug

SEQ ID NO: 85538 - RNA, 21 nt, Artificial Sequence
  Oligomer
uccugaugaacucauccuugg

SEQ ID NO: 85539 - RNA, 21 nt, Artificial Sequence
  Oligomer
ucaaagucguacaugcggaac

SEQ ID NO: 85540 - RNA, 21 nt, Artificial Sequence
  Oligomer
uccacaucuucagcacuuugu

SEQ ID NO: 85541 - RNA, 21 nt, Artificial Sequence
  Oligomer
aauuaguugugguguuagacu

SEQ ID NO: 85542 - RNA, 21 nt, Artificial Sequence
  Oligomer
agacaugcacacacauaguac

SEQ ID NO: 85543 - RNA, 21 nt, Artificial Sequence
  Oligomer
uguagaugugcacagacacca

SEQ ID NO: 85544 - RNA, 21 nt, Artificial Sequence
  Oligomer
uggugggaggcaaagacauac

SEQ ID NO: 85545 - RNA, 21 nt, Artificial Sequence
  Oligomer
uccuuuaugccagacaaagac

SEQ ID NO: 85546 - RNA, 21 nt, Artificial Sequence
  Oligomer
uaguugugguguuagacuggg

SEQ ID NO: 85547 - RNA, 21 nt, Artificial Sequence
  Oligomer
uaguacuugucaggucagcuu

SEQ ID NO: 85548 - RNA, 21 nt, Artificial Sequence
  Oligomer
ucugagauuuguuucugaagu

SEQ ID NO: 85549 - RNA, 21 nt, Artificial Sequence
  Oligomer
uuucugaagucuggaagcaga

SEQ ID NO: 85550 - RNA, 21 nt, Artificial Sequence
  Oligomer
ucugaagucuggaagcagagg

SEQ ID NO: 85551 - RNA, 21 nt, Artificial Sequence
  Oligomer
ucaaaccucugcucaacuggg

SEQ ID NO: 85552 - RNA, 21 nt, Artificial Sequence
  Oligomer
ugaugagcugacaggccuuuu

SEQ ID NO: 85553 - RNA, 21 nt, Artificial Sequence
  Oligomer
acaugaaagagaugcuggcug

SEQ ID NO: 85554 - RNA, 21 nt, Artificial Sequence
  Oligomer
ugaagcggagcucgcuauugu

SEQ ID NO: 85555 - RNA, 21 nt, Artificial Sequence
  Oligomer
ugaagugaaaaucuucccaug

SEQ ID NO: 85556 - RNA, 21 nt, Artificial Sequence
  Oligomer
ucucgaugaaggaucucagca

SEQ ID NO: 85557 - RNA, 21 nt, Artificial Sequence
  Oligomer
uucuguaaauggcuugccaug

SEQ ID NO: 85558 - RNA, 21 nt, Artificial Sequence
  Oligomer
uggaugaugagcaggacauag

SEQ ID NO: 85559 - RNA, 21 nt, Artificial Sequence
  Oligomer
uggagaucucgaugaaggauc

SEQ ID NO: 85560 - RNA, 21 nt, Artificial Sequence
  Oligomer
uggacaggacgaaguugaccu

SEQ ID NO: 85561 - RNA, 21 nt, Artificial Sequence
  Oligomer
auccacugcccucaaaauagu

SEQ ID NO: 85562 - RNA, 21 nt, Artificial Sequence
  Oligomer
ucauacacagcgauguucugg

SEQ ID NO: 85563 - RNA, 21 nt, Artificial Sequence
  Oligomer
auagguauugggccagggucu

SEQ ID NO: 85564 - RNA, 21 nt, Artificial Sequence
  Oligomer
ugagguuguuguaccacccau

SEQ ID NO: 85565 - RNA, 21 nt, Artificial Sequence
  Oligomer
agaucuucuuacagaacacuu

SEQ ID NO: 85566 - RNA, 21 nt, Artificial Sequence
  Oligomer
ugacggaugacuugaagacca

SEQ ID NO: 85567 - RNA, 21 nt, Artificial Sequence
  Oligomer
acagcuuuggguaucuggcac

SEQ ID NO: 85568 - RNA, 21 nt, Artificial Sequence
  Oligomer
ucagacccaucaucauggaag

SEQ ID NO: 85569 - RNA, 21 nt, Artificial Sequence
  Oligomer
uguaggagaacaugaaagaga

SEQ ID NO: 85570 - RNA, 21 nt, Artificial Sequence
  Oligomer
cugaggugucaacucagucuc

SEQ ID NO: 85571 - RNA, 21 nt, Artificial Sequence
  Oligomer
uggccuugccauuccaaagcu

SEQ ID NO: 85572 - RNA, 21 nt, Artificial Sequence
  Oligomer
gugguauuucggauuucuuca

SEQ ID NO: 85573 - RNA, 21 nt, Artificial Sequence
  Oligomer
uacagacaugcacacacauag

SEQ ID NO: 85574 - RNA, 21 nt, Artificial Sequence
  Oligomer
uuacagaacacuuggcagcug

SEQ ID NO: 85575 - RNA, 21 nt, Artificial Sequence
  Oligomer
ugauggagaacagguacacau

SEQ ID NO: 85576 - RNA, 21 nt, Artificial Sequence
  Oligomer
uggcccacacuguguaagacu

SEQ ID NO: 85577 - RNA, 21 nt, Artificial Sequence
  Oligomer
ugagcaagauguaggagaaca

SEQ ID NO: 85578 - RNA, 21 nt, Artificial Sequence
  Oligomer
acgugauagccaaagaagacc

SEQ ID NO: 85579 - RNA, 21 nt, Artificial Sequence
  Oligomer
uagugguccugaggucgaacu

SEQ ID NO: 85580 - RNA, 21 nt, Artificial Sequence
  Oligomer
augucagccagccacucaaac

SEQ ID NO: 85581 - RNA, 21 nt, Artificial Sequence
  Oligomer
augauugcugggaccaggaag

SEQ ID NO: 85582 - RNA, 21 nt, Artificial Sequence
  Oligomer
augagcaggacauagagcagg

SEQ ID NO: 85583 - RNA, 21 nt, Artificial Sequence
  Oligomer
acagguacacauucaccacau

SEQ ID NO: 85584 - RNA, 21 nt, Artificial Sequence
  Oligomer
cuguguaagacugugaggacg

SEQ ID NO: 85585 - RNA, 21 nt, Artificial Sequence
  Oligomer
cuucccaugucaguuccuccu

SEQ ID NO: 85586 - RNA, 21 nt, Artificial Sequence
  Oligomer
aggccauucccaucaaagucg

SEQ ID NO: 85587 - RNA, 21 nt, Artificial Sequence
  Oligomer
uucucacucuagucccuagac

SEQ ID NO: 85588 - RNA, 21 nt, Artificial Sequence
  Oligomer
uuucuccaggcugagacacau

SEQ ID NO: 85589 - RNA, 21 nt, Artificial Sequence
  Oligomer
ucagaaccuucuggaagugcc

SEQ ID NO: 85590 - RNA, 21 nt, Artificial Sequence
  Oligomer
ugucaacucagucucaauguc

SEQ ID NO: 85591 - RNA, 21 nt, Artificial Sequence
  Oligomer
augaacucauccuuggaaaug

SEQ ID NO: 85592 - RNA, 21 nt, Artificial Sequence
  Oligomer
ugccgcucuuccuccaaguua

SEQ ID NO: 85593 - RNA, 21 nt, Artificial Sequence
  Oligomer
cagaaaucccgcacaucuuca

SEQ ID NO: 85594 - RNA, 21 nt, Artificial Sequence
  Oligomer
acacuugaguuccgauugaug

SEQ ID NO: 85595 - RNA, 21 nt, Artificial Sequence
  Oligomer
uuggaagggagacuacuggag

SEQ ID NO: 85596 - RNA, 21 nt, Artificial Sequence
  Oligomer
ucuaccuccugcaaggcauuu

SEQ ID NO: 85597 - RNA, 21 nt, Artificial Sequence
  Oligomer
ugugcuccaugagguuguugu

SEQ ID NO: 85598 - RNA, 21 nt, Artificial Sequence
  Oligomer
cccuacuucucacucuagucc

SEQ ID NO: 85599 - RNA, 21 nt, Artificial Sequence
  Oligomer
uccugaggucgaacuucucag

SEQ ID NO: 85600 - RNA, 21 nt, Artificial Sequence
  Oligomer
auguagaugugcacagacacc

SEQ ID NO: 85601 - RNA, 21 nt, Artificial Sequence
  Oligomer
uccaccucucggaugauguca

SEQ ID NO: 85602 - RNA, 21 nt, Artificial Sequence
  Oligomer
uacagaacacuuggcagcuga

SEQ ID NO: 85603 - RNA, 21 nt, Artificial Sequence
  Oligomer
acgcugaucuccaccuucuuc

SEQ ID NO: 85604 - RNA, 21 nt, Artificial Sequence
  Oligomer
acaugauggccaggaucagga

SEQ ID NO: 85605 - RNA, 21 nt, Artificial Sequence
  Oligomer
ugaugacuucaggcaccucca

SEQ ID NO: 85606 - RNA, 21 nt, Artificial Sequence
  Oligomer
ugucaguuccuccuuguccug

SEQ ID NO: 85607 - RNA, 21 nt, Artificial Sequence
  Oligomer
aucucagcauccugaugaacu

SEQ ID NO: 85608 - RNA, 21 nt, Artificial Sequence
  Oligomer
ucaugaagaccaccaggaugu

SEQ ID NO: 85609 - RNA, 21 nt, Artificial Sequence
  Oligomer
uuguggccuugccauuccaaa

SEQ ID NO: 85610 - RNA, 21 nt, Artificial Sequence
  Oligomer
agcagugcauccacaucuuca

SEQ ID NO: 85611 - RNA, 21 nt, Artificial Sequence
  Oligomer
ugagcugacaggccuuuucca

SEQ ID NO: 85612 - RNA, 21 nt, Artificial Sequence
  Oligomer
acuuguacucaaagcccuggg

SEQ ID NO: 85613 - RNA, 21 nt, Artificial Sequence
  Oligomer
uuugacacagagcugcgugaa

SEQ ID NO: 85614 - RNA, 21 nt, Artificial Sequence
  Oligomer
ucaggagagccuuucaugaag

SEQ ID NO: 85615 - RNA, 21 nt, Artificial Sequence
  Oligomer
uugccauccuugucagccaga

SEQ ID NO: 85616 - RNA, 21 nt, Artificial Sequence
  Oligomer
uguugauaacagcgaccagca

SEQ ID NO: 85617 - RNA, 21 nt, Artificial Sequence
  Oligomer
aaaccaguagcggucaccauc

SEQ ID NO: 85618 - RNA, 21 nt, Artificial Sequence
  Oligomer
ccucaaacuuaugccacuccu

SEQ ID NO: 85619 - RNA, 21 nt, Artificial Sequence
  Oligomer
acauggugagcaagauguagg

SEQ ID NO: 85620 - RNA, 21 nt, Artificial Sequence
  Oligomer
uggugagcaagauguaggaga

SEQ ID NO: 85621 - RNA, 21 nt, Artificial Sequence
  Oligomer
ucugaggugucaacucagucu

SEQ ID NO: 85622 - RNA, 21 nt, Artificial Sequence
  Oligomer
acgagcuucucagacacgaug

SEQ ID NO: 85623 - RNA, 21 nt, Artificial Sequence
  Oligomer
auguugauaacagcgaccagc

SEQ ID NO: 85624 - RNA, 21 nt, Artificial Sequence
  Oligomer
uccuucuuggagaacagccca

SEQ ID NO: 85625 - RNA, 21 nt, Artificial Sequence
  Oligomer
ccagaaaucccgcacaucuuc

SEQ ID NO: 85626 - RNA, 21 nt, Artificial Sequence
  Oligomer
caaccaacacaugguccucuc

SEQ ID NO: 85627 - RNA, 21 nt, Artificial Sequence
  Oligomer
agcagcagugcauccacaucu

SEQ ID NO: 85628 - RNA, 21 nt, Artificial Sequence
  Oligomer
uaagaugccagcauccaugcu

SEQ ID NO: 85629 - RNA, 21 nt, Artificial Sequence
  Oligomer
cacugcauccuuacacucacc

SEQ ID NO: 85630 - RNA, 21 nt, Artificial Sequence
  Oligomer
ucucauaauggugggagaagu

SEQ ID NO: 85631 - RNA, 21 nt, Artificial Sequence
  Oligomer
auaauggugggagaagugagu

SEQ ID NO: 85632 - RNA, 21 nt, Artificial Sequence
  Oligomer
auagacuccgguucagaaccu

SEQ ID NO: 85633 - RNA, 21 nt, Artificial Sequence
  Oligomer
uacagcuuuggguaucuggca

SEQ ID NO: 85634 - RNA, 21 nt, Artificial Sequence
  Oligomer
agauguaggagaacaugaaag

SEQ ID NO: 85635 - RNA, 21 nt, Artificial Sequence
  Oligomer
ugaacuguugcaccgucuggu

SEQ ID NO: 85636 - RNA, 21 nt, Artificial Sequence
  Oligomer
ucacagcugcucucaucagcu

SEQ ID NO: 85637 - RNA, 21 nt, Artificial Sequence
  Oligomer
aagccaaauccacugcccuca

SEQ ID NO: 85638 - RNA, 21 nt, Artificial Sequence
  Oligomer
ccgcacaaauuguucaaggac

SEQ ID NO: 85639 - RNA, 21 nt, Artificial Sequence
  Oligomer
aguagggaggguucuaagaug

SEQ ID NO: 85640 - RNA, 21 nt, Artificial Sequence
  Oligomer
acaugcacacacauaguacuu

SEQ ID NO: 85641 - RNA, 21 nt, Artificial Sequence
  Oligomer
auuuguuucugaagucuggaa

SEQ ID NO: 85642 - RNA, 21 nt, Artificial Sequence
  Oligomer
ucuggaagcagagguuucacu

SEQ ID NO: 85643 - RNA, 21 nt, Artificial Sequence
  Oligomer
acucuagucccuagacacugc

SEQ ID NO: 85644 - RNA, 21 nt, Artificial Sequence
  Oligomer
accauuucuccaggcugagac

SEQ ID NO: 85645 - RNA, 21 nt, Artificial Sequence
  Oligomer
ccaugagguuguuguaccacc

SEQ ID NO: 85646 - RNA, 21 nt, Artificial Sequence
  Oligomer
ugguccugaggucgaacuucu

SEQ ID NO: 85647 - RNA, 21 nt, Artificial Sequence
  Oligomer
ugggugauguagaugugcaca

SEQ ID NO: 85648 - RNA, 21 nt, Artificial Sequence
  Oligomer
uggucauucuccuccaccucu

SEQ ID NO: 85649 - RNA, 21 nt, Artificial Sequence
  Oligomer
ucagggauuagaaugucccaa

SEQ ID NO: 85650 - RNA, 21 nt, Artificial Sequence
  Oligomer
guaagacugugaggacgaugg

SEQ ID NO: 85651 - RNA, 21 nt, Artificial Sequence
  Oligomer
ugaaaaucuucccaugucagu

SEQ ID NO: 85652 - RNA, 21 nt, Artificial Sequence
  Oligomer
auguccaggaacucucggaag

SEQ ID NO: 85653 - RNA, 21 nt, Artificial Sequence
  Oligomer
agcaccaggucauacuccuug

SEQ ID NO: 85654 - RNA, 21 nt, Artificial Sequence
  Oligomer
uguggccuugccauuccaaag

SEQ ID NO: 85655 - RNA, 21 nt, Artificial Sequence
  Oligomer
ugguauuucggauuucuucaa

SEQ ID NO: 85656 - RNA, 21 nt, Artificial Sequence
  Oligomer
uggaaguggcagcuggcauuu

SEQ ID NO: 85657 - RNA, 21 nt, Artificial Sequence
  Oligomer
uccagaaauggccgguauccu

SEQ ID NO: 85658 - RNA, 21 nt, Artificial Sequence
  Oligomer
ugucugugaugcccgugugau

SEQ ID NO: 85659 - RNA, 21 nt, Artificial Sequence
  Oligomer
acguuaccuucuugccaaacc

SEQ ID NO: 85660 - RNA, 21 nt, Artificial Sequence
  Oligomer
aacauggacuccaccaccuca

SEQ ID NO: 85661 - RNA, 21 nt, Artificial Sequence
  Oligomer
ugaugaacucauccuuggaaa

SEQ ID NO: 85662 - RNA, 21 nt, Artificial Sequence
  Oligomer
ugccaucuaccacacggaucu

SEQ ID NO: 85663 - RNA, 21 nt, Artificial Sequence
  Oligomer
cugugcgggaaaacuucagug

SEQ ID NO: 85664 - RNA, 21 nt, Artificial Sequence
  Oligomer
cagugcauccacaucuucagc

SEQ ID NO: 85665 - RNA, 21 nt, Artificial Sequence
  Oligomer
ucuucagcacuuuguaggcuu

SEQ ID NO: 85666 - RNA, 21 nt, Artificial Sequence
  Oligomer
uguaaauggcuugccaugggu

SEQ ID NO: 85667 - RNA, 21 nt, Artificial Sequence
  Oligomer
acacacauaguacuugucagg

SEQ ID NO: 85668 - RNA, 21 nt, Artificial Sequence
  Oligomer
ucagcuugucuucugagauuu

SEQ ID NO: 85669 - RNA, 21 nt, Artificial Sequence
  Oligomer
ucagccagccacucaaacuga

SEQ ID NO: 85670 - RNA, 21 nt, Artificial Sequence
  Oligomer
cagaaguguccaugcuagagc

SEQ ID NO: 85671 - RNA, 21 nt, Artificial Sequence
  Oligomer
uacggucuggaagaaccacca

SEQ ID NO: 85672 - RNA, 21 nt, Artificial Sequence
  Oligomer
aacucagucucaaugucgcug

SEQ ID NO: 85673 - RNA, 21 nt, Artificial Sequence
  Oligomer
uggaaaugaggccauucccau

SEQ ID NO: 85674 - RNA, 21 nt, Artificial Sequence
  Oligomer
ggugguauuucggauuucuuc

SEQ ID NO: 85675 - RNA, 21 nt, Artificial Sequence
  Oligomer
ucggauuucuucaaucuccuu

SEQ ID NO: 85676 - RNA, 21 nt, Artificial Sequence
  Oligomer
ucuucaaucuccuucuuggag

SEQ ID NO: 85677 - RNA, 21 nt, Artificial Sequence
  Oligomer
gcacaaauuguucaaggacga

SEQ ID NO: 85678 - RNA, 21 nt, Artificial Sequence
  Oligomer
ccagggucugaugaaagaacg

SEQ ID NO: 85679 - RNA, 21 nt, Artificial Sequence
  Oligomer
aaauuaguugugguguuagac

SEQ ID NO: 85680 - RNA, 21 nt, Artificial Sequence
  Oligomer
ugguacacgccaucugcauag

SEQ ID NO: 85681 - RNA, 21 nt, Artificial Sequence
  Oligomer
uucuaagaugccagcauccau

SEQ ID NO: 85682 - RNA, 21 nt, Artificial Sequence
  Oligomer
acacauaguacuugucagguc

SEQ ID NO: 85683 - RNA, 21 nt, Artificial Sequence
  Oligomer
ugcuccaugagguuguuguac

SEQ ID NO: 85684 - RNA, 21 nt, Artificial Sequence
  Oligomer
ugaggcagccagaaauaggaa

SEQ ID NO: 85685 - RNA, 21 nt, Artificial Sequence
  Oligomer
aggccuuuuccacauucuugg

SEQ ID NO: 85686 - RNA, 21 nt, Artificial Sequence
  Oligomer
acacugacaccucaaacuuau

SEQ ID NO: 85687 - RNA, 21 nt, Artificial Sequence
  Oligomer
aacagguacacauucaccaca

SEQ ID NO: 85688 - RNA, 21 nt, Artificial Sequence
  Oligomer
aagugaaaaucuucccauguc

SEQ ID NO: 85689 - RNA, 21 nt, Artificial Sequence
  Oligomer
ucagcauccugaugaacucau

SEQ ID NO: 85690 - RNA, 21 nt, Artificial Sequence
  Oligomer
augaggccauucccaucaaag

SEQ ID NO: 85691 - RNA, 21 nt, Artificial Sequence
  Oligomer
acagguagccauugccauccu

SEQ ID NO: 85692 - RNA, 21 nt, Artificial Sequence
  Oligomer
uggacuccacaaacauguccu

SEQ ID NO: 85693 - RNA, 21 nt, Artificial Sequence
  Oligomer
cuugccauuccaaagcuucca

SEQ ID NO: 85694 - RNA, 21 nt, Artificial Sequence
  Oligomer
ucacgaacaacagagggagca

SEQ ID NO: 85695 - RNA, 21 nt, Artificial Sequence
  Oligomer
ucugugcgggaaaacuucagu

SEQ ID NO: 85696 - RNA, 21 nt, Artificial Sequence
  Oligomer
accaggucugaaagcacguga

SEQ ID NO: 85697 - RNA, 21 nt, Artificial Sequence
  Oligomer
aggagcauugcauacauaggu

SEQ ID NO: 85698 - RNA, 21 nt, Artificial Sequence
  Oligomer
uggguuucuguaaauggcuug

SEQ ID NO: 85699 - RNA, 21 nt, Artificial Sequence
  Oligomer
ucacucuagucccuagacacu

SEQ ID NO: 85700 - RNA, 21 nt, Artificial Sequence
  Oligomer
gugggaaaucagagaaggcug

SEQ ID NO: 85701 - RNA, 21 nt, Artificial Sequence
  Oligomer
uccacauucuuggucaugcca

SEQ ID NO: 85702 - RNA, 21 nt, Artificial Sequence
  Oligomer
ucacccagaugaaguagaucu

SEQ ID NO: 85703 - RNA, 21 nt, Artificial Sequence
  Oligomer
agcaggacauagagcaggaug

SEQ ID NO: 85704 - RNA, 21 nt, Artificial Sequence
  Oligomer
uaguaggcccucuccaggaaa

SEQ ID NO: 85705 - RNA, 21 nt, Artificial Sequence
  Oligomer
ugaacagcaagggcuggaaug

SEQ ID NO: 85706 - RNA, 21 nt, Artificial Sequence
  Oligomer
ggcuggaaugacguuaccuuc

SEQ ID NO: 85707 - RNA, 21 nt, Artificial Sequence
  Oligomer
ucucugaggugucaacucagu

SEQ ID NO: 85708 - RNA, 21 nt, Artificial Sequence
  Oligomer
ugaacucauccuuggaaauga

SEQ ID NO: 85709 - RNA, 21 nt, Artificial Sequence
  Oligomer
agucguacaugcggaacauaa

SEQ ID NO: 85710 - RNA, 21 nt, Artificial Sequence
  Oligomer
uuucaugaagaccaccaggau

SEQ ID NO: 85711 - RNA, 21 nt, Artificial Sequence
  Oligomer
ccuggagccucuugaaauuuc

SEQ ID NO: 85712 - RNA, 21 nt, Artificial Sequence
  Oligomer
aaauccacugcccucaaaaua

SEQ ID NO: 85713 - RNA, 21 nt, Artificial Sequence
  Oligomer
ucucaaaccaguagcggucac

SEQ ID NO: 85714 - RNA, 21 nt, Artificial Sequence
  Oligomer
cauuucucauguagacgccag

SEQ ID NO: 85715 - RNA, 21 nt, Artificial Sequence
  Oligomer
uggccgguauccuguauacuc

SEQ ID NO: 85716 - RNA, 21 nt, Artificial Sequence
  Oligomer
agccacucauacacagcgaug

SEQ ID NO: 85717 - RNA, 21 nt, Artificial Sequence
  Oligomer
gucugaaagcacgugauagcc

SEQ ID NO: 85718 - RNA, 21 nt, Artificial Sequence
  Oligomer
guggguuucuguaaauggcuu

SEQ ID NO: 85719 - RNA, 21 nt, Artificial Sequence
  Oligomer
uaugggaguagggaggguucu

SEQ ID NO: 85720 - RNA, 21 nt, Artificial Sequence
  Oligomer
cucccacugcauccuuacacu

SEQ ID NO: 85721 - RNA, 21 nt, Artificial Sequence
  Oligomer
acauacagacaugcacacaca

SEQ ID NO: 85722 - RNA, 21 nt, Artificial Sequence
  Oligomer
ugucaggucagcuugucuucu

SEQ ID NO: 85723 - RNA, 21 nt, Artificial Sequence
  Oligomer
auucuccuccaccucucggau

SEQ ID NO: 85724 - RNA, 21 nt, Artificial Sequence
  Oligomer
ugcccugacuuguacucaaag

SEQ ID NO: 85725 - RNA, 21 nt, Artificial Sequence
  Oligomer
gaucagggcaaagcuaccaug

SEQ ID NO: 85726 - RNA, 21 nt, Artificial Sequence
  Oligomer
agcccaugaugaaaauaauag

SEQ ID NO: 85727 - RNA, 21 nt, Artificial Sequence
  Oligomer
acauucaccacauggcccaca

SEQ ID NO: 85728 - RNA, 21 nt, Artificial Sequence
  Oligomer
ugcguuggaacuucucucggu

SEQ ID NO: 85729 - RNA, 21 nt, Artificial Sequence
  Oligomer
ggugucaacucagucucaaug

SEQ ID NO: 85730 - RNA, 21 nt, Artificial Sequence
  Oligomer
uuggagaucucgaugaaggau

SEQ ID NO: 85731 - RNA, 21 nt, Artificial Sequence
  Oligomer
agaaaaggugccugaaaaagg

SEQ ID NO: 85732 - RNA, 21 nt, Artificial Sequence
  Oligomer
guauuucggauuucuucaauc

SEQ ID NO: 85733 - RNA, 21 nt, Artificial Sequence
  Oligomer
aguguuuucugcaggaagcug

SEQ ID NO: 85734 - RNA, 21 nt, Artificial Sequence
  Oligomer
uguucugguagguggcgauga

SEQ ID NO: 85735 - RNA, 21 nt, Artificial Sequence
  Oligomer
gaaugcgaggaaccauagaug

SEQ ID NO: 85736 - RNA, 21 nt, Artificial Sequence
  Oligomer
gggugaaauuaguuguggugu

SEQ ID NO: 85737 - RNA, 21 nt, Artificial Sequence
  Oligomer
agcagagguuucacuuugccc

SEQ ID NO: 85738 - RNA, 21 nt, Artificial Sequence
  Oligomer
acuucucacucuagucccuag

SEQ ID NO: 85739 - RNA, 21 nt, Artificial Sequence
  Oligomer
ugggaggugggaaaucagaga

SEQ ID NO: 85740 - RNA, 21 nt, Artificial Sequence
  Oligomer
cauaauggugggagaagugag

SEQ ID NO: 85741 - RNA, 21 nt, Artificial Sequence
  Oligomer
agugccgcucacagauguaca

SEQ ID NO: 85742 - RNA, 21 nt, Artificial Sequence
  Oligomer
ugauguagaugugcacagaca

SEQ ID NO: 85743 - RNA, 21 nt, Artificial Sequence
  Oligomer
acauacaugauggccaggauc

SEQ ID NO: 85744 - RNA, 21 nt, Artificial Sequence
  Oligomer
agcucagacccaucaucaugg

SEQ ID NO: 85745 - RNA, 21 nt, Artificial Sequence
  Oligomer
gagaacagguacacauucacc

SEQ ID NO: 85746 - RNA, 21 nt, Artificial Sequence
  Oligomer
acacauucaccacauggccca

SEQ ID NO: 85747 - RNA, 21 nt, Artificial Sequence
  Oligomer
agcgguugaggaagguuucuc

SEQ ID NO: 85748 - RNA, 21 nt, Artificial Sequence
  Oligomer
aguuaaacagcagcaccaggu

SEQ ID NO: 85749 - RNA, 21 nt, Artificial Sequence
  Oligomer
agccaaauccacugcccucaa

SEQ ID NO: 85750 - RNA, 21 nt, Artificial Sequence
  Oligomer
guagccgcacaaauuguucaa

SEQ ID NO: 85751 - RNA, 21 nt, Artificial Sequence
  Oligomer
ucugaugaaagaacgugcuua

SEQ ID NO: 85752 - RNA, 21 nt, Artificial Sequence
  Oligomer
cauaguacuugucaggucagc

SEQ ID NO: 85753 - RNA, 21 nt, Artificial Sequence
  Oligomer
ucugugcuccaugagguuguu

SEQ ID NO: 85754 - RNA, 21 nt, Artificial Sequence
  Oligomer
cuggaagcagagguuucacuu

SEQ ID NO: 85755 - RNA, 21 nt, Artificial Sequence
  Oligomer
auuucuccaggcugagacaca

SEQ ID NO: 85756 - RNA, 21 nt, Artificial Sequence
  Oligomer
aagguugggaggugggaaauc

SEQ ID NO: 85757 - RNA, 21 nt, Artificial Sequence
  Oligomer
uccugcagggaguugaagaag

SEQ ID NO: 85758 - RNA, 21 nt, Artificial Sequence
  Oligomer
agaugaaguagaucuucuuac

SEQ ID NO: 85759 - RNA, 21 nt, Artificial Sequence
  Oligomer
cagcugacggaugacuugaag

SEQ ID NO: 85760 - RNA, 21 nt, Artificial Sequence
  Oligomer
cuggaaugacguuaccuucuu

SEQ ID NO: 85761 - RNA, 21 nt, Artificial Sequence
  Oligomer
agccuuucaugaagaccacca

SEQ ID NO: 85762 - RNA, 21 nt, Artificial Sequence
  Oligomer
uccugguguucucaaaccagu

SEQ ID NO: 85763 - RNA, 21 nt, Artificial Sequence
  Oligomer
uguucaaggacgauggugcug

SEQ ID NO: 85764 - RNA, 21 nt, Artificial Sequence
  Oligomer
aggucugaaagcacgugauag

SEQ ID NO: 85765 - RNA, 21 nt, Artificial Sequence
  Oligomer
agaugguguugcuaaggucuc

SEQ ID NO: 85766 - RNA, 21 nt, Artificial Sequence
  Oligomer
cccaacacacauacagacaug

SEQ ID NO: 85767 - RNA, 21 nt, Artificial Sequence
  Oligomer
cugaagucuggaagcagaggu

SEQ ID NO: 85768 - RNA, 21 nt, Artificial Sequence
  Oligomer
ccuuuuccacauucuugguca

SEQ ID NO: 85769 - RNA, 21 nt, Artificial Sequence
  Oligomer
cugacuuguacucaaagcccu

SEQ ID NO: 85770 - RNA, 21 nt, Artificial Sequence
  Oligomer
uggaucagggcaaagcuacca

SEQ ID NO: 85771 - RNA, 21 nt, Artificial Sequence
  Oligomer
ucauggaagaggccaggaaag

SEQ ID NO: 85772 - RNA, 21 nt, Artificial Sequence
  Oligomer
gccgguaguucucaaugaagc

SEQ ID NO: 85773 - RNA, 21 nt, Artificial Sequence
  Oligomer
aggaucucagcauccugauga

SEQ ID NO: 85774 - RNA, 21 nt, Artificial Sequence
  Oligomer
auccuuggaaaugaggccauu

SEQ ID NO: 85775 - RNA, 21 nt, Artificial Sequence
  Oligomer
cuuccuccaaguuaaacagca

SEQ ID NO: 85776 - RNA, 21 nt, Artificial Sequence
  Oligomer
uaaacagcagcaccaggucau

SEQ ID NO: 85777 - RNA, 21 nt, Artificial Sequence
  Oligomer
acgaacaacagagggagcaca

SEQ ID NO: 85778 - RNA, 21 nt, Artificial Sequence
  Oligomer
guucaaggacgauggugcuga

SEQ ID NO: 85779 - RNA, 21 nt, Artificial Sequence
  Oligomer
gccuccaguacagugucauug

SEQ ID NO: 85780 - RNA, 21 nt, Artificial Sequence
  Oligomer
uggcagcuggcauuucucaug

SEQ ID NO: 85781 - RNA, 21 nt, Artificial Sequence
  Oligomer
uguauacuccgggaguguuuu

SEQ ID NO: 85782 - RNA, 21 nt, Artificial Sequence
  Oligomer
ccaggaaugcgaggaaccaua

SEQ ID NO: 85783 - RNA, 21 nt, Artificial Sequence
  Oligomer
gaaagaacgugcuuaaaaccu

SEQ ID NO: 85784 - RNA, 21 nt, Artificial Sequence
  Oligomer
acagacaugcacacacauagu

SEQ ID NO: 85785 - RNA, 21 nt, Artificial Sequence
  Oligomer
caucugugcuccaugagguug

SEQ ID NO: 85786 - RNA, 21 nt, Artificial Sequence
  Oligomer
aagcagagguuucacuuugcc

SEQ ID NO: 85787 - RNA, 21 nt, Artificial Sequence
  Oligomer
uucucauaauggugggagaag

SEQ ID NO: 85788 - RNA, 21 nt, Artificial Sequence
  Oligomer
guuguuguaccacccaucaaa

SEQ ID NO: 85789 - RNA, 21 nt, Artificial Sequence
  Oligomer
ugucagccagccacucaaacu

SEQ ID NO: 85790 - RNA, 21 nt, Artificial Sequence
  Oligomer
guaucuggcacaucugucacc

SEQ ID NO: 85791 - RNA, 21 nt, Artificial Sequence
  Oligomer
auugcugggaccaggaagaag

SEQ ID NO: 85792 - RNA, 21 nt, Artificial Sequence
  Oligomer
ugagcaggacauagagcagga

SEQ ID NO: 85793 - RNA, 21 nt, Artificial Sequence
  Oligomer
aguggugggaggcaaagacau

SEQ ID NO: 85794 - RNA, 21 nt, Artificial Sequence
  Oligomer
cuugaacuguugcaccgucug

SEQ ID NO: 85795 - RNA, 21 nt, Artificial Sequence
  Oligomer
agacagcugcguuggaacuuc

SEQ ID NO: 85796 - RNA, 21 nt, Artificial Sequence
  Oligomer
gcuggaaugacguuaccuucu

SEQ ID NO: 85797 - RNA, 21 nt, Artificial Sequence
  Oligomer
ugcggaacauaaggcgagacu

SEQ ID NO: 85798 - RNA, 21 nt, Artificial Sequence
  Oligomer
ugaagaccaccaggaugucca

SEQ ID NO: 85799 - RNA, 21 nt, Artificial Sequence
  Oligomer
cucaaaauagucacgaacaac

SEQ ID NO: 85800 - RNA, 21 nt, Artificial Sequence
  Oligomer
augguggacaggaacugcuca

SEQ ID NO: 85801 - RNA, 21 nt, Artificial Sequence
  Oligomer
gugaaauuaguugugguguua

SEQ ID NO: 85802 - RNA, 21 nt, Artificial Sequence
  Oligomer
agguuguuguaccacccauca

SEQ ID NO: 85803 - RNA, 21 nt, Artificial Sequence
  Oligomer
acauucuuggucaugccaggg

SEQ ID NO: 85804 - RNA, 21 nt, Artificial Sequence
  Oligomer
aguugaagaagggcucaaagg

SEQ ID NO: 85805 - RNA, 21 nt, Artificial Sequence
  Oligomer
aucaagguacagcuuugggua

SEQ ID NO: 85806 - RNA, 21 nt, Artificial Sequence
  Oligomer
ucuggaagaaccaccaguaau

SEQ ID NO: 85807 - RNA, 21 nt, Artificial Sequence
  Oligomer
guugaggaagguuucucgcag

SEQ ID NO: 85808 - RNA, 21 nt, Artificial Sequence
  Oligomer
ugacguuaccuucuugccaaa

SEQ ID NO: 85809 - RNA, 21 nt, Artificial Sequence
  Oligomer
ucaguuccuccuuguccugga

SEQ ID NO: 85810 - RNA, 21 nt, Artificial Sequence
  Oligomer
ucucagcauccugaugaacuc

SEQ ID NO: 85811 - RNA, 21 nt, Artificial Sequence
  Oligomer
agcauccugaugaacucaucc

SEQ ID NO: 85812 - RNA, 21 nt, Artificial Sequence
  Oligomer
cauuccaaagcuuccaugccu

SEQ ID NO: 85813 - RNA, 21 nt, Artificial Sequence
  Oligomer
cagcucuagccaggauaaguc

SEQ ID NO: 85814 - RNA, 21 nt, Artificial Sequence
  Oligomer
ccaguacagugucauugcucc

SEQ ID NO: 85815 - RNA, 21 nt, Artificial Sequence
  Oligomer
cacuugaguuccgauugauga

SEQ ID NO: 85816 - RNA, 21 nt, Artificial Sequence
  Oligomer
uuucuguaaauggcuugccau

SEQ ID NO: 85817 - RNA, 21 nt, Artificial Sequence
  Oligomer
agaagaggaggagguauggga

SEQ ID NO: 85818 - RNA, 21 nt, Artificial Sequence
  Oligomer
agggaggguucuaagaugcca

SEQ ID NO: 85819 - RNA, 21 nt, Artificial Sequence
  Oligomer
ugaagucuggaagcagagguu

SEQ ID NO: 85820 - RNA, 21 nt, Artificial Sequence
  Oligomer
cacucuagucccuagacacug

SEQ ID NO: 85821 - RNA, 21 nt, Artificial Sequence
  Oligomer
cauuucuccaggcugagacac

SEQ ID NO: 85822 - RNA, 21 nt, Artificial Sequence
  Oligomer
aguagaucuucuuacagaaca

SEQ ID NO: 85823 - RNA, 21 nt, Artificial Sequence
  Oligomer
cucuccaaaugguccaucaag

SEQ ID NO: 85824 - RNA, 21 nt, Artificial Sequence
  Oligomer
agaugauugcugggaccagga

SEQ ID NO: 85825 - RNA, 21 nt, Artificial Sequence
  Oligomer
caaugaagcgcuugaacuguu

SEQ ID NO: 85826 - RNA, 21 nt, Artificial Sequence
  Oligomer
gaacauaaggcgagacuuuuc

SEQ ID NO: 85827 - RNA, 21 nt, Artificial Sequence
  Oligomer
ucggaaggacagguagccauu

SEQ ID NO: 85828 - RNA, 21 nt, Artificial Sequence
  Oligomer
acauggacuccacaaacaugu

SEQ ID NO: 85829 - RNA, 21 nt, Artificial Sequence
  Oligomer
cugaaaaaggucuccaggagg

SEQ ID NO: 85830 - RNA, 21 nt, Artificial Sequence
  Oligomer
ugaaaaaggucuccaggaggu

SEQ ID NO: 85831 - RNA, 21 nt, Artificial Sequence
  Oligomer
acgaaguugaccuucugugga

SEQ ID NO: 85832 - RNA, 21 nt, Artificial Sequence
  Oligomer
cggauuucuucaaucuccuuc

SEQ ID NO: 85833 - RNA, 21 nt, Artificial Sequence
  Oligomer
uagccaggauaaguccugguu

SEQ ID NO: 85834 - RNA, 21 nt, Artificial Sequence
  Oligomer
aggauaaguccugguuguaca

SEQ ID NO: 85835 - RNA, 21 nt, Artificial Sequence
  Oligomer
cacauaguacuugucagguca

SEQ ID NO: 85836 - RNA, 21 nt, Artificial Sequence
  Oligomer
gcuccaugagguuguuguacc

SEQ ID NO: 85837 - RNA, 21 nt, Artificial Sequence
  Oligomer
cucacucuagucccuagacac

SEQ ID NO: 85838 - RNA, 21 nt, Artificial Sequence
  Oligomer
ucauaauggugggagaaguga

SEQ ID NO: 85839 - RNA, 21 nt, Artificial Sequence
  Oligomer
caggccuuuuccacauucuug

SEQ ID NO: 85840 - RNA, 21 nt, Artificial Sequence
  Oligomer
uagacuccgguucagaaccuu

SEQ ID NO: 85841 - RNA, 21 nt, Artificial Sequence
  Oligomer
cucccacuaacacugacaccu

SEQ ID NO: 85842 - RNA, 21 nt, Artificial Sequence
  Oligomer
caccucaaacuuaugccacuc

SEQ ID NO: 85843 - RNA, 21 nt, Artificial Sequence
  Oligomer
ugguccaucaagguacagcuu

SEQ ID NO: 85844 - RNA, 21 nt, Artificial Sequence
  Oligomer
ugauugcugggaccaggaaga

SEQ ID NO: 85845 - RNA, 21 nt, Artificial Sequence
  Oligomer
auggcccacacuguguaagac

SEQ ID NO: 85846 - RNA, 21 nt, Artificial Sequence
  Oligomer
ugcagucucugaggugucaac

SEQ ID NO: 85847 - RNA, 21 nt, Artificial Sequence
  Oligomer
agaucauauccuggcugaugu

SEQ ID NO: 85848 - RNA, 21 nt, Artificial Sequence
  Oligomer
cauaaggcgagacuuuuccuc

SEQ ID NO: 85849 - RNA, 21 nt, Artificial Sequence
  Oligomer
ugcagggugguauuucggauu

SEQ ID NO: 85850 - RNA, 21 nt, Artificial Sequence
  Oligomer
cagaaauggccgguauccugu

SEQ ID NO: 85851 - RNA, 21 nt, Artificial Sequence
  Oligomer
aaagaacgugcuuaaaaccuu

SEQ ID NO: 85852 - RNA, 21 nt, Artificial Sequence
  Oligomer
auacagacaugcacacacaua

SEQ ID NO: 85853 - RNA, 21 nt, Artificial Sequence
  Oligomer
gcacacacauaguacuuguca

SEQ ID NO: 85854 - RNA, 21 nt, Artificial Sequence
  Oligomer
cuugucaggucagcuugucuu

SEQ ID NO: 85855 - RNA, 21 nt, Artificial Sequence
  Oligomer
cuugucuucugagauuuguuu

SEQ ID NO: 85856 - RNA, 21 nt, Artificial Sequence
  Oligomer
gagguuguuguaccacccauc

SEQ ID NO: 85857 - RNA, 21 nt, Artificial Sequence
  Oligomer
ugaaguagaucuucuuacaga

SEQ ID NO: 85858 - RNA, 21 nt, Artificial Sequence
  Oligomer
augacuugaagaccaggucuu

SEQ ID NO: 85859 - RNA, 21 nt, Artificial Sequence
  Oligomer
agggcaaagcuaccauggaug

SEQ ID NO: 85860 - RNA, 21 nt, Artificial Sequence
  Oligomer
gcagucucugaggugucaacu

SEQ ID NO: 85861 - RNA, 21 nt, Artificial Sequence
  Oligomer
cuugaaauuucucauccggag

SEQ ID NO: 85862 - RNA, 21 nt, Artificial Sequence
  Oligomer
ucaaggacgauggugcugaac

SEQ ID NO: 85863 - RNA, 21 nt, Artificial Sequence
  Oligomer
ucagcacuuuguaggcuuggg

SEQ ID NO: 85864 - RNA, 21 nt, Artificial Sequence
  Oligomer
cuguaaauggcuugccauggg

SEQ ID NO: 85865 - RNA, 21 nt, Artificial Sequence
  Oligomer
aagaggaggagguaugggagu

SEQ ID NO: 85866 - RNA, 21 nt, Artificial Sequence
  Oligomer
cacacauaguacuugucaggu

SEQ ID NO: 85867 - RNA, 21 nt, Artificial Sequence
  Oligomer
ucaggucagcuugucuucuga

SEQ ID NO: 85868 - RNA, 21 nt, Artificial Sequence
  Oligomer
guugggaggugggaaaucaga

SEQ ID NO: 85869 - RNA, 21 nt, Artificial Sequence
  Oligomer
ugaugucagccagccacucaa

SEQ ID NO: 85870 - RNA, 21 nt, Artificial Sequence
  Oligomer
ugaugagcaggacauagagca

SEQ ID NO: 85871 - RNA, 21 nt, Artificial Sequence
  Oligomer
agcaagauguaggagaacaug

SEQ ID NO: 85872 - RNA, 21 nt, Artificial Sequence
  Oligomer
gguaguucucaaugaagcgcu

SEQ ID NO: 85873 - RNA, 21 nt, Artificial Sequence
  Oligomer
caguuguuggagaucucgaug

SEQ ID NO: 85874 - RNA, 21 nt, Artificial Sequence
  Oligomer
guagccauugccauccuuguc

SEQ ID NO: 85875 - RNA, 21 nt, Artificial Sequence
  Oligomer
gugucacagcugcucucauca

SEQ ID NO: 85876 - RNA, 21 nt, Artificial Sequence
  Oligomer
ucaccaaagggaagcaacaga

SEQ ID NO: 85877 - RNA, 21 nt, Artificial Sequence
  Oligomer
caccaaagggaagcaacagag

SEQ ID NO: 85878 - RNA, 21 nt, Artificial Sequence
  Oligomer
ugauaacagcgaccagcacgu

SEQ ID NO: 85879 - RNA, 21 nt, Artificial Sequence
  Oligomer
agaacagcccauuccuggugu

SEQ ID NO: 85880 - RNA, 21 nt, Artificial Sequence
  Oligomer
cuccaguacagugucauugcu

SEQ ID NO: 85881 - RNA, 21 nt, Artificial Sequence
  Oligomer
ggucugugcgggaaaacuuca

SEQ ID NO: 85882 - RNA, 21 nt, Artificial Sequence
  Oligomer
ggaugcgaauguugaggaacu

SEQ ID NO: 85883 - RNA, 21 nt, Artificial Sequence
  Oligomer
caacacugugcgguuucucag

SEQ ID NO: 85884 - RNA, 21 nt, Artificial Sequence
  Oligomer
ggguucuaagaugccagcauc

SEQ ID NO: 85885 - RNA, 21 nt, Artificial Sequence
  Oligomer
acacauacagacaugcacaca

SEQ ID NO: 85886 - RNA, 21 nt, Artificial Sequence
  Oligomer
acauaguacuugucaggucag

SEQ ID NO: 85887 - RNA, 21 nt, Artificial Sequence
  Oligomer
cugugaauagacuccgguuca

SEQ ID NO: 85888 - RNA, 21 nt, Artificial Sequence
  Oligomer
agaacagguacacauucacca

SEQ ID NO: 85889 - RNA, 21 nt, Artificial Sequence
  Oligomer
ucugggagagggacagaucau

SEQ ID NO: 85890 - RNA, 21 nt, Artificial Sequence
  Oligomer
cauccugaugaacucauccuu

SEQ ID NO: 85891 - RNA, 21 nt, Artificial Sequence
  Oligomer
uguccagcaccugggagaaaa

SEQ ID NO: 85892 - RNA, 21 nt, Artificial Sequence
  Oligomer
ccuccaaguuaaacagcagca

SEQ ID NO: 85893 - RNA, 21 nt, Artificial Sequence
  Oligomer
ccaaguuaaacagcagcacca

SEQ ID NO: 85894 - RNA, 21 nt, Artificial Sequence
  Oligomer
acagcagcaccaggucauacu

SEQ ID NO: 85895 - RNA, 21 nt, Artificial Sequence
  Oligomer
ggacgaaguugaccuucugug

SEQ ID NO: 85896 - RNA, 21 nt, Artificial Sequence
  Oligomer
ccuugccauuccaaagcuucc

SEQ ID NO: 85897 - RNA, 21 nt, Artificial Sequence
  Oligomer
ccuuuaugccagacaaagaca

SEQ ID NO: 85898 - RNA, 21 nt, Artificial Sequence
  Oligomer
guaaugggagacaagcccagu

SEQ ID NO: 85899 - RNA, 21 nt, Artificial Sequence
  Oligomer
acuuuguaggcuugggugcuc

SEQ ID NO: 85900 - RNA, 21 nt, Artificial Sequence
  Oligomer
agacacuugaguuccgauuga

SEQ ID NO: 85901 - RNA, 21 nt, Artificial Sequence
  Oligomer
agcacgugauagccaaagaag

SEQ ID NO: 85902 - RNA, 21 nt, Artificial Sequence
  Oligomer
agggcugaggagcauugcaua

SEQ ID NO: 85903 - RNA, 21 nt, Artificial Sequence
  Oligomer
ugaugaaagaacgugcuuaaa

SEQ ID NO: 85904 - RNA, 21 nt, Artificial Sequence
  Oligomer
ugucuucugagauuuguuucu

SEQ ID NO: 85905 - RNA, 21 nt, Artificial Sequence
  Oligomer
aacaagguugggaggugggaa

SEQ ID NO: 85906 - RNA, 21 nt, Artificial Sequence
  Oligomer
ugugaauagacuccgguucag

SEQ ID NO: 85907 - RNA, 21 nt, Artificial Sequence
  Oligomer
uccaaaugguccaucaaggua

SEQ ID NO: 85908 - RNA, 21 nt, Artificial Sequence
  Oligomer
ccaaaugguccaucaagguac

SEQ ID NO: 85909 - RNA, 21 nt, Artificial Sequence
  Oligomer
aucauggaagaggccaggaaa

SEQ ID NO: 85910 - RNA, 21 nt, Artificial Sequence
  Oligomer
auggaagaggccaggaaagag

SEQ ID NO: 85911 - RNA, 21 nt, Artificial Sequence
  Oligomer
cguagcgguugaggaagguuu

SEQ ID NO: 85912 - RNA, 21 nt, Artificial Sequence
  Oligomer
guccuugaugacuucaggcac

SEQ ID NO: 85913 - RNA, 21 nt, Artificial Sequence
  Oligomer
cguacaugcggaacauaaggc

SEQ ID NO: 85914 - RNA, 21 nt, Artificial Sequence
  Oligomer
acaaagacauugggcugcaga

SEQ ID NO: 85915 - RNA, 21 nt, Artificial Sequence
  Oligomer
aaagacauugggcugcagagc

SEQ ID NO: 85916 - RNA, 21 nt, Artificial Sequence
  Oligomer
aagacauugggcugcagagca

SEQ ID NO: 85917 - RNA, 21 nt, Artificial Sequence
  Oligomer
gguauuucggauuucuucaau

SEQ ID NO: 85918 - RNA, 21 nt, Artificial Sequence
  Oligomer
uucuucaaucuccuucuugga

SEQ ID NO: 85919 - RNA, 21 nt, Artificial Sequence
  Oligomer
ugccgaguggguuucuguaaa

SEQ ID NO: 85920 - RNA, 21 nt, Artificial Sequence
  Oligomer
aacacacauacagacaugcac

SEQ ID NO: 85921 - RNA, 21 nt, Artificial Sequence
  Oligomer
ggaagcagagguuucacuuug

SEQ ID NO: 85922 - RNA, 21 nt, Artificial Sequence
  Oligomer
ccacauucuuggucaugccag

SEQ ID NO: 85923 - RNA, 21 nt, Artificial Sequence
  Oligomer
aagaccaggucuuugaggaug

SEQ ID NO: 85924 - RNA, 21 nt, Artificial Sequence
  Oligomer
cccacuaacacugacaccuca

SEQ ID NO: 85925 - RNA, 21 nt, Artificial Sequence
  Oligomer
gguaucuggcacaucugucac

SEQ ID NO: 85926 - RNA, 21 nt, Artificial Sequence
  Oligomer
gagcucagacccaucaucaug

SEQ ID NO: 85927 - RNA, 21 nt, Artificial Sequence
  Oligomer
guaggagaacaugaaagagau

SEQ ID NO: 85928 - RNA, 21 nt, Artificial Sequence
  Oligomer
ugaagcgcuugaacuguugca

SEQ ID NO: 85929 - RNA, 21 nt, Artificial Sequence
  Oligomer
acaggcaguuguuggagaucu

SEQ ID NO: 85930 - RNA, 21 nt, Artificial Sequence
  Oligomer
acuuuuccucaggagagccuu

SEQ ID NO: 85931 - RNA, 21 nt, Artificial Sequence
  Oligomer
gugccugaaaaaggucuccag

SEQ ID NO: 85932 - RNA, 21 nt, Artificial Sequence
  Oligomer
cuuuaugccagacaaagacau

SEQ ID NO: 85933 - RNA, 21 nt, Artificial Sequence
  Oligomer
cuucuuggagaacagcccauu

SEQ ID NO: 85934 - RNA, 21 nt, Artificial Sequence
  Oligomer
gagagcucuggagacacuuga

SEQ ID NO: 85935 - RNA, 21 nt, Artificial Sequence
  Oligomer
guauacuccgggaguguuuuc

SEQ ID NO: 85936 - RNA, 21 nt, Artificial Sequence
  Oligomer
cugaaagcacgugauagccaa

SEQ ID NO: 85937 - RNA, 21 nt, Artificial Sequence
  Oligomer
cugaggagcauugcauacaua

SEQ ID NO: 85938 - RNA, 21 nt, Artificial Sequence
  Oligomer
cugaugaaagaacgugcuuaa

SEQ ID NO: 85939 - RNA, 21 nt, Artificial Sequence
  Oligomer
gguucuaagaugccagcaucc

SEQ ID NO: 85940 - RNA, 21 nt, Artificial Sequence
  Oligomer
cuacuucucacucuagucccu

SEQ ID NO: 85941 - RNA, 21 nt, Artificial Sequence
  Oligomer
ugggaaaucagagaaggcuga

SEQ ID NO: 85942 - RNA, 21 nt, Artificial Sequence
  Oligomer
ggaagaacagaggugaggugu

SEQ ID NO: 85943 - RNA, 21 nt, Artificial Sequence
  Oligomer
ugaauagacuccgguucagaa

SEQ ID NO: 85944 - RNA, 21 nt, Artificial Sequence
  Oligomer
acccagaugaaguagaucuuc

SEQ ID NO: 85945 - RNA, 21 nt, Artificial Sequence
  Oligomer
cauagagcaggauguagaggu

SEQ ID NO: 85946 - RNA, 21 nt, Artificial Sequence
  Oligomer
aggaagguuucucgcaggaag

SEQ ID NO: 85947 - RNA, 21 nt, Artificial Sequence
  Oligomer
cccaugucaguuccuccuugu

SEQ ID NO: 85948 - RNA, 21 nt, Artificial Sequence
  Oligomer
acaugcggaacauaaggcgag

SEQ ID NO: 85949 - RNA, 21 nt, Artificial Sequence
  Oligomer
cuugucagccagagagaacau

SEQ ID NO: 85950 - RNA, 21 nt, Artificial Sequence
  Oligomer
cccucaaaauagucacgaaca

SEQ ID NO: 85951 - RNA, 21 nt, Artificial Sequence
  Oligomer
cuucaaucuccuucuuggaga

SEQ ID NO: 85952 - RNA, 21 nt, Artificial Sequence
  Oligomer
ucaaucuccuucuuggagaac

SEQ ID NO: 85953 - RNA, 21 nt, Artificial Sequence
  Oligomer
agugcauccacaucuucagca

SEQ ID NO: 85954 - RNA, 21 nt, Artificial Sequence
  Oligomer
agcucuggagacacuugaguu

SEQ ID NO: 85955 - RNA, 21 nt, Artificial Sequence
  Oligomer
aguggcagcuggcauuucuca

SEQ ID NO: 85956 - RNA, 21 nt, Artificial Sequence
  Oligomer
cuaccuccugcaaggcauuug

SEQ ID NO: 85957 - RNA, 21 nt, Artificial Sequence
  Oligomer
uguuucugaagucuggaagca

SEQ ID NO: 85958 - RNA, 21 nt, Artificial Sequence
  Oligomer
auggccaccuggaacaagguu

SEQ ID NO: 85959 - RNA, 23 nt, Artificial Sequence
  Oligomer
ggaugaguucaucaggaugcuga

SEQ ID NO: 85960 - RNA, 23 nt, Artificial Sequence
  Oligomer
cuacaaagugcugaagaugugga

SEQ ID NO: 85961 - RNA, 23 nt, Artificial Sequence
  Oligomer
gaaguucgaccucaggaccacua

SEQ ID NO: 85962 - RNA, 23 nt, Artificial Sequence
  Oligomer
uacuacgccuuugccgcacauca

SEQ ID NO: 85963 - RNA, 23 nt, Artificial Sequence
  Oligomer
ucaagucauccgucagcugccaa

SEQ ID NO: 85964 - RNA, 23 nt, Artificial Sequence
  Oligomer
uaaggaugcagugggagcaugga

SEQ ID NO: 85965 - RNA, 23 nt, Artificial Sequence
  Oligomer
caucuucuuccuggucccagcaa

SEQ ID NO: 85966 - RNA, 23 nt, Artificial Sequence
  Oligomer
cuucaugcugcgggaccacaaua

SEQ ID NO: 85967 - RNA, 23 nt, Artificial Sequence
  Oligomer
gaaggucaacuucguccugucca

SEQ ID NO: 85968 - RNA, 23 nt, Artificial Sequence
  Oligomer
gaguaugaccuggugcugcuguu

SEQ ID NO: 85969 - RNA, 23 nt, Artificial Sequence
  Oligomer
gcucuagcauggacacuucuggu

SEQ ID NO: 85970 - RNA, 23 nt, Artificial Sequence
  Oligomer
auaugaucugucccucucccaga

SEQ ID NO: 85971 - RNA, 23 nt, Artificial Sequence
  Oligomer
cuuagaacccucccuacucccau

SEQ ID NO: 85972 - RNA, 23 nt, Artificial Sequence
  Oligomer
aaggaugcagugggagcauggau

SEQ ID NO: 85973 - RNA, 23 nt, Artificial Sequence
  Oligomer
guuugaguggcuggcugacauca

SEQ ID NO: 85974 - RNA, 23 nt, Artificial Sequence
  Oligomer
uucagaccuggugagcguggaaa

SEQ ID NO: 85975 - RNA, 23 nt, Artificial Sequence
  Oligomer
cuucucugauuucccaccuccca

SEQ ID NO: 85976 - RNA, 23 nt, Artificial Sequence
  Oligomer
gacuuauccuggcuagagcugcu

SEQ ID NO: 85977 - RNA, 23 nt, Artificial Sequence
  Oligomer
gauuucccaccucccaaccuugu

SEQ ID NO: 85978 - RNA, 23 nt, Artificial Sequence
  Oligomer
acuacuacgccuuugccgcacau

SEQ ID NO: 85979 - RNA, 23 nt, Artificial Sequence
  Oligomer
cuuucaucagacccuggcccaau

SEQ ID NO: 85980 - RNA, 23 nt, Artificial Sequence
  Oligomer
ccucuguugcuucccuuugguga

SEQ ID NO: 85981 - RNA, 23 nt, Artificial Sequence
  Oligomer
acaccucaccucuguucuuccua

SEQ ID NO: 85982 - RNA, 23 nt, Artificial Sequence
  Oligomer
aucugugagcggcacuuccagaa

SEQ ID NO: 85983 - RNA, 23 nt, Artificial Sequence
  Oligomer
acuucaugcugcgggaccacaau

SEQ ID NO: 85984 - RNA, 23 nt, Artificial Sequence
  Oligomer
gauuuucacuucaugcugcggga

SEQ ID NO: 85985 - RNA, 23 nt, Artificial Sequence
  Oligomer
acgucauuccagcccuugcuguu

SEQ ID NO: 85986 - RNA, 23 nt, Artificial Sequence
  Oligomer
gaaauccgaaauaccacccugca

SEQ ID NO: 85987 - RNA, 23 nt, Artificial Sequence
  Oligomer
gcugaagauguggaugcacugcu

SEQ ID NO: 85988 - RNA, 23 nt, Artificial Sequence
  Oligomer
gccugaagucaucaaggaccucu

SEQ ID NO: 85989 - RNA, 23 nt, Artificial Sequence
  Oligomer
agaaaugccagcugccacuucca

SEQ ID NO: 85990 - RNA, 23 nt, Artificial Sequence
  Oligomer
agugcucugcagcccaaugucuu

SEQ ID NO: 85991 - RNA, 23 nt, Artificial Sequence
  Oligomer
cuguucuccaagaaggagauuga

SEQ ID NO: 85992 - RNA, 23 nt, Artificial Sequence
  Oligomer
gauggugaccgcuacugguuuga

SEQ ID NO: 85993 - RNA, 23 nt, Artificial Sequence
  Oligomer
aguugagcagagguuugagccca

SEQ ID NO: 85994 - RNA, 23 nt, Artificial Sequence
  Oligomer
cuuuuccuggagagggccuacua

SEQ ID NO: 85995 - RNA, 23 nt, Artificial Sequence
  Oligomer
auucggcggagguuuggcaagaa

SEQ ID NO: 85996 - RNA, 23 nt, Artificial Sequence
  Oligomer
gugcucugcagcccaaugucuuu

SEQ ID NO: 85997 - RNA, 23 nt, Artificial Sequence
  Oligomer
gaaugggcuguucuccaagaagg

SEQ ID NO: 85998 - RNA, 23 nt, Artificial Sequence
  Oligomer
auuucgugggaggugcagcgauu

SEQ ID NO: 85999 - RNA, 23 nt, Artificial Sequence
  Oligomer
uuucagaccuggugagcguggaa

SEQ ID NO: 86000 - RNA, 23 nt, Artificial Sequence
  Oligomer
cauuuacagaaacccacucggca

SEQ ID NO: 86001 - RNA, 23 nt, Artificial Sequence
  Oligomer
cacaccucaccucuguucuuccu

SEQ ID NO: 86002 - RNA, 23 nt, Artificial Sequence
  Oligomer
cuucuuccuggucccagcaauca

SEQ ID NO: 86003 - RNA, 23 nt, Artificial Sequence
  Oligomer
gaguugacaccucagagacugca

SEQ ID NO: 86004 - RNA, 23 nt, Artificial Sequence
  Oligomer
ccugaagucaucaaggaccucug

SEQ ID NO: 86005 - RNA, 23 nt, Artificial Sequence
  Oligomer
aaagugaaaccucugcuuccaga

SEQ ID NO: 86006 - RNA, 23 nt, Artificial Sequence
  Oligomer
acagucuuacacagugugggcca

SEQ ID NO: 86007 - RNA, 23 nt, Artificial Sequence
  Oligomer
augcaaugcuccucagcccucuu

SEQ ID NO: 86008 - RNA, 23 nt, Artificial Sequence
  Oligomer
caaagugaaaccucugcuuccag

SEQ ID NO: 86009 - RNA, 23 nt, Artificial Sequence
  Oligomer
cuuuucucccaggugcuggacau

SEQ ID NO: 86010 - RNA, 23 nt, Artificial Sequence
  Oligomer
uuuccuggagagggccuacuacu

SEQ ID NO: 86011 - RNA, 23 nt, Artificial Sequence
  Oligomer
gacugaguugacaccucagagac

SEQ ID NO: 86012 - RNA, 23 nt, Artificial Sequence
  Oligomer
agugaaaccucugcuuccagacu

SEQ ID NO: 86013 - RNA, 23 nt, Artificial Sequence
  Oligomer
aagucauccgucagcugccaagu

SEQ ID NO: 86014 - RNA, 23 nt, Artificial Sequence
  Oligomer
cauccugcucuauguccugcuca

SEQ ID NO: 86015 - RNA, 23 nt, Artificial Sequence
  Oligomer
cucuuuccuggccucuuccauga

SEQ ID NO: 86016 - RNA, 23 nt, Artificial Sequence
  Oligomer
gacuuugaugggaauggccucau

SEQ ID NO: 86017 - RNA, 23 nt, Artificial Sequence
  Oligomer
auuacccgcuggcaggacaucaa

SEQ ID NO: 86018 - RNA, 23 nt, Artificial Sequence
  Oligomer
ucagaagacaagcugaccugaca

SEQ ID NO: 86019 - RNA, 23 nt, Artificial Sequence
  Oligomer
acuggugguucuuccagaccgua

SEQ ID NO: 86020 - RNA, 23 nt, Artificial Sequence
  Oligomer
cauguucuccuacaucuugcuca

SEQ ID NO: 86021 - RNA, 23 nt, Artificial Sequence
  Oligomer
gaauguggaaaaggccugucagc

SEQ ID NO: 86022 - RNA, 23 nt, Artificial Sequence
  Oligomer
ucuuagaacccucccuacuccca

SEQ ID NO: 86023 - RNA, 23 nt, Artificial Sequence
  Oligomer
acaucuucuuccuggucccagca

SEQ ID NO: 86024 - RNA, 23 nt, Artificial Sequence
  Oligomer
cuuuccuggccucuuccaugaug

SEQ ID NO: 86025 - RNA, 23 nt, Artificial Sequence
  Oligomer
gucauuccagcccuugcuguuca

SEQ ID NO: 86026 - RNA, 23 nt, Artificial Sequence
  Oligomer
aauggcuaccuguccuuccgaga

SEQ ID NO: 86027 - RNA, 23 nt, Artificial Sequence
  Oligomer
uucucccaggugcuggacaucaa

SEQ ID NO: 86028 - RNA, 23 nt, Artificial Sequence
  Oligomer
uuuaacuuggaggaagagcggca

SEQ ID NO: 86029 - RNA, 23 nt, Artificial Sequence
  Oligomer
uuuugagggcaguggauuuggcu

SEQ ID NO: 86030 - RNA, 23 nt, Artificial Sequence
  Oligomer
cuauuucuggcugccucagccuu

SEQ ID NO: 86031 - RNA, 23 nt, Artificial Sequence
  Oligomer
uacuacuacgccuuugccgcaca

SEQ ID NO: 86032 - RNA, 23 nt, Artificial Sequence
  Oligomer
auugagaacuaccggcgccacau

SEQ ID NO: 86033 - RNA, 23 nt, Artificial Sequence
  Oligomer
gagauccuucaucgagaucucca

SEQ ID NO: 86034 - RNA, 23 nt, Artificial Sequence
  Oligomer
aaagucucgccuuauguuccgca

SEQ ID NO: 86035 - RNA, 23 nt, Artificial Sequence
  Oligomer
caugagaaaugccagcugccacu

SEQ ID NO: 86036 - RNA, 23 nt, Artificial Sequence
  Oligomer
uauuauuuucaucaugggcuucu

SEQ ID NO: 86037 - RNA, 23 nt, Artificial Sequence
  Oligomer
augugccgcaaccucaucaccuu

SEQ ID NO: 86038 - RNA, 23 nt, Artificial Sequence
  Oligomer
gcaaagugaaaccucugcuucca

SEQ ID NO: 86039 - RNA, 23 nt, Artificial Sequence
  Oligomer
agaauguggaaaaggccugucag

SEQ ID NO: 86040 - RNA, 23 nt, Artificial Sequence
  Oligomer
ccaagaauguggaaaaggccugu

SEQ ID NO: 86041 - RNA, 23 nt, Artificial Sequence
  Oligomer
uacaucacccagcuggcugagaa

SEQ ID NO: 86042 - RNA, 23 nt, Artificial Sequence
  Oligomer
gucugugcacaucuacaucaccc

SEQ ID NO: 86043 - RNA, 23 nt, Artificial Sequence
  Oligomer
agauacccaaagcuguaccuuga

SEQ ID NO: 86044 - RNA, 23 nt, Artificial Sequence
  Oligomer
uguggaguccauguucucucugg

SEQ ID NO: 86045 - RNA, 23 nt, Artificial Sequence
  Oligomer
aagaauguggaaaaggccuguca

SEQ ID NO: 86046 - RNA, 23 nt, Artificial Sequence
  Oligomer
cuuugagcccuucuucaacuccc

SEQ ID NO: 86047 - RNA, 23 nt, Artificial Sequence
  Oligomer
aaacacucccggaguauacagga

SEQ ID NO: 86048 - RNA, 23 nt, Artificial Sequence
  Oligomer
gggcaaagugaaaccucugcuuc

SEQ ID NO: 86049 - RNA, 23 nt, Artificial Sequence
  Oligomer
ugagaaguucgaccucaggacca

SEQ ID NO: 86050 - RNA, 23 nt, Artificial Sequence
  Oligomer
auuccaggacaaggaggaacuga

SEQ ID NO: 86051 - RNA, 23 nt, Artificial Sequence
  Oligomer
cauuuccaaggaugaguucauca

SEQ ID NO: 86052 - RNA, 23 nt, Artificial Sequence
  Oligomer
uggaguccauguucucucuggcu

SEQ ID NO: 86053 - RNA, 23 nt, Artificial Sequence
  Oligomer
uaugcaaugcuccucagcccucu

SEQ ID NO: 86054 - RNA, 23 nt, Artificial Sequence
  Oligomer
ggauuccaggacaaggaggaacu

SEQ ID NO: 86055 - RNA, 23 nt, Artificial Sequence
  Oligomer
aggcaccuccuggagaccuuuuu

SEQ ID NO: 86056 - RNA, 23 nt, Artificial Sequence
  Oligomer
cauguguugguugaagaugugcg

SEQ ID NO: 86057 - RNA, 23 nt, Artificial Sequence
  Oligomer
uucaagucauccgucagcugcca

SEQ ID NO: 86058 - RNA, 23 nt, Artificial Sequence
  Oligomer
aggacuuauccuggcuagagcug

SEQ ID NO: 86059 - RNA, 23 nt, Artificial Sequence
  Oligomer
caaaucucagaagacaagcugac

SEQ ID NO: 86060 - RNA, 23 nt, Artificial Sequence
  Oligomer
auccugcucuauguccugcucau

SEQ ID NO: 86061 - RNA, 23 nt, Artificial Sequence
  Oligomer
augucuuugccucccaccacuuc

SEQ ID NO: 86062 - RNA, 23 nt, Artificial Sequence
  Oligomer
cauuccagcccuugcuguucacu

SEQ ID NO: 86063 - RNA, 23 nt, Artificial Sequence
  Oligomer
gauaugaucugucccucucccag

SEQ ID NO: 86064 - RNA, 23 nt, Artificial Sequence
  Oligomer
cagaaggucaacuucguccuguc

SEQ ID NO: 86065 - RNA, 23 nt, Artificial Sequence
  Oligomer
aauuucaagaggcuccagggcca

SEQ ID NO: 86066 - RNA, 23 nt, Artificial Sequence
  Oligomer
cucuguugcuucccuuuggugag

SEQ ID NO: 86067 - RNA, 23 nt, Artificial Sequence
  Oligomer
auuucccaccucccaaccuuguu

SEQ ID NO: 86068 - RNA, 23 nt, Artificial Sequence
  Oligomer
gaccacuaugcuguacaucugug

SEQ ID NO: 86069 - RNA, 23 nt, Artificial Sequence
  Oligomer
ucuucaagucauccgucagcugc

SEQ ID NO: 86070 - RNA, 23 nt, Artificial Sequence
  Oligomer
ucuucuuccuggucccagcaauc

SEQ ID NO: 86071 - RNA, 23 nt, Artificial Sequence
  Oligomer
aguauuacuggugguucuuccag

SEQ ID NO: 86072 - RNA, 23 nt, Artificial Sequence
  Oligomer
ucuugccucuuuccuggccucuu

SEQ ID NO: 86073 - RNA, 23 nt, Artificial Sequence
  Oligomer
aguugacaccucagagacugcag

SEQ ID NO: 86074 - RNA, 23 nt, Artificial Sequence
  Oligomer
uguugcuucccuuuggugagccu

SEQ ID NO: 86075 - RNA, 23 nt, Artificial Sequence
  Oligomer
aagaaauccgaaauaccacccug

SEQ ID NO: 86076 - RNA, 23 nt, Artificial Sequence
  Oligomer
ucagcauccugaugaacucaucc

SEQ ID NO: 86077 - RNA, 23 nt, Artificial Sequence
  Oligomer
uccacaucuucagcacuuuguag

SEQ ID NO: 86078 - RNA, 23 nt, Artificial Sequence
  Oligomer
uagugguccugaggucgaacuuc

SEQ ID NO: 86079 - RNA, 23 nt, Artificial Sequence
  Oligomer
ugaugugcggcaaaggcguagua

SEQ ID NO: 86080 - RNA, 23 nt, Artificial Sequence
  Oligomer
uuggcagcugacggaugacuuga

SEQ ID NO: 86081 - RNA, 23 nt, Artificial Sequence
  Oligomer
uccaugcucccacugcauccuua

SEQ ID NO: 86082 - RNA, 23 nt, Artificial Sequence
  Oligomer
uugcugggaccaggaagaagaug

SEQ ID NO: 86083 - RNA, 23 nt, Artificial Sequence
  Oligomer
uauuguggucccgcagcaugaag

SEQ ID NO: 86084 - RNA, 23 nt, Artificial Sequence
  Oligomer
uggacaggacgaaguugaccuuc

SEQ ID NO: 86085 - RNA, 23 nt, Artificial Sequence
  Oligomer
aacagcagcaccaggucauacuc

SEQ ID NO: 86086 - RNA, 23 nt, Artificial Sequence
  Oligomer
accagaaguguccaugcuagagc

SEQ ID NO: 86087 - RNA, 23 nt, Artificial Sequence
  Oligomer
ucugggagagggacagaucauau

SEQ ID NO: 86088 - RNA, 23 nt, Artificial Sequence
  Oligomer
augggaguagggaggguucuaag

SEQ ID NO: 86089 - RNA, 23 nt, Artificial Sequence
  Oligomer
auccaugcucccacugcauccuu

SEQ ID NO: 86090 - RNA, 23 nt, Artificial Sequence
  Oligomer
ugaugucagccagccacucaaac

SEQ ID NO: 86091 - RNA, 23 nt, Artificial Sequence
  Oligomer
uuuccacgcucaccaggucugaa

SEQ ID NO: 86092 - RNA, 23 nt, Artificial Sequence
  Oligomer
ugggaggugggaaaucagagaag

SEQ ID NO: 86093 - RNA, 23 nt, Artificial Sequence
  Oligomer
agcagcucuagccaggauaaguc

SEQ ID NO: 86094 - RNA, 23 nt, Artificial Sequence
  Oligomer
acaagguugggaggugggaaauc

SEQ ID NO: 86095 - RNA, 23 nt, Artificial Sequence
  Oligomer
augugcggcaaaggcguaguagu

SEQ ID NO: 86096 - RNA, 23 nt, Artificial Sequence
  Oligomer
auugggccagggucugaugaaag

SEQ ID NO: 86097 - RNA, 23 nt, Artificial Sequence
  Oligomer
ucaccaaagggaagcaacagagg

SEQ ID NO: 86098 - RNA, 23 nt, Artificial Sequence
  Oligomer
uaggaagaacagaggugaggugu

SEQ ID NO: 86099 - RNA, 23 nt, Artificial Sequence
  Oligomer
uucuggaagugccgcucacagau

SEQ ID NO: 86100 - RNA, 23 nt, Artificial Sequence
  Oligomer
auuguggucccgcagcaugaagu

SEQ ID NO: 86101 - RNA, 23 nt, Artificial Sequence
  Oligomer
ucccgcagcaugaagugaaaauc

SEQ ID NO: 86102 - RNA, 23 nt, Artificial Sequence
  Oligomer
aacagcaagggcuggaaugacgu

SEQ ID NO: 86103 - RNA, 23 nt, Artificial Sequence
  Oligomer
ugcagggugguauuucggauuuc

SEQ ID NO: 86104 - RNA, 23 nt, Artificial Sequence
  Oligomer
agcagugcauccacaucuucagc

SEQ ID NO: 86105 - RNA, 23 nt, Artificial Sequence
  Oligomer
agagguccuugaugacuucaggc

SEQ ID NO: 86106 - RNA, 23 nt, Artificial Sequence
  Oligomer
uggaaguggcagcuggcauuucu

SEQ ID NO: 86107 - RNA, 23 nt, Artificial Sequence
  Oligomer
aagacauugggcugcagagcacu

SEQ ID NO: 86108 - RNA, 23 nt, Artificial Sequence
  Oligomer
ucaaucuccuucuuggagaacag

SEQ ID NO: 86109 - RNA, 23 nt, Artificial Sequence
  Oligomer
ucaaaccaguagcggucaccauc

SEQ ID NO: 86110 - RNA, 23 nt, Artificial Sequence
  Oligomer
ugggcucaaaccucugcucaacu

SEQ ID NO: 86111 - RNA, 23 nt, Artificial Sequence
  Oligomer
uaguaggcccucuccaggaaaag

SEQ ID NO: 86112 - RNA, 23 nt, Artificial Sequence
  Oligomer
uucuugccaaaccuccgccgaau

SEQ ID NO: 86113 - RNA, 23 nt, Artificial Sequence
  Oligomer
aaagacauugggcugcagagcac

SEQ ID NO: 86114 - RNA, 23 nt, Artificial Sequence
  Oligomer
ccuucuuggagaacagcccauuc

SEQ ID NO: 86115 - RNA, 23 nt, Artificial Sequence
  Oligomer
aaucgcugcaccucccacgaaau

SEQ ID NO: 86116 - RNA, 23 nt, Artificial Sequence
  Oligomer
uuccacgcucaccaggucugaaa

SEQ ID NO: 86117 - RNA, 23 nt, Artificial Sequence
  Oligomer
ugccgaguggguuucuguaaaug

SEQ ID NO: 86118 - RNA, 23 nt, Artificial Sequence
  Oligomer
aggaagaacagaggugaggugug

SEQ ID NO: 86119 - RNA, 23 nt, Artificial Sequence
  Oligomer
ugauugcugggaccaggaagaag

SEQ ID NO: 86120 - RNA, 23 nt, Artificial Sequence
  Oligomer
ugcagucucugaggugucaacuc

SEQ ID NO: 86121 - RNA, 23 nt, Artificial Sequence
  Oligomer
cagagguccuugaugacuucagg

SEQ ID NO: 86122 - RNA, 23 nt, Artificial Sequence
  Oligomer
ucuggaagcagagguuucacuuu

SEQ ID NO: 86123 - RNA, 23 nt, Artificial Sequence
  Oligomer
uggcccacacuguguaagacugu

SEQ ID NO: 86124 - RNA, 23 nt, Artificial Sequence
  Oligomer
aagagggcugaggagcauugcau

SEQ ID NO: 86125 - RNA, 23 nt, Artificial Sequence
  Oligomer
cuggaagcagagguuucacuuug

SEQ ID NO: 86126 - RNA, 23 nt, Artificial Sequence
  Oligomer
auguccagcaccugggagaaaag

SEQ ID NO: 86127 - RNA, 23 nt, Artificial Sequence
  Oligomer
aguaguaggcccucuccaggaaa

SEQ ID NO: 86128 - RNA, 23 nt, Artificial Sequence
  Oligomer
gucucugaggugucaacucaguc

SEQ ID NO: 86129 - RNA, 23 nt, Artificial Sequence
  Oligomer
agucuggaagcagagguuucacu

SEQ ID NO: 86130 - RNA, 23 nt, Artificial Sequence
  Oligomer
acuuggcagcugacggaugacuu

SEQ ID NO: 86131 - RNA, 23 nt, Artificial Sequence
  Oligomer
ugagcaggacauagagcaggaug

SEQ ID NO: 86132 - RNA, 23 nt, Artificial Sequence
  Oligomer
ucauggaagaggccaggaaagag

SEQ ID NO: 86133 - RNA, 23 nt, Artificial Sequence
  Oligomer
augaggccauucccaucaaaguc

SEQ ID NO: 86134 - RNA, 23 nt, Artificial Sequence
  Oligomer
uugauguccugccagcggguaau

SEQ ID NO: 86135 - RNA, 23 nt, Artificial Sequence
  Oligomer
ugucaggucagcuugucuucuga

SEQ ID NO: 86136 - RNA, 23 nt, Artificial Sequence
  Oligomer
uacggucuggaagaaccaccagu

SEQ ID NO: 86137 - RNA, 23 nt, Artificial Sequence
  Oligomer
ugagcaagauguaggagaacaug

SEQ ID NO: 86138 - RNA, 23 nt, Artificial Sequence
  Oligomer
gcugacaggccuuuuccacauuc

SEQ ID NO: 86139 - RNA, 23 nt, Artificial Sequence
  Oligomer
ugggaguagggaggguucuaaga

SEQ ID NO: 86140 - RNA, 23 nt, Artificial Sequence
  Oligomer
ugcugggaccaggaagaagaugu

SEQ ID NO: 86141 - RNA, 23 nt, Artificial Sequence
  Oligomer
caucauggaagaggccaggaaag

SEQ ID NO: 86142 - RNA, 23 nt, Artificial Sequence
  Oligomer
ugaacagcaagggcuggaaugac

SEQ ID NO: 86143 - RNA, 23 nt, Artificial Sequence
  Oligomer
ucucggaaggacagguagccauu

SEQ ID NO: 86144 - RNA, 23 nt, Artificial Sequence
  Oligomer
uugauguccagcaccugggagaa

SEQ ID NO: 86145 - RNA, 23 nt, Artificial Sequence
  Oligomer
ugccgcucuuccuccaaguuaaa

SEQ ID NO: 86146 - RNA, 23 nt, Artificial Sequence
  Oligomer
agccaaauccacugcccucaaaa

SEQ ID NO: 86147 - RNA, 23 nt, Artificial Sequence
  Oligomer
aaggcugaggcagccagaaauag

SEQ ID NO: 86148 - RNA, 23 nt, Artificial Sequence
  Oligomer
ugugcggcaaaggcguaguagua

SEQ ID NO: 86149 - RNA, 23 nt, Artificial Sequence
  Oligomer
auguggcgccgguaguucucaau

SEQ ID NO: 86150 - RNA, 23 nt, Artificial Sequence
  Oligomer
uggagaucucgaugaaggaucuc

SEQ ID NO: 86151 - RNA, 23 nt, Artificial Sequence
  Oligomer
ugcggaacauaaggcgagacuuu

SEQ ID NO: 86152 - RNA, 23 nt, Artificial Sequence
  Oligomer
aguggcagcuggcauuucucaug

SEQ ID NO: 86153 - RNA, 23 nt, Artificial Sequence
  Oligomer
agaagcccaugaugaaaauaaua

SEQ ID NO: 86154 - RNA, 23 nt, Artificial Sequence
  Oligomer
aaggugaugagguugcggcacau

SEQ ID NO: 86155 - RNA, 23 nt, Artificial Sequence
  Oligomer
uggaagcagagguuucacuuugc

SEQ ID NO: 86156 - RNA, 23 nt, Artificial Sequence
  Oligomer
cugacaggccuuuuccacauucu

SEQ ID NO: 86157 - RNA, 23 nt, Artificial Sequence
  Oligomer
acaggccuuuuccacauucuugg

SEQ ID NO: 86158 - RNA, 23 nt, Artificial Sequence
  Oligomer
uucucagccagcugggugaugua

SEQ ID NO: 86159 - RNA, 23 nt, Artificial Sequence
  Oligomer
gggugauguagaugugcacagac

SEQ ID NO: 86160 - RNA, 23 nt, Artificial Sequence
  Oligomer
ucaagguacagcuuuggguaucu

SEQ ID NO: 86161 - RNA, 23 nt, Artificial Sequence
  Oligomer
ccagagagaacauggacuccaca

SEQ ID NO: 86162 - RNA, 23 nt, Artificial Sequence
  Oligomer
ugacaggccuuuuccacauucuu

SEQ ID NO: 86163 - RNA, 23 nt, Artificial Sequence
  Oligomer
gggaguugaagaagggcucaaag

SEQ ID NO: 86164 - RNA, 23 nt, Artificial Sequence
  Oligomer
uccuguauacuccgggaguguuu

SEQ ID NO: 86165 - RNA, 23 nt, Artificial Sequence
  Oligomer
gaagcagagguuucacuuugccc

SEQ ID NO: 86166 - RNA, 23 nt, Artificial Sequence
  Oligomer
ugguccugaggucgaacuucuca

SEQ ID NO: 86167 - RNA, 23 nt, Artificial Sequence
  Oligomer
ucaguuccuccuuguccuggaau

SEQ ID NO: 86168 - RNA, 23 nt, Artificial Sequence
  Oligomer
ugaugaacucauccuuggaaaug

SEQ ID NO: 86169 - RNA, 23 nt, Artificial Sequence
  Oligomer
agccagagagaacauggacucca

SEQ ID NO: 86170 - RNA, 23 nt, Artificial Sequence
  Oligomer
agagggcugaggagcauugcaua

SEQ ID NO: 86171 - RNA, 23 nt, Artificial Sequence
  Oligomer
aguuccuccuuguccuggaaucc

SEQ ID NO: 86172 - RNA, 23 nt, Artificial Sequence
  Oligomer
aaaaaggucuccaggaggugccu

SEQ ID NO: 86173 - RNA, 23 nt, Artificial Sequence
  Oligomer
cgcacaucuucaaccaacacaug

SEQ ID NO: 86174 - RNA, 23 nt, Artificial Sequence
  Oligomer
uggcagcugacggaugacuugaa

SEQ ID NO: 86175 - RNA, 23 nt, Artificial Sequence
  Oligomer
cagcucuagccaggauaaguccu

SEQ ID NO: 86176 - RNA, 23 nt, Artificial Sequence
  Oligomer
gucagcuugucuucugagauuug

SEQ ID NO: 86177 - RNA, 23 nt, Artificial Sequence
  Oligomer
augagcaggacauagagcaggau

SEQ ID NO: 86178 - RNA, 23 nt, Artificial Sequence
  Oligomer
gaaguggugggaggcaaagacau

SEQ ID NO: 86179 - RNA, 23 nt, Artificial Sequence
  Oligomer
agugaacagcaagggcuggaaug

SEQ ID NO: 86180 - RNA, 23 nt, Artificial Sequence
  Oligomer
cugggagagggacagaucauauc

SEQ ID NO: 86181 - RNA, 23 nt, Artificial Sequence
  Oligomer
gacaggacgaaguugaccuucug

SEQ ID NO: 86182 - RNA, 23 nt, Artificial Sequence
  Oligomer
uggcccuggagccucuugaaauu

SEQ ID NO: 86183 - RNA, 23 nt, Artificial Sequence
  Oligomer
cucaccaaagggaagcaacagag

SEQ ID NO: 86184 - RNA, 23 nt, Artificial Sequence
  Oligomer
aacaagguugggaggugggaaau

SEQ ID NO: 86185 - RNA, 23 nt, Artificial Sequence
  Oligomer
cacagauguacagcauagugguc

SEQ ID NO: 86186 - RNA, 23 nt, Artificial Sequence
  Oligomer
gcagcugacggaugacuugaaga

SEQ ID NO: 86187 - RNA, 23 nt, Artificial Sequence
  Oligomer
gauugcugggaccaggaagaaga

SEQ ID NO: 86188 - RNA, 23 nt, Artificial Sequence
  Oligomer
cuggaagaaccaccaguaauacu

SEQ ID NO: 86189 - RNA, 23 nt, Artificial Sequence
  Oligomer
aagaggccaggaaagaggcaaga

SEQ ID NO: 86190 - RNA, 23 nt, Artificial Sequence
  Oligomer
cugcagucucugaggugucaacu

SEQ ID NO: 86191 - RNA, 23 nt, Artificial Sequence
  Oligomer
aggcucaccaaagggaagcaaca

SEQ ID NO: 86192 - RNA, 23 nt, Artificial Sequence
  Oligomer
cagggugguauuucggauuucuu

SEQ ID NO: 86193 - RNA, 23 nt, Artificial Sequence
  Oligomer
aacaccacaacuaauuucaccca

SEQ ID NO: 86194 - RNA, 23 nt, Artificial Sequence
  Oligomer
ccaggacaaggaggaacugacau

SEQ ID NO: 86195 - RNA, 23 nt, Artificial Sequence
  Oligomer
uccaggacaaggaggaacugaca

SEQ ID NO: 86196 - RNA, 23 nt, Artificial Sequence
  Oligomer
cauggaugcuggcaucuuagaac

SEQ ID NO: 86197 - RNA, 23 nt, Artificial Sequence
  Oligomer
gcauggaugcuggcaucuuagaa

SEQ ID NO: 86198 - RNA, 23 nt, Artificial Sequence
  Oligomer
agcauggaugcuggcaucuuaga

SEQ ID NO: 86199 - RNA, 23 nt, Artificial Sequence
  Oligomer
gagcauggaugcuggcaucuuag

SEQ ID NO: 86200 - RNA, 23 nt, Artificial Sequence
  Oligomer
ggagcauggaugcuggcaucuua

SEQ ID NO: 86201 - RNA, 23 nt, Artificial Sequence
  Oligomer
ggaccacuaugcuguacaucugu

SEQ ID NO: 86202 - RNA, 23 nt, Artificial Sequence
  Oligomer
agccgagacagcucagcacugaa

SEQ ID NO: 86203 - RNA, 23 nt, Artificial Sequence
  Oligomer
ucucccggagcaaugacacugua

SEQ ID NO: 86204 - RNA, 23 nt, Artificial Sequence
  Oligomer
gggacuagagugagaaguagggg

SEQ ID NO: 86205 - RNA, 23 nt, Artificial Sequence
  Oligomer
agucuaacaccacaacuaauuuc

SEQ ID NO: 86206 - RNA, 23 nt, Artificial Sequence
  Oligomer
cagucuaacaccacaacuaauuu

SEQ ID NO: 86207 - RNA, 23 nt, Artificial Sequence
  Oligomer
ccagucuaacaccacaacuaauu

SEQ ID NO: 86208 - RNA, 23 nt, Artificial Sequence
  Oligomer
cccagucuaacaccacaacuaau

SEQ ID NO: 86209 - RNA, 23 nt, Artificial Sequence
  Oligomer
ccccagucuaacaccacaacuaa

SEQ ID NO: 86210 - RNA, 23 nt, Artificial Sequence
  Oligomer
guguaaggaugcagugggagcau

SEQ ID NO: 86211 - RNA, 23 nt, Artificial Sequence
  Oligomer
aguguaaggaugcagugggagca

SEQ ID NO: 86212 - RNA, 23 nt, Artificial Sequence
  Oligomer
gaguguaaggaugcagugggagc

SEQ ID NO: 86213 - RNA, 23 nt, Artificial Sequence
  Oligomer
ugaguguaaggaugcagugggag

SEQ ID NO: 86214 - RNA, 23 nt, Artificial Sequence
  Oligomer
gugaguguaaggaugcaguggga

SEQ ID NO: 86215 - RNA, 23 nt, Artificial Sequence
  Oligomer
cggugaguguaaggaugcagugg

SEQ ID NO: 86216 - RNA, 23 nt, Artificial Sequence
  Oligomer
gcggugaguguaaggaugcagug

SEQ ID NO: 86217 - RNA, 23 nt, Artificial Sequence
  Oligomer
ggcggugaguguaaggaugcagu

SEQ ID NO: 86218 - RNA, 23 nt, Artificial Sequence
  Oligomer
gggcggugaguguaaggaugcag

SEQ ID NO: 86219 - RNA, 23 nt, Artificial Sequence
  Oligomer
ggggcggugaguguaaggaugca

SEQ ID NO: 86220 - RNA, 23 nt, Artificial Sequence
  Oligomer
gaagaaauccgaaauaccacccu

SEQ ID NO: 86221 - RNA, 23 nt, Artificial Sequence
  Oligomer
ugaagaaauccgaaauaccaccc

SEQ ID NO: 86222 - RNA, 23 nt, Artificial Sequence
  Oligomer
uugaagaaauccgaaauaccacc

SEQ ID NO: 86223 - RNA, 23 nt, Artificial Sequence
  Oligomer
auugaagaaauccgaaauaccac

SEQ ID NO: 86224 - RNA, 23 nt, Artificial Sequence
  Oligomer
uggagaucagcguggugaaggcg

SEQ ID NO: 86225 - RNA, 23 nt, Artificial Sequence
  Oligomer
guggagaucagcguggugaaggc

SEQ ID NO: 86226 - RNA, 23 nt, Artificial Sequence
  Oligomer
gguggagaucagcguggugaagg

SEQ ID NO: 86227 - RNA, 23 nt, Artificial Sequence
  Oligomer
agguggagaucagcguggugaag

SEQ ID NO: 86228 - RNA, 23 nt, Artificial Sequence
  Oligomer
aagguggagaucagcguggugaa

SEQ ID NO: 86229 - RNA, 23 nt, Artificial Sequence
  Oligomer
cauugagacugaguugacaccuc

SEQ ID NO: 86230 - RNA, 23 nt, Artificial Sequence
  Oligomer
acauugagacugaguugacaccu

SEQ ID NO: 86231 - RNA, 23 nt, Artificial Sequence
  Oligomer
ucuccaagaaggagauugaagaa

SEQ ID NO: 86232 - RNA, 23 nt, Artificial Sequence
  Oligomer
uucuccaagaaggagauugaaga

SEQ ID NO: 86233 - RNA, 23 nt, Artificial Sequence
  Oligomer
gaaccggagucuauucacaggcc

SEQ ID NO: 86234 - RNA, 23 nt, Artificial Sequence
  Oligomer
ugaaccggagucuauucacaggc

SEQ ID NO: 86235 - RNA, 23 nt, Artificial Sequence
  Oligomer
cugaaccggagucuauucacagg

SEQ ID NO: 86236 - RNA, 23 nt, Artificial Sequence
  Oligomer
ucugaaccggagucuauucacag

SEQ ID NO: 86237 - RNA, 23 nt, Artificial Sequence
  Oligomer
uucugaaccggagucuauucaca

SEQ ID NO: 86238 - RNA, 23 nt, Artificial Sequence
  Oligomer
ggaagaagguggagaucagcgug

SEQ ID NO: 86239 - RNA, 23 nt, Artificial Sequence
  Oligomer
gaugugccagauacccaaagcug

SEQ ID NO: 86240 - RNA, 23 nt, Artificial Sequence
  Oligomer
gcuaucacgugcuuucagaccug

SEQ ID NO: 86241 - RNA, 23 nt, Artificial Sequence
  Oligomer
ggcuaucacgugcuuucagaccu

SEQ ID NO: 86242 - RNA, 23 nt, Artificial Sequence
  Oligomer
uggcuaucacgugcuuucagacc

SEQ ID NO: 86243 - RNA, 23 nt, Artificial Sequence
  Oligomer
uuggcuaucacgugcuuucagac

SEQ ID NO: 86244 - RNA, 23 nt, Artificial Sequence
  Oligomer
uuuggcuaucacgugcuuucaga

SEQ ID NO: 86245 - RNA, 23 nt, Artificial Sequence
  Oligomer
gcauaaguuugaggugucagugu

SEQ ID NO: 86246 - RNA, 23 nt, Artificial Sequence
  Oligomer
cuauuuugagggcaguggauuug

SEQ ID NO: 86247 - RNA, 23 nt, Artificial Sequence
  Oligomer
acuauuuugagggcaguggauuu

SEQ ID NO: 86248 - RNA, 23 nt, Artificial Sequence
  Oligomer
gacuauuuugagggcaguggauu

SEQ ID NO: 86249 - RNA, 23 nt, Artificial Sequence
  Oligomer
ccuauuucuggcugccucagccu

SEQ ID NO: 86250 - RNA, 23 nt, Artificial Sequence
  Oligomer
uccuauuucuggcugccucagcc

SEQ ID NO: 86251 - RNA, 23 nt, Artificial Sequence
  Oligomer
uuccuauuucuggcugccucagc

SEQ ID NO: 86252 - RNA, 23 nt, Artificial Sequence
  Oligomer
cuuccuauuucuggcugccucag

SEQ ID NO: 86253 - RNA, 23 nt, Artificial Sequence
  Oligomer
ucuuccuauuucuggcugccuca

SEQ ID NO: 86254 - RNA, 23 nt, Artificial Sequence
  Oligomer
guccuugaacaauuugugcggcu

SEQ ID NO: 86255 - RNA, 23 nt, Artificial Sequence
  Oligomer
ccagauacccaaagcuguaccuu

SEQ ID NO: 86256 - RNA, 23 nt, Artificial Sequence
  Oligomer
gccagauacccaaagcuguaccu

SEQ ID NO: 86257 - RNA, 23 nt, Artificial Sequence
  Oligomer
ugccagauacccaaagcuguacc

SEQ ID NO: 86258 - RNA, 23 nt, Artificial Sequence
  Oligomer
gugccagauacccaaagcuguac

SEQ ID NO: 86259 - RNA, 23 nt, Artificial Sequence
  Oligomer
ugugccagauacccaaagcugua

SEQ ID NO: 86260 - RNA, 23 nt, Artificial Sequence
  Oligomer
acaucacacgggcaucacagaca

SEQ ID NO: 86261 - RNA, 23 nt, Artificial Sequence
  Oligomer
cacaucacacgggcaucacagac

SEQ ID NO: 86262 - RNA, 23 nt, Artificial Sequence
  Oligomer
gcacaucacacgggcaucacaga

SEQ ID NO: 86263 - RNA, 23 nt, Artificial Sequence
  Oligomer
cgcacaucacacgggcaucacag

SEQ ID NO: 86264 - RNA, 23 nt, Artificial Sequence
  Oligomer
ccgcacaucacacgggcaucaca

SEQ ID NO: 86265 - RNA, 23 nt, Artificial Sequence
  Oligomer
ggaaugggcuguucuccaagaag

SEQ ID NO: 86266 - RNA, 23 nt, Artificial Sequence
  Oligomer
aggaaugggcuguucuccaagaa

SEQ ID NO: 86267 - RNA, 23 nt, Artificial Sequence
  Oligomer
caggaaugggcuguucuccaaga

SEQ ID NO: 86268 - RNA, 23 nt, Artificial Sequence
  Oligomer
ccaggaaugggcuguucuccaag

SEQ ID NO: 86269 - RNA, 23 nt, Artificial Sequence
  Oligomer
accaggaaugggcuguucuccaa

SEQ ID NO: 86270 - RNA, 23 nt, Artificial Sequence
  Oligomer
gucuaacaccacaacuaauuuca

SEQ ID NO: 86271 - RNA, 23 nt, Artificial Sequence
  Oligomer
cugauuucccaccucccaaccuu

SEQ ID NO: 86272 - RNA, 23 nt, Artificial Sequence
  Oligomer
ucugauuucccaccucccaaccu

SEQ ID NO: 86273 - RNA, 23 nt, Artificial Sequence
  Oligomer
cucugauuucccaccucccaacc

SEQ ID NO: 86274 - RNA, 23 nt, Artificial Sequence
  Oligomer
ucucugauuucccaccucccaac

SEQ ID NO: 86275 - RNA, 23 nt, Artificial Sequence
  Oligomer
uucucugauuucccaccucccaa

SEQ ID NO: 86276 - RNA, 23 nt, Artificial Sequence
  Oligomer
uggcaugaccaagaauguggaaa

SEQ ID NO: 86277 - RNA, 23 nt, Artificial Sequence
  Oligomer
cuggcaugaccaagaauguggaa

SEQ ID NO: 86278 - RNA, 23 nt, Artificial Sequence
  Oligomer
ccuggcaugaccaagaaugugga

SEQ ID NO: 86279 - RNA, 23 nt, Artificial Sequence
  Oligomer
gagagguggaggagaaugaccac

SEQ ID NO: 86280 - RNA, 23 nt, Artificial Sequence
  Oligomer
cgagagguggaggagaaugacca

SEQ ID NO: 86281 - RNA, 23 nt, Artificial Sequence
  Oligomer
ccgagagguggaggagaaugacc

SEQ ID NO: 86282 - RNA, 23 nt, Artificial Sequence
  Oligomer
uccgagagguggaggagaaugac

SEQ ID NO: 86283 - RNA, 23 nt, Artificial Sequence
  Oligomer
auccgagagguggaggagaauga

SEQ ID NO: 86284 - RNA, 23 nt, Artificial Sequence
  Oligomer
gaugagagcagcugugacacggg

SEQ ID NO: 86285 - RNA, 23 nt, Artificial Sequence
  Oligomer
ugaugagagcagcugugacacgg

SEQ ID NO: 86286 - RNA, 23 nt, Artificial Sequence
  Oligomer
cugaugagagcagcugugacacg

SEQ ID NO: 86287 - RNA, 23 nt, Artificial Sequence
  Oligomer
gcugaugagagcagcugugacac

SEQ ID NO: 86288 - RNA, 23 nt, Artificial Sequence
  Oligomer
agcugaugagagcagcugugaca

SEQ ID NO: 86289 - RNA, 23 nt, Artificial Sequence
  Oligomer
caucauccaugguagcuuugccc

SEQ ID NO: 86290 - RNA, 23 nt, Artificial Sequence
  Oligomer
agaagguaacgucauuccagccc

SEQ ID NO: 86291 - RNA, 23 nt, Artificial Sequence
  Oligomer
aagaagguaacgucauuccagcc

SEQ ID NO: 86292 - RNA, 23 nt, Artificial Sequence
  Oligomer
ccgcagcgacauugagacugagu

SEQ ID NO: 86293 - RNA, 23 nt, Artificial Sequence
  Oligomer
cccgcagcgacauugagacugag

SEQ ID NO: 86294 - RNA, 23 nt, Artificial Sequence
  Oligomer
ucccgcagcgacauugagacuga

SEQ ID NO: 86295 - RNA, 23 nt, Artificial Sequence
  Oligomer
cacgcagcucugugucaaagggg

SEQ ID NO: 86296 - RNA, 23 nt, Artificial Sequence
  Oligomer
ucacgcagcucugugucaaaggg

SEQ ID NO: 86297 - RNA, 23 nt, Artificial Sequence
  Oligomer
uucacgcagcucugugucaaagg

SEQ ID NO: 86298 - RNA, 23 nt, Artificial Sequence
  Oligomer
cuucacgcagcucugugucaaag

SEQ ID NO: 86299 - RNA, 23 nt, Artificial Sequence
  Oligomer
gcuucacgcagcucugugucaaa

SEQ ID NO: 86300 - RNA, 23 nt, Artificial Sequence
  Oligomer
gcagauccgugugguagauggca

SEQ ID NO: 86301 - RNA, 23 nt, Artificial Sequence
  Oligomer
ggcagauccgugugguagauggc

SEQ ID NO: 86302 - RNA, 23 nt, Artificial Sequence
  Oligomer
gggcagauccgugugguagaugg

SEQ ID NO: 86303 - RNA, 23 nt, Artificial Sequence
  Oligomer
cgggcagauccgugugguagaug

SEQ ID NO: 86304 - RNA, 23 nt, Artificial Sequence
  Oligomer
ccgggcagauccgugugguagau

SEQ ID NO: 86305 - RNA, 23 nt, Artificial Sequence
  Oligomer
ggcuguucuccaagaaggagauu

SEQ ID NO: 86306 - RNA, 23 nt, Artificial Sequence
  Oligomer
gggcuguucuccaagaaggagau

SEQ ID NO: 86307 - RNA, 23 nt, Artificial Sequence
  Oligomer
ugggcuguucuccaagaaggaga

SEQ ID NO: 86308 - RNA, 23 nt, Artificial Sequence
  Oligomer
augggcuguucuccaagaaggag

SEQ ID NO: 86309 - RNA, 23 nt, Artificial Sequence
  Oligomer
aaugggcuguucuccaagaagga

SEQ ID NO: 86310 - RNA, 23 nt, Artificial Sequence
  Oligomer
ggacuagagugagaaguagggga

SEQ ID NO: 86311 - RNA, 23 nt, Artificial Sequence
  Oligomer
gaugugucucagccuggagaaau

SEQ ID NO: 86312 - RNA, 23 nt, Artificial Sequence
  Oligomer
ggaugugucucagccuggagaaa

SEQ ID NO: 86313 - RNA, 23 nt, Artificial Sequence
  Oligomer
gauuugaugggugguacaacaac

SEQ ID NO: 86314 - RNA, 23 nt, Artificial Sequence
  Oligomer
gguucugaaccggagucuauuca

SEQ ID NO: 86315 - RNA, 23 nt, Artificial Sequence
  Oligomer
agguucugaaccggagucuauuc

SEQ ID NO: 86316 - RNA, 23 nt, Artificial Sequence
  Oligomer
aagguucugaaccggagucuauu

SEQ ID NO: 86317 - RNA, 23 nt, Artificial Sequence
  Oligomer
gaagguucugaaccggagucuau

SEQ ID NO: 86318 - RNA, 23 nt, Artificial Sequence
  Oligomer
guuugagaacaccaggaaugggc

SEQ ID NO: 86319 - RNA, 23 nt, Artificial Sequence
  Oligomer
aacccucccuacucccauaccuc

SEQ ID NO: 86320 - RNA, 23 nt, Artificial Sequence
  Oligomer
gaacccucccuacucccauaccu

SEQ ID NO: 86321 - RNA, 23 nt, Artificial Sequence
  Oligomer
agaacccucccuacucccauacc

SEQ ID NO: 86322 - RNA, 23 nt, Artificial Sequence
  Oligomer
uagaacccucccuacucccauac

SEQ ID NO: 86323 - RNA, 23 nt, Artificial Sequence
  Oligomer
uuagaacccucccuacucccaua

SEQ ID NO: 86324 - RNA, 23 nt, Artificial Sequence
  Oligomer
uggaugcuggcaucuuagaaccc

SEQ ID NO: 86325 - RNA, 23 nt, Artificial Sequence
  Oligomer
auggaugcuggcaucuuagaacc

SEQ ID NO: 86326 - RNA, 23 nt, Artificial Sequence
  Oligomer
uuugaugggugguacaacaaccu

SEQ ID NO: 86327 - RNA, 23 nt, Artificial Sequence
  Oligomer
auuugaugggugguacaacaacc

SEQ ID NO: 86328 - RNA, 23 nt, Artificial Sequence
  Oligomer
gugacagaugugccagauaccca

SEQ ID NO: 86329 - RNA, 23 nt, Artificial Sequence
  Oligomer
guagcuuugcccugauccagcug

SEQ ID NO: 86330 - RNA, 23 nt, Artificial Sequence
  Oligomer
gguagcuuugcccugauccagcu

SEQ ID NO: 86331 - RNA, 23 nt, Artificial Sequence
  Oligomer
ggaaaagucucgccuuauguucc

SEQ ID NO: 86332 - RNA, 23 nt, Artificial Sequence
  Oligomer
gaagcuuuggaauggcaaggcca

SEQ ID NO: 86333 - RNA, 23 nt, Artificial Sequence
  Oligomer
cggccccagggcuuugaguacaa

SEQ ID NO: 86334 - RNA, 23 nt, Artificial Sequence
  Oligomer
caggauaccggccauuucuggac

SEQ ID NO: 86335 - RNA, 23 nt, Artificial Sequence
  Oligomer
acaggauaccggccauuucugga

SEQ ID NO: 86336 - RNA, 23 nt, Artificial Sequence
  Oligomer
uacaggauaccggccauuucugg

SEQ ID NO: 86337 - RNA, 23 nt, Artificial Sequence
  Oligomer
caagcugaccugacaaguacuau

SEQ ID NO: 86338 - RNA, 23 nt, Artificial Sequence
  Oligomer
acaagcugaccugacaaguacua

SEQ ID NO: 86339 - RNA, 23 nt, Artificial Sequence
  Oligomer
guucugaaccggagucuauucac

SEQ ID NO: 86340 - RNA, 23 nt, Artificial Sequence
  Oligomer
uucaugaaaggcucuccugagga

SEQ ID NO: 86341 - RNA, 23 nt, Artificial Sequence
  Oligomer
cuucaugaaaggcucuccugagg

SEQ ID NO: 86342 - RNA, 23 nt, Artificial Sequence
  Oligomer
ucuucaugaaaggcucuccugag

SEQ ID NO: 86343 - RNA, 23 nt, Artificial Sequence
  Oligomer
gucuucaugaaaggcucuccuga

SEQ ID NO: 86344 - RNA, 23 nt, Artificial Sequence
  Oligomer
cuuugucuggcauaaaggagacc

SEQ ID NO: 86345 - RNA, 23 nt, Artificial Sequence
  Oligomer
ucuuugucuggcauaaaggagac

SEQ ID NO: 86346 - RNA, 23 nt, Artificial Sequence
  Oligomer
ugaaguuuucccgcacagaccac

SEQ ID NO: 86347 - RNA, 23 nt, Artificial Sequence
  Oligomer
cugaaguuuucccgcacagacca

SEQ ID NO: 86348 - RNA, 23 nt, Artificial Sequence
  Oligomer
ucugguuccgcuaccacaaccug

SEQ ID NO: 86349 - RNA, 23 nt, Artificial Sequence
  Oligomer
cucugguuccgcuaccacaaccu

SEQ ID NO: 86350 - RNA, 23 nt, Artificial Sequence
  Oligomer
gcucugguuccgcuaccacaacc

SEQ ID NO: 86351 - RNA, 23 nt, Artificial Sequence
  Oligomer
ugcucugguuccgcuaccacaac

SEQ ID NO: 86352 - RNA, 23 nt, Artificial Sequence
  Oligomer
cugcucugguuccgcuaccacaa

SEQ ID NO: 86353 - RNA, 23 nt, Artificial Sequence
  Oligomer
accccagucuaacaccacaacua

SEQ ID NO: 86354 - RNA, 23 nt, Artificial Sequence
  Oligomer
cuuccagaagguucugaaccgga

SEQ ID NO: 86355 - RNA, 23 nt, Artificial Sequence
  Oligomer
ucagcguccucucuugccucuuu

SEQ ID NO: 86356 - RNA, 23 nt, Artificial Sequence
  Oligomer
aauuugugcggcuacgggauggu

SEQ ID NO: 86357 - RNA, 23 nt, Artificial Sequence
  Oligomer
caauuugugcggcuacgggaugg

SEQ ID NO: 86358 - RNA, 23 nt, Artificial Sequence
  Oligomer
acaauuugugcggcuacgggaug

SEQ ID NO: 86359 - RNA, 23 nt, Artificial Sequence
  Oligomer
aacaauuugugcggcuacgggau

SEQ ID NO: 86360 - RNA, 23 nt, Artificial Sequence
  Oligomer
uaauuucacccaagguuuuaagc

SEQ ID NO: 86361 - RNA, 23 nt, Artificial Sequence
  Oligomer
uaacaccacaacuaauuucaccc

SEQ ID NO: 86362 - RNA, 23 nt, Artificial Sequence
  Oligomer
cuaacaccacaacuaauuucacc

SEQ ID NO: 86363 - RNA, 23 nt, Artificial Sequence
  Oligomer
ucuaacaccacaacuaauuucac

SEQ ID NO: 86364 - RNA, 23 nt, Artificial Sequence
  Oligomer
cauccaugguagcuuugcccuga

SEQ ID NO: 86365 - RNA, 23 nt, Artificial Sequence
  Oligomer
uggagagggccuacuacuacgcc

SEQ ID NO: 86366 - RNA, 23 nt, Artificial Sequence
  Oligomer
cuggagagggccuacuacuacgc

SEQ ID NO: 86367 - RNA, 23 nt, Artificial Sequence
  Oligomer
ccuggagagggccuacuacuacg

SEQ ID NO: 86368 - RNA, 23 nt, Artificial Sequence
  Oligomer
uccuggagagggccuacuacuac

SEQ ID NO: 86369 - RNA, 23 nt, Artificial Sequence
  Oligomer
uuccuggagagggccuacuacua

SEQ ID NO: 86370 - RNA, 23 nt, Artificial Sequence
  Oligomer
ucacgugcuuucagaccugguga

SEQ ID NO: 86371 - RNA, 23 nt, Artificial Sequence
  Oligomer
gcugaccugacaaguacuaugug

SEQ ID NO: 86372 - RNA, 23 nt, Artificial Sequence
  Oligomer
agcugaccugacaaguacuaugu

SEQ ID NO: 86373 - RNA, 23 nt, Artificial Sequence
  Oligomer
aagcugaccugacaaguacuaug

SEQ ID NO: 86374 - RNA, 23 nt, Artificial Sequence
  Oligomer
uuccuggucccagcaaucaucua

SEQ ID NO: 86375 - RNA, 23 nt, Artificial Sequence
  Oligomer
ggacuuccaucgccucauugccu

SEQ ID NO: 86376 - RNA, 23 nt, Artificial Sequence
  Oligomer
aggaugaguucaucaggaugcug

SEQ ID NO: 86377 - RNA, 23 nt, Artificial Sequence
  Oligomer
aaggaugaguucaucaggaugcu

SEQ ID NO: 86378 - RNA, 23 nt, Artificial Sequence
  Oligomer
caaggaugaguucaucaggaugc

SEQ ID NO: 86379 - RNA, 23 nt, Artificial Sequence
  Oligomer
guccauguucucucuggcugaca

SEQ ID NO: 86380 - RNA, 23 nt, Artificial Sequence
  Oligomer
aguccauguucucucuggcugac

SEQ ID NO: 86381 - RNA, 23 nt, Artificial Sequence
  Oligomer
gaguccauguucucucuggcuga

SEQ ID NO: 86382 - RNA, 23 nt, Artificial Sequence
  Oligomer
gcacucugcugcucaagaucccc

SEQ ID NO: 86383 - RNA, 23 nt, Artificial Sequence
  Oligomer
cgcacucugcugcucaagauccc

SEQ ID NO: 86384 - RNA, 23 nt, Artificial Sequence
  Oligomer
ccgcacucugcugcucaagaucc

SEQ ID NO: 86385 - RNA, 23 nt, Artificial Sequence
  Oligomer
gccgcacucugcugcucaagauc

SEQ ID NO: 86386 - RNA, 23 nt, Artificial Sequence
  Oligomer
cgccgcacucugcugcucaagau

SEQ ID NO: 86387 - RNA, 23 nt, Artificial Sequence
  Oligomer
gaaauaccacccugcaggacgug

SEQ ID NO: 86388 - RNA, 23 nt, Artificial Sequence
  Oligomer
cgaaauaccacccugcaggacgu

SEQ ID NO: 86389 - RNA, 23 nt, Artificial Sequence
  Oligomer
ccgaaauaccacccugcaggacg

SEQ ID NO: 86390 - RNA, 23 nt, Artificial Sequence
  Oligomer
uccgaaauaccacccugcaggac

SEQ ID NO: 86391 - RNA, 23 nt, Artificial Sequence
  Oligomer
auccgaaauaccacccugcagga

SEQ ID NO: 86392 - RNA, 23 nt, Artificial Sequence
  Oligomer
ggucaucgccaccuaccagaaca

SEQ ID NO: 86393 - RNA, 23 nt, Artificial Sequence
  Oligomer
gggucaucgccaccuaccagaac

SEQ ID NO: 86394 - RNA, 23 nt, Artificial Sequence
  Oligomer
agggucaucgccaccuaccagaa

SEQ ID NO: 86395 - RNA, 23 nt, Artificial Sequence
  Oligomer
cuauguaugcaaugcuccucagc

SEQ ID NO: 86396 - RNA, 23 nt, Artificial Sequence
  Oligomer
ccuauguaugcaaugcuccucag

SEQ ID NO: 86397 - RNA, 23 nt, Artificial Sequence
  Oligomer
uuuuaagcacguucuuucaucag

SEQ ID NO: 86398 - RNA, 23 nt, Artificial Sequence
  Oligomer
guuuuaagcacguucuuucauca

SEQ ID NO: 86399 - RNA, 23 nt, Artificial Sequence
  Oligomer
ccuuugagcccuucuucaacucc

SEQ ID NO: 86400 - RNA, 23 nt, Artificial Sequence
  Oligomer
gcuguacaucugugagcggcacu

SEQ ID NO: 86401 - RNA, 23 nt, Artificial Sequence
  Oligomer
ugcuguacaucugugagcggcac

SEQ ID NO: 86402 - RNA, 23 nt, Artificial Sequence
  Oligomer
augcuguacaucugugagcggca

SEQ ID NO: 86403 - RNA, 23 nt, Artificial Sequence
  Oligomer
gugucugugcacaucuacaucac

SEQ ID NO: 86404 - RNA, 23 nt, Artificial Sequence
  Oligomer
ggugucugugcacaucuacauca

SEQ ID NO: 86405 - RNA, 23 nt, Artificial Sequence
  Oligomer
aaggcucuccugaggaaaagucu

SEQ ID NO: 86406 - RNA, 23 nt, Artificial Sequence
  Oligomer
aaaggcucuccugaggaaaaguc

SEQ ID NO: 86407 - RNA, 23 nt, Artificial Sequence
  Oligomer
cucuguucagcaccaucguccuu

SEQ ID NO: 86408 - RNA, 23 nt, Artificial Sequence
  Oligomer
ccucuguucagcaccaucguccu

SEQ ID NO: 86409 - RNA, 23 nt, Artificial Sequence
  Oligomer
accucuguucagcaccaucgucc

SEQ ID NO: 86410 - RNA, 23 nt, Artificial Sequence
  Oligomer
aguuuucccgcacagaccaccug

SEQ ID NO: 86411 - RNA, 23 nt, Artificial Sequence
  Oligomer
aaguuuucccgcacagaccaccu

SEQ ID NO: 86412 - RNA, 23 nt, Artificial Sequence
  Oligomer
gaaguuuucccgcacagaccacc

SEQ ID NO: 86413 - RNA, 23 nt, Artificial Sequence
  Oligomer
caaagugcugaagauguggaugc

SEQ ID NO: 86414 - RNA, 23 nt, Artificial Sequence
  Oligomer
acaaagugcugaagauguggaug

SEQ ID NO: 86415 - RNA, 23 nt, Artificial Sequence
  Oligomer
uacaaagugcugaagauguggau

SEQ ID NO: 86416 - RNA, 23 nt, Artificial Sequence
  Oligomer
ccaagccuacaaagugcugaaga

SEQ ID NO: 86417 - RNA, 23 nt, Artificial Sequence
  Oligomer
ggugaguguaaggaugcaguggg

SEQ ID NO: 86418 - RNA, 23 nt, Artificial Sequence
  Oligomer
caaguacuaugugugugcauguc

SEQ ID NO: 86419 - RNA, 23 nt, Artificial Sequence
  Oligomer
acaaguacuaugugugugcaugu

SEQ ID NO: 86420 - RNA, 23 nt, Artificial Sequence
  Oligomer
gacaaguacuaugugugugcaug

SEQ ID NO: 86421 - RNA, 23 nt, Artificial Sequence
  Oligomer
ugacaaguacuaugugugugcau

SEQ ID NO: 86422 - RNA, 23 nt, Artificial Sequence
  Oligomer
cugacaaguacuaugugugugca

SEQ ID NO: 86423 - RNA, 23 nt, Artificial Sequence
  Oligomer
ggugucaguguuagugggagggg

SEQ ID NO: 86424 - RNA, 23 nt, Artificial Sequence
  Oligomer
aggugucaguguuagugggaggg

SEQ ID NO: 86425 - RNA, 23 nt, Artificial Sequence
  Oligomer
gaggugucaguguuagugggagg

SEQ ID NO: 86426 - RNA, 23 nt, Artificial Sequence
  Oligomer
ccugauccuggccaucauguaug

SEQ ID NO: 86427 - RNA, 23 nt, Artificial Sequence
  Oligomer
uccugauccuggccaucauguau

SEQ ID NO: 86428 - RNA, 23 nt, Artificial Sequence
  Oligomer
cuccugauccuggccaucaugua

SEQ ID NO: 86429 - RNA, 23 nt, Artificial Sequence
  Oligomer
gcuccugauccuggccaucaugu

SEQ ID NO: 86430 - RNA, 23 nt, Artificial Sequence
  Oligomer
ugcuccugauccuggccaucaug

SEQ ID NO: 86431 - RNA, 23 nt, Artificial Sequence
  Oligomer
cugcuccugauccuggccaucau

SEQ ID NO: 86432 - RNA, 23 nt, Artificial Sequence
  Oligomer
agcccuugcuguucacugaggcg

SEQ ID NO: 86433 - RNA, 23 nt, Artificial Sequence
  Oligomer
cagcccuugcuguucacugaggc

SEQ ID NO: 86434 - RNA, 23 nt, Artificial Sequence
  Oligomer
ccagcccuugcuguucacugagg

SEQ ID NO: 86435 - RNA, 23 nt, Artificial Sequence
  Oligomer
uccagcccuugcuguucacugag

SEQ ID NO: 86436 - RNA, 23 nt, Artificial Sequence
  Oligomer
uuccagcccuugcuguucacuga

SEQ ID NO: 86437 - RNA, 23 nt, Artificial Sequence
  Oligomer
gaaaagucucgccuuauguuccg

SEQ ID NO: 86438 - RNA, 23 nt, Artificial Sequence
  Oligomer
caaggauggcaauggcuaccugu

SEQ ID NO: 86439 - RNA, 23 nt, Artificial Sequence
  Oligomer
acaaggauggcaauggcuaccug

SEQ ID NO: 86440 - RNA, 23 nt, Artificial Sequence
  Oligomer
gacaaggauggcaauggcuaccu

SEQ ID NO: 86441 - RNA, 23 nt, Artificial Sequence
  Oligomer
ugacaaggauggcaauggcuacc

SEQ ID NO: 86442 - RNA, 23 nt, Artificial Sequence
  Oligomer
cugacaaggauggcaauggcuac

SEQ ID NO: 86443 - RNA, 23 nt, Artificial Sequence
  Oligomer
ccuuuuucaggcaccuuuucucc

SEQ ID NO: 86444 - RNA, 23 nt, Artificial Sequence
  Oligomer
accuuuuucaggcaccuuuucuc

SEQ ID NO: 86445 - RNA, 23 nt, Artificial Sequence
  Oligomer
gaccuuuuucaggcaccuuuucu

SEQ ID NO: 86446 - RNA, 23 nt, Artificial Sequence
  Oligomer
agaccuuuuucaggcaccuuuuc

SEQ ID NO: 86447 - RNA, 23 nt, Artificial Sequence
  Oligomer
gagaccuuuuucaggcaccuuuu

SEQ ID NO: 86448 - RNA, 23 nt, Artificial Sequence
  Oligomer
uggugaccgcuacugguuugaga

SEQ ID NO: 86449 - RNA, 23 nt, Artificial Sequence
  Oligomer
augccuugcaggagguagaggcu

SEQ ID NO: 86450 - RNA, 23 nt, Artificial Sequence
  Oligomer
aaugccuugcaggagguagaggc

SEQ ID NO: 86451 - RNA, 23 nt, Artificial Sequence
  Oligomer
aaaugccuugcaggagguagagg

SEQ ID NO: 86452 - RNA, 23 nt, Artificial Sequence
  Oligomer
caaaugccuugcaggagguagag

SEQ ID NO: 86453 - RNA, 23 nt, Artificial Sequence
  Oligomer
gcaaaugccuugcaggagguaga

SEQ ID NO: 86454 - RNA, 23 nt, Artificial Sequence
  Oligomer
cuuguuccagguggccauaguca

SEQ ID NO: 86455 - RNA, 23 nt, Artificial Sequence
  Oligomer
ccuuguuccagguggccauaguc

SEQ ID NO: 86456 - RNA, 23 nt, Artificial Sequence
  Oligomer
accuuguuccagguggccauagu

SEQ ID NO: 86457 - RNA, 23 nt, Artificial Sequence
  Oligomer
aaccuuguuccagguggccauag

SEQ ID NO: 86458 - RNA, 23 nt, Artificial Sequence
  Oligomer
caaccuuguuccagguggccaua

SEQ ID NO: 86459 - RNA, 23 nt, Artificial Sequence
  Oligomer
caccucaccucuguucuuccuau

SEQ ID NO: 86460 - RNA, 23 nt, Artificial Sequence
  Oligomer
acaucauccgagagguggaggag

SEQ ID NO: 86461 - RNA, 23 nt, Artificial Sequence
  Oligomer
gacaucauccgagagguggagga

SEQ ID NO: 86462 - RNA, 23 nt, Artificial Sequence
  Oligomer
ugacaucauccgagagguggagg

SEQ ID NO: 86463 - RNA, 23 nt, Artificial Sequence
  Oligomer
cugacaucauccgagagguggag

SEQ ID NO: 86464 - RNA, 23 nt, Artificial Sequence
  Oligomer
gcugacaucauccgagaggugga

SEQ ID NO: 86465 - RNA, 23 nt, Artificial Sequence
  Oligomer
uggcugacaucauccgagaggug

SEQ ID NO: 86466 - RNA, 23 nt, Artificial Sequence
  Oligomer
cuggcugacaucauccgagaggu

SEQ ID NO: 86467 - RNA, 23 nt, Artificial Sequence
  Oligomer
gcuggcugacaucauccgagagg

SEQ ID NO: 86468 - RNA, 23 nt, Artificial Sequence
  Oligomer
ggcuggcugacaucauccgagag

SEQ ID NO: 86469 - RNA, 23 nt, Artificial Sequence
  Oligomer
uggcuggcugacaucauccgaga

SEQ ID NO: 86470 - RNA, 23 nt, Artificial Sequence
  Oligomer
augugccagauacccaaagcugu

SEQ ID NO: 86471 - RNA, 23 nt, Artificial Sequence
  Oligomer
cucuuccaugaugaugggucuga

SEQ ID NO: 86472 - RNA, 23 nt, Artificial Sequence
  Oligomer
ccucuuccaugaugaugggucug

SEQ ID NO: 86473 - RNA, 23 nt, Artificial Sequence
  Oligomer
gcugacaaggauggcaauggcua

SEQ ID NO: 86474 - RNA, 23 nt, Artificial Sequence
  Oligomer
uauuuugagggcaguggauuugg

SEQ ID NO: 86475 - RNA, 23 nt, Artificial Sequence
  Oligomer
ccugacaaguacuaugugugugc

SEQ ID NO: 86476 - RNA, 23 nt, Artificial Sequence
  Oligomer
accugacaaguacuaugugugug

SEQ ID NO: 86477 - RNA, 23 nt, Artificial Sequence
  Oligomer
gaccugacaaguacuaugugugu

SEQ ID NO: 86478 - RNA, 23 nt, Artificial Sequence
  Oligomer
ugaccugacaaguacuaugugug

SEQ ID NO: 86479 - RNA, 23 nt, Artificial Sequence
  Oligomer
cugaccugacaaguacuaugugu

SEQ ID NO: 86480 - RNA, 23 nt, Artificial Sequence
  Oligomer
cccuggcaugaccaagaaugugg

SEQ ID NO: 86481 - RNA, 23 nt, Artificial Sequence
  Oligomer
ccccuggcaugaccaagaaugug

SEQ ID NO: 86482 - RNA, 23 nt, Artificial Sequence
  Oligomer
cccccuggcaugaccaagaaugu

SEQ ID NO: 86483 - RNA, 23 nt, Artificial Sequence
  Oligomer
ccccccuggcaugaccaagaaug

SEQ ID NO: 86484 - RNA, 23 nt, Artificial Sequence
  Oligomer
gccccccuggcaugaccaagaau

SEQ ID NO: 86485 - RNA, 23 nt, Artificial Sequence
  Oligomer
aaguauuacuggugguucuucca

SEQ ID NO: 86486 - RNA, 23 nt, Artificial Sequence
  Oligomer
gaaguauuacuggugguucuucc

SEQ ID NO: 86487 - RNA, 23 nt, Artificial Sequence
  Oligomer
aucacacgggcaucacagacacc

SEQ ID NO: 86488 - RNA, 23 nt, Artificial Sequence
  Oligomer
caucacacgggcaucacagacac

SEQ ID NO: 86489 - RNA, 23 nt, Artificial Sequence
  Oligomer
agacugaguugacaccucagaga

SEQ ID NO: 86490 - RNA, 23 nt, Artificial Sequence
  Oligomer
gagacugaguugacaccucagag

SEQ ID NO: 86491 - RNA, 23 nt, Artificial Sequence
  Oligomer
ugagacugaguugacaccucaga

SEQ ID NO: 86492 - RNA, 23 nt, Artificial Sequence
  Oligomer
uugagacugaguugacaccucag

SEQ ID NO: 86493 - RNA, 23 nt, Artificial Sequence
  Oligomer
auugagacugaguugacaccuca

SEQ ID NO: 86494 - RNA, 23 nt, Artificial Sequence
  Oligomer
aguuccucaacauucgcaucccg

SEQ ID NO: 86495 - RNA, 23 nt, Artificial Sequence
  Oligomer
gaguuccucaacauucgcauccc

SEQ ID NO: 86496 - RNA, 23 nt, Artificial Sequence
  Oligomer
cgaguuccucaacauucgcaucc

SEQ ID NO: 86497 - RNA, 23 nt, Artificial Sequence
  Oligomer
ucuucucccugcuccaguagucu

SEQ ID NO: 86498 - RNA, 23 nt, Artificial Sequence
  Oligomer
cucuucucccugcuccaguaguc

SEQ ID NO: 86499 - RNA, 23 nt, Artificial Sequence
  Oligomer
ccucuucucccugcuccaguagu

SEQ ID NO: 86500 - RNA, 23 nt, Artificial Sequence
  Oligomer
cccucuucucccugcuccaguag

SEQ ID NO: 86501 - RNA, 23 nt, Artificial Sequence
  Oligomer
gcccucuucucccugcuccagua

SEQ ID NO: 86502 - RNA, 23 nt, Artificial Sequence
  Oligomer
cuaugugugugcaugucuguaug

SEQ ID NO: 86503 - RNA, 23 nt, Artificial Sequence
  Oligomer
acuaugugugugcaugucuguau

SEQ ID NO: 86504 - RNA, 23 nt, Artificial Sequence
  Oligomer
guacuaugugugugcaugucugu

SEQ ID NO: 86505 - RNA, 23 nt, Artificial Sequence
  Oligomer
aguacuaugugugugcaugucug

SEQ ID NO: 86506 - RNA, 23 nt, Artificial Sequence
  Oligomer
uugaugggugguacaacaaccuc

SEQ ID NO: 86507 - RNA, 23 nt, Artificial Sequence
  Oligomer
acuuccagaagguucugaaccgg

SEQ ID NO: 86508 - RNA, 23 nt, Artificial Sequence
  Oligomer
cacuuccagaagguucugaaccg

SEQ ID NO: 86509 - RNA, 23 nt, Artificial Sequence
  Oligomer
gcacuuccagaagguucugaacc

SEQ ID NO: 86510 - RNA, 23 nt, Artificial Sequence
  Oligomer
ccugcucuauguccugcucauca

SEQ ID NO: 86511 - RNA, 23 nt, Artificial Sequence
  Oligomer
cuuccugcgagaaaccuuccuca

SEQ ID NO: 86512 - RNA, 23 nt, Artificial Sequence
  Oligomer
gacauccugguggucuucaugaa

SEQ ID NO: 86513 - RNA, 23 nt, Artificial Sequence
  Oligomer
ggacauccugguggucuucauga

SEQ ID NO: 86514 - RNA, 23 nt, Artificial Sequence
  Oligomer
cgugcuggucgcuguuaucaaca

SEQ ID NO: 86515 - RNA, 23 nt, Artificial Sequence
  Oligomer
gaagaugugcgggauuucuggcc

SEQ ID NO: 86516 - RNA, 23 nt, Artificial Sequence
  Oligomer
ugaagaugugcgggauuucuggc

SEQ ID NO: 86517 - RNA, 23 nt, Artificial Sequence
  Oligomer
uugaagaugugcgggauuucugg

SEQ ID NO: 86518 - RNA, 23 nt, Artificial Sequence
  Oligomer
guugaagaugugcgggauuucug

SEQ ID NO: 86519 - RNA, 23 nt, Artificial Sequence
  Oligomer
cagaagacaagcugaccugacaa

SEQ ID NO: 86520 - RNA, 23 nt, Artificial Sequence
  Oligomer
ggaggagaaugaccaccaggacc

SEQ ID NO: 86521 - RNA, 23 nt, Artificial Sequence
  Oligomer
uggaggagaaugaccaccaggac

SEQ ID NO: 86522 - RNA, 23 nt, Artificial Sequence
  Oligomer
guggaggagaaugaccaccagga

SEQ ID NO: 86523 - RNA, 23 nt, Artificial Sequence
  Oligomer
aguuugaguggcuggcugacauc

SEQ ID NO: 86524 - RNA, 23 nt, Artificial Sequence
  Oligomer
caguuugaguggcuggcugacau

SEQ ID NO: 86525 - RNA, 23 nt, Artificial Sequence
  Oligomer
ucaguuugaguggcuggcugaca

SEQ ID NO: 86526 - RNA, 23 nt, Artificial Sequence
  Oligomer
gucaguuugaguggcuggcugac

SEQ ID NO: 86527 - RNA, 23 nt, Artificial Sequence
  Oligomer
cgucaguuugaguggcuggcuga

SEQ ID NO: 86528 - RNA, 23 nt, Artificial Sequence
  Oligomer
cuuccuggucccagcaaucaucu

SEQ ID NO: 86529 - RNA, 23 nt, Artificial Sequence
  Oligomer
ucuuccuggucccagcaaucauc

SEQ ID NO: 86530 - RNA, 23 nt, Artificial Sequence
  Oligomer
uucuuccuggucccagcaaucau

SEQ ID NO: 86531 - RNA, 23 nt, Artificial Sequence
  Oligomer
auguggugaauguguaccuguuc

SEQ ID NO: 86532 - RNA, 23 nt, Artificial Sequence
  Oligomer
cauguggugaauguguaccuguu

SEQ ID NO: 86533 - RNA, 23 nt, Artificial Sequence
  Oligomer
uuccaggacaaggaggaacugac

SEQ ID NO: 86534 - RNA, 23 nt, Artificial Sequence
  Oligomer
agcuuuggaauggcaaggccaca

SEQ ID NO: 86535 - RNA, 23 nt, Artificial Sequence
  Oligomer
aagcuuuggaauggcaaggccac

SEQ ID NO: 86536 - RNA, 23 nt, Artificial Sequence
  Oligomer
ccgccagagcaucgugucugaga

SEQ ID NO: 86537 - RNA, 23 nt, Artificial Sequence
  Oligomer
guucuccaagaaggagauugaag

SEQ ID NO: 86538 - RNA, 23 nt, Artificial Sequence
  Oligomer
uguucuccaagaaggagauugaa

SEQ ID NO: 86539 - RNA, 23 nt, Artificial Sequence
  Oligomer
agaugugcgggauuucuggccug

SEQ ID NO: 86540 - RNA, 23 nt, Artificial Sequence
  Oligomer
aagaugugcgggauuucuggccu

SEQ ID NO: 86541 - RNA, 23 nt, Artificial Sequence
  Oligomer
aucagacccuggcccaauaccua

SEQ ID NO: 86542 - RNA, 23 nt, Artificial Sequence
  Oligomer
caucagacccuggcccaauaccu

SEQ ID NO: 86543 - RNA, 23 nt, Artificial Sequence
  Oligomer
ucaucagacccuggcccaauacc

SEQ ID NO: 86544 - RNA, 23 nt, Artificial Sequence
  Oligomer
uucaucagacccuggcccaauac

SEQ ID NO: 86545 - RNA, 23 nt, Artificial Sequence
  Oligomer
uuucaucagacccuggcccaaua

SEQ ID NO: 86546 - RNA, 23 nt, Artificial Sequence
  Oligomer
gcaugucuguauguguguugggg

SEQ ID NO: 86547 - RNA, 23 nt, Artificial Sequence
  Oligomer
ugcaugucuguauguguguuggg

SEQ ID NO: 86548 - RNA, 23 nt, Artificial Sequence
  Oligomer
gugcaugucuguauguguguugg

SEQ ID NO: 86549 - RNA, 23 nt, Artificial Sequence
  Oligomer
ugugcaugucuguauguguguug

SEQ ID NO: 86550 - RNA, 23 nt, Artificial Sequence
  Oligomer
gugugcaugucuguauguguguu

SEQ ID NO: 86551 - RNA, 23 nt, Artificial Sequence
  Oligomer
agcuggcugagaaguucgaccuc

SEQ ID NO: 86552 - RNA, 23 nt, Artificial Sequence
  Oligomer
cagcuggcugagaaguucgaccu

SEQ ID NO: 86553 - RNA, 23 nt, Artificial Sequence
  Oligomer
ccagcuggcugagaaguucgacc

SEQ ID NO: 86554 - RNA, 23 nt, Artificial Sequence
  Oligomer
cccagcuggcugagaaguucgac

SEQ ID NO: 86555 - RNA, 23 nt, Artificial Sequence
  Oligomer
acccagcuggcugagaaguucga

SEQ ID NO: 86556 - RNA, 23 nt, Artificial Sequence
  Oligomer
agguggaggagaaugaccaccag

SEQ ID NO: 86557 - RNA, 23 nt, Artificial Sequence
  Oligomer
gagguggaggagaaugaccacca

SEQ ID NO: 86558 - RNA, 23 nt, Artificial Sequence
  Oligomer
agagguggaggagaaugaccacc

SEQ ID NO: 86559 - RNA, 23 nt, Artificial Sequence
  Oligomer
cuuacacagugugggccaugugg

SEQ ID NO: 86560 - RNA, 23 nt, Artificial Sequence
  Oligomer
ucuuacacagugugggccaugug

SEQ ID NO: 86561 - RNA, 23 nt, Artificial Sequence
  Oligomer
gucuuacacagugugggccaugu

SEQ ID NO: 86562 - RNA, 23 nt, Artificial Sequence
  Oligomer
agucuuacacagugugggccaug

SEQ ID NO: 86563 - RNA, 23 nt, Artificial Sequence
  Oligomer
cagucuuacacagugugggccau

SEQ ID NO: 86564 - RNA, 23 nt, Artificial Sequence
  Oligomer
gguggaggugccugaagucauca

SEQ ID NO: 86565 - RNA, 23 nt, Artificial Sequence
  Oligomer
ggguggaggugccugaagucauc

SEQ ID NO: 86566 - RNA, 23 nt, Artificial Sequence
  Oligomer
gggguggaggugccugaagucau

SEQ ID NO: 86567 - RNA, 23 nt, Artificial Sequence
  Oligomer
ccuuauguuccgcauguacgacu

SEQ ID NO: 86568 - RNA, 23 nt, Artificial Sequence
  Oligomer
uugucuggcauaaaggagacccc

SEQ ID NO: 86569 - RNA, 23 nt, Artificial Sequence
  Oligomer
uuugucuggcauaaaggagaccc

SEQ ID NO: 86570 - RNA, 23 nt, Artificial Sequence
  Oligomer
ccugcagaaaacacucccggagu

SEQ ID NO: 86571 - RNA, 23 nt, Artificial Sequence
  Oligomer
uccugcagaaaacacucccggag

SEQ ID NO: 86572 - RNA, 23 nt, Artificial Sequence
  Oligomer
uuccugcagaaaacacucccgga

SEQ ID NO: 86573 - RNA, 23 nt, Artificial Sequence
  Oligomer
ugugugcaugucuguaugugugu

SEQ ID NO: 86574 - RNA, 23 nt, Artificial Sequence
  Oligomer
gugugugcaugucuguaugugug

SEQ ID NO: 86575 - RNA, 23 nt, Artificial Sequence
  Oligomer
ugugugugcaugucuguaugugu

SEQ ID NO: 86576 - RNA, 23 nt, Artificial Sequence
  Oligomer
aaguacuaugugugugcaugucu

SEQ ID NO: 86577 - RNA, 23 nt, Artificial Sequence
  Oligomer
agugucuagggacuagagugaga

SEQ ID NO: 86578 - RNA, 23 nt, Artificial Sequence
  Oligomer
aguggcuggcugacaucauccga

SEQ ID NO: 86579 - RNA, 23 nt, Artificial Sequence
  Oligomer
gaguggcuggcugacaucauccg

SEQ ID NO: 86580 - RNA, 23 nt, Artificial Sequence
  Oligomer
ugaguggcuggcugacaucaucc

SEQ ID NO: 86581 - RNA, 23 nt, Artificial Sequence
  Oligomer
uugaguggcuggcugacaucauc

SEQ ID NO: 86582 - RNA, 23 nt, Artificial Sequence
  Oligomer
uuugaguggcuggcugacaucau

SEQ ID NO: 86583 - RNA, 23 nt, Artificial Sequence
  Oligomer
uacuggugguucuuccagaccgu

SEQ ID NO: 86584 - RNA, 23 nt, Artificial Sequence
  Oligomer
uuacuggugguucuuccagaccg

SEQ ID NO: 86585 - RNA, 23 nt, Artificial Sequence
  Oligomer
auuacuggugguucuuccagacc

SEQ ID NO: 86586 - RNA, 23 nt, Artificial Sequence
  Oligomer
uauuacuggugguucuuccagac

SEQ ID NO: 86587 - RNA, 23 nt, Artificial Sequence
  Oligomer
guauuacuggugguucuuccaga

SEQ ID NO: 86588 - RNA, 23 nt, Artificial Sequence
  Oligomer
cucucuggcugacaaggauggca

SEQ ID NO: 86589 - RNA, 23 nt, Artificial Sequence
  Oligomer
ucucucuggcugacaaggauggc

SEQ ID NO: 86590 - RNA, 23 nt, Artificial Sequence
  Oligomer
uucucucuggcugacaaggaugg

SEQ ID NO: 86591 - RNA, 23 nt, Artificial Sequence
  Oligomer
guucucucuggcugacaaggaug

SEQ ID NO: 86592 - RNA, 23 nt, Artificial Sequence
  Oligomer
uaugguuccucgcauuccuggag

SEQ ID NO: 86593 - RNA, 23 nt, Artificial Sequence
  Oligomer
cuaugguuccucgcauuccugga

SEQ ID NO: 86594 - RNA, 23 nt, Artificial Sequence
  Oligomer
ucuaugguuccucgcauuccugg

SEQ ID NO: 86595 - RNA, 23 nt, Artificial Sequence
  Oligomer
aggaugugucucagccuggagaa

SEQ ID NO: 86596 - RNA, 23 nt, Artificial Sequence
  Oligomer
ucacuucucccaccauuaugaga

SEQ ID NO: 86597 - RNA, 23 nt, Artificial Sequence
  Oligomer
gggccaccaggaguggcauaagu

SEQ ID NO: 86598 - RNA, 23 nt, Artificial Sequence
  Oligomer
ccaaagcuguaccuugauggacc

SEQ ID NO: 86599 - RNA, 23 nt, Artificial Sequence
  Oligomer
ugaguucaucaggaugcugagau

SEQ ID NO: 86600 - RNA, 23 nt, Artificial Sequence
  Oligomer
augaguucaucaggaugcugaga

SEQ ID NO: 86601 - RNA, 23 nt, Artificial Sequence
  Oligomer
gaugaguucaucaggaugcugag

SEQ ID NO: 86602 - RNA, 23 nt, Artificial Sequence
  Oligomer
gagcugaugagagcagcugugac

SEQ ID NO: 86603 - RNA, 23 nt, Artificial Sequence
  Oligomer
ggagcugaugagagcagcuguga

SEQ ID NO: 86604 - RNA, 23 nt, Artificial Sequence
  Oligomer
auuugugcggcuacgggauggug

SEQ ID NO: 86605 - RNA, 23 nt, Artificial Sequence
  Oligomer
ucccauaccuccuccucuucugg

SEQ ID NO: 86606 - RNA, 23 nt, Artificial Sequence
  Oligomer
cucccauaccuccuccucuucug

SEQ ID NO: 86607 - RNA, 23 nt, Artificial Sequence
  Oligomer
acucccauaccuccuccucuucu

SEQ ID NO: 86608 - RNA, 23 nt, Artificial Sequence
  Oligomer
uacucccauaccuccuccucuuc

SEQ ID NO: 86609 - RNA, 23 nt, Artificial Sequence
  Oligomer
cuacucccauaccuccuccucuu

SEQ ID NO: 86610 - RNA, 23 nt, Artificial Sequence
  Oligomer
cagugucuagggacuagagugag

SEQ ID NO: 86611 - RNA, 23 nt, Artificial Sequence
  Oligomer
gcagugucuagggacuagaguga

SEQ ID NO: 86612 - RNA, 23 nt, Artificial Sequence
  Oligomer
uguuccagguggccauagucagu

SEQ ID NO: 86613 - RNA, 23 nt, Artificial Sequence
  Oligomer
uuguuccagguggccauagucag

SEQ ID NO: 86614 - RNA, 23 nt, Artificial Sequence
  Oligomer
guucuuccagaccguaccaggcc

SEQ ID NO: 86615 - RNA, 23 nt, Artificial Sequence
  Oligomer
gguucuuccagaccguaccaggc

SEQ ID NO: 86616 - RNA, 23 nt, Artificial Sequence
  Oligomer
ugguucuuccagaccguaccagg

SEQ ID NO: 86617 - RNA, 23 nt, Artificial Sequence
  Oligomer
gugguucuuccagaccguaccag

SEQ ID NO: 86618 - RNA, 23 nt, Artificial Sequence
  Oligomer
ggugguucuuccagaccguacca

SEQ ID NO: 86619 - RNA, 23 nt, Artificial Sequence
  Oligomer
ucaucgagaucuccaacaacugc

SEQ ID NO: 86620 - RNA, 23 nt, Artificial Sequence
  Oligomer
uucaucgagaucuccaacaacug

SEQ ID NO: 86621 - RNA, 23 nt, Artificial Sequence
  Oligomer
cuucaucgagaucuccaacaacu

SEQ ID NO: 86622 - RNA, 23 nt, Artificial Sequence
  Oligomer
gagaguuccuggacauccuggug

SEQ ID NO: 86623 - RNA, 23 nt, Artificial Sequence
  Oligomer
cgagaguuccuggacauccuggu

SEQ ID NO: 86624 - RNA, 23 nt, Artificial Sequence
  Oligomer
ccgagaguuccuggacauccugg

SEQ ID NO: 86625 - RNA, 23 nt, Artificial Sequence
  Oligomer
uccgagaguuccuggacauccug

SEQ ID NO: 86626 - RNA, 23 nt, Artificial Sequence
  Oligomer
uuccgagaguuccuggacauccu

SEQ ID NO: 86627 - RNA, 23 nt, Artificial Sequence
  Oligomer
agggcaguggauuuggcuucggg

SEQ ID NO: 86628 - RNA, 23 nt, Artificial Sequence
  Oligomer
gagggcaguggauuuggcuucgg

SEQ ID NO: 86629 - RNA, 23 nt, Artificial Sequence
  Oligomer
ugagggcaguggauuuggcuucg

SEQ ID NO: 86630 - RNA, 23 nt, Artificial Sequence
  Oligomer
uugagggcaguggauuuggcuuc

SEQ ID NO: 86631 - RNA, 23 nt, Artificial Sequence
  Oligomer
uuugagggcaguggauuuggcuu

SEQ ID NO: 86632 - RNA, 23 nt, Artificial Sequence
  Oligomer
cagacccuggcccaauaccuaug

SEQ ID NO: 86633 - RNA, 23 nt, Artificial Sequence
  Oligomer
ucagacccuggcccaauaccuau

SEQ ID NO: 86634 - RNA, 23 nt, Artificial Sequence
  Oligomer
aauuucacccaagguuuuaagca

SEQ ID NO: 86635 - RNA, 23 nt, Artificial Sequence
  Oligomer
gcuggacccauggcaagccauuu

SEQ ID NO: 86636 - RNA, 23 nt, Artificial Sequence
  Oligomer
uggcaaaugccuugcaggaggua

SEQ ID NO: 86637 - RNA, 23 nt, Artificial Sequence
  Oligomer
cuggcaaaugccuugcaggaggu

SEQ ID NO: 86638 - RNA, 23 nt, Artificial Sequence
  Oligomer
gcuggcaaaugccuugcaggagg

SEQ ID NO: 86639 - RNA, 23 nt, Artificial Sequence
  Oligomer
ggcuggcaaaugccuugcaggag

SEQ ID NO: 86640 - RNA, 23 nt, Artificial Sequence
  Oligomer
gggcuggcaaaugccuugcagga

SEQ ID NO: 86641 - RNA, 23 nt, Artificial Sequence
  Oligomer
ugggugaaauuaguugugguguu

SEQ ID NO: 86642 - RNA, 23 nt, Artificial Sequence
  Oligomer
augucaguuccuccuuguccugg

SEQ ID NO: 86643 - RNA, 23 nt, Artificial Sequence
  Oligomer
ugucaguuccuccuuguccugga

SEQ ID NO: 86644 - RNA, 23 nt, Artificial Sequence
  Oligomer
guucuaagaugccagcauccaug

SEQ ID NO: 86645 - RNA, 23 nt, Artificial Sequence
  Oligomer
uucuaagaugccagcauccaugc

SEQ ID NO: 86646 - RNA, 23 nt, Artificial Sequence
  Oligomer
ucuaagaugccagcauccaugcu

SEQ ID NO: 86647 - RNA, 23 nt, Artificial Sequence
  Oligomer
cuaagaugccagcauccaugcuc

SEQ ID NO: 86648 - RNA, 23 nt, Artificial Sequence
  Oligomer
uaagaugccagcauccaugcucc

SEQ ID NO: 86649 - RNA, 23 nt, Artificial Sequence
  Oligomer
acagauguacagcauaguggucc

SEQ ID NO: 86650 - RNA, 23 nt, Artificial Sequence
  Oligomer
uucagugcugagcugucucggcu

SEQ ID NO: 86651 - RNA, 23 nt, Artificial Sequence
  Oligomer
uacagugucauugcuccgggaga

SEQ ID NO: 86652 - RNA, 23 nt, Artificial Sequence
  Oligomer
ccccuacuucucacucuaguccc

SEQ ID NO: 86653 - RNA, 23 nt, Artificial Sequence
  Oligomer
gaaauuaguugugguguuagacu

SEQ ID NO: 86654 - RNA, 23 nt, Artificial Sequence
  Oligomer
aaauuaguugugguguuagacug

SEQ ID NO: 86655 - RNA, 23 nt, Artificial Sequence
  Oligomer
aauuaguugugguguuagacugg

SEQ ID NO: 86656 - RNA, 23 nt, Artificial Sequence
  Oligomer
auuaguugugguguuagacuggg

SEQ ID NO: 86657 - RNA, 23 nt, Artificial Sequence
  Oligomer
uuaguugugguguuagacugggg

SEQ ID NO: 86658 - RNA, 23 nt, Artificial Sequence
  Oligomer
augcucccacugcauccuuacac

SEQ ID NO: 86659 - RNA, 23 nt, Artificial Sequence
  Oligomer
ugcucccacugcauccuuacacu

SEQ ID NO: 86660 - RNA, 23 nt, Artificial Sequence
  Oligomer
gcucccacugcauccuuacacuc

SEQ ID NO: 86661 - RNA, 23 nt, Artificial Sequence
  Oligomer
cucccacugcauccuuacacuca

SEQ ID NO: 86662 - RNA, 23 nt, Artificial Sequence
  Oligomer
ucccacugcauccuuacacucac

SEQ ID NO: 86663 - RNA, 23 nt, Artificial Sequence
  Oligomer
ccacugcauccuuacacucaccg

SEQ ID NO: 86664 - RNA, 23 nt, Artificial Sequence
  Oligomer
cacugcauccuuacacucaccgc

SEQ ID NO: 86665 - RNA, 23 nt, Artificial Sequence
  Oligomer
acugcauccuuacacucaccgcc

SEQ ID NO: 86666 - RNA, 23 nt, Artificial Sequence
  Oligomer
cugcauccuuacacucaccgccc

SEQ ID NO: 86667 - RNA, 23 nt, Artificial Sequence
  Oligomer
ugcauccuuacacucaccgcccc

SEQ ID NO: 86668 - RNA, 23 nt, Artificial Sequence
  Oligomer
agggugguauuucggauuucuuc

SEQ ID NO: 86669 - RNA, 23 nt, Artificial Sequence
  Oligomer
gggugguauuucggauuucuuca

SEQ ID NO: 86670 - RNA, 23 nt, Artificial Sequence
  Oligomer
ggugguauuucggauuucuucaa

SEQ ID NO: 86671 - RNA, 23 nt, Artificial Sequence
  Oligomer
gugguauuucggauuucuucaau

SEQ ID NO: 86672 - RNA, 23 nt, Artificial Sequence
  Oligomer
cgccuucaccacgcugaucucca

SEQ ID NO: 86673 - RNA, 23 nt, Artificial Sequence
  Oligomer
gccuucaccacgcugaucuccac

SEQ ID NO: 86674 - RNA, 23 nt, Artificial Sequence
  Oligomer
ccuucaccacgcugaucuccacc

SEQ ID NO: 86675 - RNA, 23 nt, Artificial Sequence
  Oligomer
cuucaccacgcugaucuccaccu

SEQ ID NO: 86676 - RNA, 23 nt, Artificial Sequence
  Oligomer
uucaccacgcugaucuccaccuu

SEQ ID NO: 86677 - RNA, 23 nt, Artificial Sequence
  Oligomer
gaggugucaacucagucucaaug

SEQ ID NO: 86678 - RNA, 23 nt, Artificial Sequence
  Oligomer
aggugucaacucagucucaaugu

SEQ ID NO: 86679 - RNA, 23 nt, Artificial Sequence
  Oligomer
uucuucaaucuccuucuuggaga

SEQ ID NO: 86680 - RNA, 23 nt, Artificial Sequence
  Oligomer
ucuucaaucuccuucuuggagaa

SEQ ID NO: 86681 - RNA, 23 nt, Artificial Sequence
  Oligomer
ggccugugaauagacuccgguuc

SEQ ID NO: 86682 - RNA, 23 nt, Artificial Sequence
  Oligomer
gccugugaauagacuccgguuca

SEQ ID NO: 86683 - RNA, 23 nt, Artificial Sequence
  Oligomer
ccugugaauagacuccgguucag

SEQ ID NO: 86684 - RNA, 23 nt, Artificial Sequence
  Oligomer
cugugaauagacuccgguucaga

SEQ ID NO: 86685 - RNA, 23 nt, Artificial Sequence
  Oligomer
ugugaauagacuccgguucagaa

SEQ ID NO: 86686 - RNA, 23 nt, Artificial Sequence
  Oligomer
cacgcugaucuccaccuucuucc

SEQ ID NO: 86687 - RNA, 23 nt, Artificial Sequence
  Oligomer
cagcuuuggguaucuggcacauc

SEQ ID NO: 86688 - RNA, 23 nt, Artificial Sequence
  Oligomer
caggucugaaagcacgugauagc

SEQ ID NO: 86689 - RNA, 23 nt, Artificial Sequence
  Oligomer
aggucugaaagcacgugauagcc

SEQ ID NO: 86690 - RNA, 23 nt, Artificial Sequence
  Oligomer
ggucugaaagcacgugauagcca

SEQ ID NO: 86691 - RNA, 23 nt, Artificial Sequence
  Oligomer
gucugaaagcacgugauagccaa

SEQ ID NO: 86692 - RNA, 23 nt, Artificial Sequence
  Oligomer
ucugaaagcacgugauagccaaa

SEQ ID NO: 86693 - RNA, 23 nt, Artificial Sequence
  Oligomer
acacugacaccucaaacuuaugc

SEQ ID NO: 86694 - RNA, 23 nt, Artificial Sequence
  Oligomer
caaauccacugcccucaaaauag

SEQ ID NO: 86695 - RNA, 23 nt, Artificial Sequence
  Oligomer
aaauccacugcccucaaaauagu

SEQ ID NO: 86696 - RNA, 23 nt, Artificial Sequence
  Oligomer
aauccacugcccucaaaauaguc

SEQ ID NO: 86697 - RNA, 23 nt, Artificial Sequence
  Oligomer
aggcugaggcagccagaaauagg

SEQ ID NO: 86698 - RNA, 23 nt, Artificial Sequence
  Oligomer
ggcugaggcagccagaaauagga

SEQ ID NO: 86699 - RNA, 23 nt, Artificial Sequence
  Oligomer
gcugaggcagccagaaauaggaa

SEQ ID NO: 86700 - RNA, 23 nt, Artificial Sequence
  Oligomer
cugaggcagccagaaauaggaag

SEQ ID NO: 86701 - RNA, 23 nt, Artificial Sequence
  Oligomer
ugaggcagccagaaauaggaaga

SEQ ID NO: 86702 - RNA, 23 nt, Artificial Sequence
  Oligomer
agccgcacaaauuguucaaggac

SEQ ID NO: 86703 - RNA, 23 nt, Artificial Sequence
  Oligomer
aagguacagcuuuggguaucugg

SEQ ID NO: 86704 - RNA, 23 nt, Artificial Sequence
  Oligomer
agguacagcuuuggguaucuggc

SEQ ID NO: 86705 - RNA, 23 nt, Artificial Sequence
  Oligomer
gguacagcuuuggguaucuggca

SEQ ID NO: 86706 - RNA, 23 nt, Artificial Sequence
  Oligomer
guacagcuuuggguaucuggcac

SEQ ID NO: 86707 - RNA, 23 nt, Artificial Sequence
  Oligomer
uacagcuuuggguaucuggcaca

SEQ ID NO: 86708 - RNA, 23 nt, Artificial Sequence
  Oligomer
ugucugugaugcccgugugaugu

SEQ ID NO: 86709 - RNA, 23 nt, Artificial Sequence
  Oligomer
gucugugaugcccgugugaugug

SEQ ID NO: 86710 - RNA, 23 nt, Artificial Sequence
  Oligomer
ucugugaugcccgugugaugugc

SEQ ID NO: 86711 - RNA, 23 nt, Artificial Sequence
  Oligomer
cugugaugcccgugugaugugcg

SEQ ID NO: 86712 - RNA, 23 nt, Artificial Sequence
  Oligomer
ugugaugcccgugugaugugcgg

SEQ ID NO: 86713 - RNA, 23 nt, Artificial Sequence
  Oligomer
cuucuuggagaacagcccauucc

SEQ ID NO: 86714 - RNA, 23 nt, Artificial Sequence
  Oligomer
uucuuggagaacagcccauuccu

SEQ ID NO: 86715 - RNA, 23 nt, Artificial Sequence
  Oligomer
ucuuggagaacagcccauuccug

SEQ ID NO: 86716 - RNA, 23 nt, Artificial Sequence
  Oligomer
cuuggagaacagcccauuccugg

SEQ ID NO: 86717 - RNA, 23 nt, Artificial Sequence
  Oligomer
uuggagaacagcccauuccuggu

SEQ ID NO: 86718 - RNA, 23 nt, Artificial Sequence
  Oligomer
ugaaauuaguugugguguuagac

SEQ ID NO: 86719 - RNA, 23 nt, Artificial Sequence
  Oligomer
aagguugggaggugggaaaucag

SEQ ID NO: 86720 - RNA, 23 nt, Artificial Sequence
  Oligomer
agguugggaggugggaaaucaga

SEQ ID NO: 86721 - RNA, 23 nt, Artificial Sequence
  Oligomer
gguugggaggugggaaaucagag

SEQ ID NO: 86722 - RNA, 23 nt, Artificial Sequence
  Oligomer
guugggaggugggaaaucagaga

SEQ ID NO: 86723 - RNA, 23 nt, Artificial Sequence
  Oligomer
uugggaggugggaaaucagagaa

SEQ ID NO: 86724 - RNA, 23 nt, Artificial Sequence
  Oligomer
uuuccacauucuuggucaugcca

SEQ ID NO: 86725 - RNA, 23 nt, Artificial Sequence
  Oligomer
uuccacauucuuggucaugccag

SEQ ID NO: 86726 - RNA, 23 nt, Artificial Sequence
  Oligomer
uccacauucuuggucaugccagg

SEQ ID NO: 86727 - RNA, 23 nt, Artificial Sequence
  Oligomer
guggucauucuccuccaccucuc

SEQ ID NO: 86728 - RNA, 23 nt, Artificial Sequence
  Oligomer
uggucauucuccuccaccucucg

SEQ ID NO: 86729 - RNA, 23 nt, Artificial Sequence
  Oligomer
ggucauucuccuccaccucucgg

SEQ ID NO: 86730 - RNA, 23 nt, Artificial Sequence
  Oligomer
gucauucuccuccaccucucgga

SEQ ID NO: 86731 - RNA, 23 nt, Artificial Sequence
  Oligomer
ucauucuccuccaccucucggau

SEQ ID NO: 86732 - RNA, 23 nt, Artificial Sequence
  Oligomer
cccgugucacagcugcucucauc

SEQ ID NO: 86733 - RNA, 23 nt, Artificial Sequence
  Oligomer
ccgugucacagcugcucucauca

SEQ ID NO: 86734 - RNA, 23 nt, Artificial Sequence
  Oligomer
cgugucacagcugcucucaucag

SEQ ID NO: 86735 - RNA, 23 nt, Artificial Sequence
  Oligomer
gugucacagcugcucucaucagc

SEQ ID NO: 86736 - RNA, 23 nt, Artificial Sequence
  Oligomer
ugucacagcugcucucaucagcu

SEQ ID NO: 86737 - RNA, 23 nt, Artificial Sequence
  Oligomer
gggcaaagcuaccauggaugaug

SEQ ID NO: 86738 - RNA, 23 nt, Artificial Sequence
  Oligomer
gggcuggaaugacguuaccuucu

SEQ ID NO: 86739 - RNA, 23 nt, Artificial Sequence
  Oligomer
ggcuggaaugacguuaccuucuu

SEQ ID NO: 86740 - RNA, 23 nt, Artificial Sequence
  Oligomer
acucagucucaaugucgcugcgg

SEQ ID NO: 86741 - RNA, 23 nt, Artificial Sequence
  Oligomer
cucagucucaaugucgcugcggg

SEQ ID NO: 86742 - RNA, 23 nt, Artificial Sequence
  Oligomer
ucagucucaaugucgcugcggga

SEQ ID NO: 86743 - RNA, 23 nt, Artificial Sequence
  Oligomer
ccccuuugacacagagcugcgug

SEQ ID NO: 86744 - RNA, 23 nt, Artificial Sequence
  Oligomer
cccuuugacacagagcugcguga

SEQ ID NO: 86745 - RNA, 23 nt, Artificial Sequence
  Oligomer
ccuuugacacagagcugcgugaa

SEQ ID NO: 86746 - RNA, 23 nt, Artificial Sequence
  Oligomer
cuuugacacagagcugcgugaag

SEQ ID NO: 86747 - RNA, 23 nt, Artificial Sequence
  Oligomer
uuugacacagagcugcgugaagc

SEQ ID NO: 86748 - RNA, 23 nt, Artificial Sequence
  Oligomer
ugccaucuaccacacggaucugc

SEQ ID NO: 86749 - RNA, 23 nt, Artificial Sequence
  Oligomer
gccaucuaccacacggaucugcc

SEQ ID NO: 86750 - RNA, 23 nt, Artificial Sequence
  Oligomer
ccaucuaccacacggaucugccc

SEQ ID NO: 86751 - RNA, 23 nt, Artificial Sequence
  Oligomer
caucuaccacacggaucugcccg

SEQ ID NO: 86752 - RNA, 23 nt, Artificial Sequence
  Oligomer
aucuaccacacggaucugcccgg

SEQ ID NO: 86753 - RNA, 23 nt, Artificial Sequence
  Oligomer
aaucuccuucuuggagaacagcc

SEQ ID NO: 86754 - RNA, 23 nt, Artificial Sequence
  Oligomer
aucuccuucuuggagaacagccc

SEQ ID NO: 86755 - RNA, 23 nt, Artificial Sequence
  Oligomer
ucuccuucuuggagaacagccca

SEQ ID NO: 86756 - RNA, 23 nt, Artificial Sequence
  Oligomer
cuccuucuuggagaacagcccau

SEQ ID NO: 86757 - RNA, 23 nt, Artificial Sequence
  Oligomer
uccuucuuggagaacagcccauu

SEQ ID NO: 86758 - RNA, 23 nt, Artificial Sequence
  Oligomer
uccccuacuucucacucuagucc

SEQ ID NO: 86759 - RNA, 23 nt, Artificial Sequence
  Oligomer
auuucuccaggcugagacacauc

SEQ ID NO: 86760 - RNA, 23 nt, Artificial Sequence
  Oligomer
uuucuccaggcugagacacaucc

SEQ ID NO: 86761 - RNA, 23 nt, Artificial Sequence
  Oligomer
guuguuguaccacccaucaaauc

SEQ ID NO: 86762 - RNA, 23 nt, Artificial Sequence
  Oligomer
ugaauagacuccgguucagaacc

SEQ ID NO: 86763 - RNA, 23 nt, Artificial Sequence
  Oligomer
gaauagacuccgguucagaaccu

SEQ ID NO: 86764 - RNA, 23 nt, Artificial Sequence
  Oligomer
aauagacuccgguucagaaccuu

SEQ ID NO: 86765 - RNA, 23 nt, Artificial Sequence
  Oligomer
auagacuccgguucagaaccuuc

SEQ ID NO: 86766 - RNA, 23 nt, Artificial Sequence
  Oligomer
gcccauuccugguguucucaaac

SEQ ID NO: 86767 - RNA, 23 nt, Artificial Sequence
  Oligomer
gagguaugggaguagggaggguu

SEQ ID NO: 86768 - RNA, 23 nt, Artificial Sequence
  Oligomer
agguaugggaguagggaggguuc

SEQ ID NO: 86769 - RNA, 23 nt, Artificial Sequence
  Oligomer
gguaugggaguagggaggguucu

SEQ ID NO: 86770 - RNA, 23 nt, Artificial Sequence
  Oligomer
guaugggaguagggaggguucua

SEQ ID NO: 86771 - RNA, 23 nt, Artificial Sequence
  Oligomer
uaugggaguagggaggguucuaa

SEQ ID NO: 86772 - RNA, 23 nt, Artificial Sequence
  Oligomer
ggguucuaagaugccagcaucca

SEQ ID NO: 86773 - RNA, 23 nt, Artificial Sequence
  Oligomer
gguucuaagaugccagcauccau

SEQ ID NO: 86774 - RNA, 23 nt, Artificial Sequence
  Oligomer
agguuguuguaccacccaucaaa

SEQ ID NO: 86775 - RNA, 23 nt, Artificial Sequence
  Oligomer
gguuguuguaccacccaucaaau

SEQ ID NO: 86776 - RNA, 23 nt, Artificial Sequence
  Oligomer
uggguaucuggcacaucugucac

SEQ ID NO: 86777 - RNA, 23 nt, Artificial Sequence
  Oligomer
cagcuggaucagggcaaagcuac

SEQ ID NO: 86778 - RNA, 23 nt, Artificial Sequence
  Oligomer
agcuggaucagggcaaagcuacc

SEQ ID NO: 86779 - RNA, 23 nt, Artificial Sequence
  Oligomer
ggaacauaaggcgagacuuuucc

SEQ ID NO: 86780 - RNA, 23 nt, Artificial Sequence
  Oligomer
uggccuugccauuccaaagcuuc

SEQ ID NO: 86781 - RNA, 23 nt, Artificial Sequence
  Oligomer
uuguacucaaagcccuggggccg

SEQ ID NO: 86782 - RNA, 23 nt, Artificial Sequence
  Oligomer
guccagaaauggccgguauccug

SEQ ID NO: 86783 - RNA, 23 nt, Artificial Sequence
  Oligomer
uccagaaauggccgguauccugu

SEQ ID NO: 86784 - RNA, 23 nt, Artificial Sequence
  Oligomer
ccagaaauggccgguauccugua

SEQ ID NO: 86785 - RNA, 23 nt, Artificial Sequence
  Oligomer
auaguacuugucaggucagcuug

SEQ ID NO: 86786 - RNA, 23 nt, Artificial Sequence
  Oligomer
uaguacuugucaggucagcuugu

SEQ ID NO: 86787 - RNA, 23 nt, Artificial Sequence
  Oligomer
gugaauagacuccgguucagaac

SEQ ID NO: 86788 - RNA, 23 nt, Artificial Sequence
  Oligomer
uccucaggagagccuuucaugaa

SEQ ID NO: 86789 - RNA, 23 nt, Artificial Sequence
  Oligomer
ccucaggagagccuuucaugaag

SEQ ID NO: 86790 - RNA, 23 nt, Artificial Sequence
  Oligomer
cucaggagagccuuucaugaaga

SEQ ID NO: 86791 - RNA, 23 nt, Artificial Sequence
  Oligomer
ucaggagagccuuucaugaagac

SEQ ID NO: 86792 - RNA, 23 nt, Artificial Sequence
  Oligomer
ggucuccuuuaugccagacaaag

SEQ ID NO: 86793 - RNA, 23 nt, Artificial Sequence
  Oligomer
gucuccuuuaugccagacaaaga

SEQ ID NO: 86794 - RNA, 23 nt, Artificial Sequence
  Oligomer
guggucugugcgggaaaacuuca

SEQ ID NO: 86795 - RNA, 23 nt, Artificial Sequence
  Oligomer
uggucugugcgggaaaacuucag

SEQ ID NO: 86796 - RNA, 23 nt, Artificial Sequence
  Oligomer
cagguugugguagcggaaccaga

SEQ ID NO: 86797 - RNA, 23 nt, Artificial Sequence
  Oligomer
agguugugguagcggaaccagag

SEQ ID NO: 86798 - RNA, 23 nt, Artificial Sequence
  Oligomer
gguugugguagcggaaccagagc

SEQ ID NO: 86799 - RNA, 23 nt, Artificial Sequence
  Oligomer
guugugguagcggaaccagagca

SEQ ID NO: 86800 - RNA, 23 nt, Artificial Sequence
  Oligomer
uugugguagcggaaccagagcag

SEQ ID NO: 86801 - RNA, 23 nt, Artificial Sequence
  Oligomer
uaguugugguguuagacuggggu

SEQ ID NO: 86802 - RNA, 23 nt, Artificial Sequence
  Oligomer
uccgguucagaaccuucuggaag

SEQ ID NO: 86803 - RNA, 23 nt, Artificial Sequence
  Oligomer
aaagaggcaagagaggacgcuga

SEQ ID NO: 86804 - RNA, 23 nt, Artificial Sequence
  Oligomer
accaucccguagccgcacaaauu

SEQ ID NO: 86805 - RNA, 23 nt, Artificial Sequence
  Oligomer
ccaucccguagccgcacaaauug

SEQ ID NO: 86806 - RNA, 23 nt, Artificial Sequence
  Oligomer
caucccguagccgcacaaauugu

SEQ ID NO: 86807 - RNA, 23 nt, Artificial Sequence
  Oligomer
aucccguagccgcacaaauuguu

SEQ ID NO: 86808 - RNA, 23 nt, Artificial Sequence
  Oligomer
gcuuaaaaccuugggugaaauua

SEQ ID NO: 86809 - RNA, 23 nt, Artificial Sequence
  Oligomer
gggugaaauuaguugugguguua

SEQ ID NO: 86810 - RNA, 23 nt, Artificial Sequence
  Oligomer
ggugaaauuaguugugguguuag

SEQ ID NO: 86811 - RNA, 23 nt, Artificial Sequence
  Oligomer
gugaaauuaguugugguguuaga

SEQ ID NO: 86812 - RNA, 23 nt, Artificial Sequence
  Oligomer
ucagggcaaagcuaccauggaug

SEQ ID NO: 86813 - RNA, 23 nt, Artificial Sequence
  Oligomer
ggcguaguaguaggcccucucca

SEQ ID NO: 86814 - RNA, 23 nt, Artificial Sequence
  Oligomer
gcguaguaguaggcccucuccag

SEQ ID NO: 86815 - RNA, 23 nt, Artificial Sequence
  Oligomer
cguaguaguaggcccucuccagg

SEQ ID NO: 86816 - RNA, 23 nt, Artificial Sequence
  Oligomer
guaguaguaggcccucuccagga

SEQ ID NO: 86817 - RNA, 23 nt, Artificial Sequence
  Oligomer
uaguaguaggcccucuccaggaa

SEQ ID NO: 86818 - RNA, 23 nt, Artificial Sequence
  Oligomer
ucaccaggucugaaagcacguga

SEQ ID NO: 86819 - RNA, 23 nt, Artificial Sequence
  Oligomer
cacauaguacuugucaggucagc

SEQ ID NO: 86820 - RNA, 23 nt, Artificial Sequence
  Oligomer
acauaguacuugucaggucagcu

SEQ ID NO: 86821 - RNA, 23 nt, Artificial Sequence
  Oligomer
cauaguacuugucaggucagcuu

SEQ ID NO: 86822 - RNA, 23 nt, Artificial Sequence
  Oligomer
uagaugauugcugggaccaggaa

SEQ ID NO: 86823 - RNA, 23 nt, Artificial Sequence
  Oligomer
aggcaaugaggcgauggaagucc

SEQ ID NO: 86824 - RNA, 23 nt, Artificial Sequence
  Oligomer
cagcauccugaugaacucauccu

SEQ ID NO: 86825 - RNA, 23 nt, Artificial Sequence
  Oligomer
agcauccugaugaacucauccuu

SEQ ID NO: 86826 - RNA, 23 nt, Artificial Sequence
  Oligomer
gcauccugaugaacucauccuug

SEQ ID NO: 86827 - RNA, 23 nt, Artificial Sequence
  Oligomer
ugucagccagagagaacauggac

SEQ ID NO: 86828 - RNA, 23 nt, Artificial Sequence
  Oligomer
gucagccagagagaacauggacu

SEQ ID NO: 86829 - RNA, 23 nt, Artificial Sequence
  Oligomer
ucagccagagagaacauggacuc

SEQ ID NO: 86830 - RNA, 23 nt, Artificial Sequence
  Oligomer
ggggaucuugagcagcagagugc

SEQ ID NO: 86831 - RNA, 23 nt, Artificial Sequence
  Oligomer
gggaucuugagcagcagagugcg

SEQ ID NO: 86832 - RNA, 23 nt, Artificial Sequence
  Oligomer
ggaucuugagcagcagagugcgg

SEQ ID NO: 86833 - RNA, 23 nt, Artificial Sequence
  Oligomer
gaucuugagcagcagagugcggc

SEQ ID NO: 86834 - RNA, 23 nt, Artificial Sequence
  Oligomer
aucuugagcagcagagugcggcg

SEQ ID NO: 86835 - RNA, 23 nt, Artificial Sequence
  Oligomer
cacguccugcagggugguauuuc

SEQ ID NO: 86836 - RNA, 23 nt, Artificial Sequence
  Oligomer
acguccugcagggugguauuucg

SEQ ID NO: 86837 - RNA, 23 nt, Artificial Sequence
  Oligomer
cguccugcagggugguauuucgg

SEQ ID NO: 86838 - RNA, 23 nt, Artificial Sequence
  Oligomer
guccugcagggugguauuucgga

SEQ ID NO: 86839 - RNA, 23 nt, Artificial Sequence
  Oligomer
uccugcagggugguauuucggau

SEQ ID NO: 86840 - RNA, 23 nt, Artificial Sequence
  Oligomer
uguucugguagguggcgaugacc

SEQ ID NO: 86841 - RNA, 23 nt, Artificial Sequence
  Oligomer
guucugguagguggcgaugaccc

SEQ ID NO: 86842 - RNA, 23 nt, Artificial Sequence
  Oligomer
uucugguagguggcgaugacccu

SEQ ID NO: 86843 - RNA, 23 nt, Artificial Sequence
  Oligomer
gcugaggagcauugcauacauag

SEQ ID NO: 86844 - RNA, 23 nt, Artificial Sequence
  Oligomer
cugaggagcauugcauacauagg

SEQ ID NO: 86845 - RNA, 23 nt, Artificial Sequence
  Oligomer
cugaugaaagaacgugcuuaaaa

SEQ ID NO: 86846 - RNA, 23 nt, Artificial Sequence
  Oligomer
ugaugaaagaacgugcuuaaaac

SEQ ID NO: 86847 - RNA, 23 nt, Artificial Sequence
  Oligomer
ggaguugaagaagggcucaaagg

SEQ ID NO: 86848 - RNA, 23 nt, Artificial Sequence
  Oligomer
agugccgcucacagauguacagc

SEQ ID NO: 86849 - RNA, 23 nt, Artificial Sequence
  Oligomer
gugccgcucacagauguacagca

SEQ ID NO: 86850 - RNA, 23 nt, Artificial Sequence
  Oligomer
ugccgcucacagauguacagcau

SEQ ID NO: 86851 - RNA, 23 nt, Artificial Sequence
  Oligomer
gugauguagaugugcacagacac

SEQ ID NO: 86852 - RNA, 23 nt, Artificial Sequence
  Oligomer
ugauguagaugugcacagacacc

SEQ ID NO: 86853 - RNA, 23 nt, Artificial Sequence
  Oligomer
agacuuuuccucaggagagccuu

SEQ ID NO: 86854 - RNA, 23 nt, Artificial Sequence
  Oligomer
gacuuuuccucaggagagccuuu

SEQ ID NO: 86855 - RNA, 23 nt, Artificial Sequence
  Oligomer
aaggacgauggugcugaacagag

SEQ ID NO: 86856 - RNA, 23 nt, Artificial Sequence
  Oligomer
aggacgauggugcugaacagagg

SEQ ID NO: 86857 - RNA, 23 nt, Artificial Sequence
  Oligomer
ggacgauggugcugaacagaggu

SEQ ID NO: 86858 - RNA, 23 nt, Artificial Sequence
  Oligomer
cagguggucugugcgggaaaacu

SEQ ID NO: 86859 - RNA, 23 nt, Artificial Sequence
  Oligomer
agguggucugugcgggaaaacuu

SEQ ID NO: 86860 - RNA, 23 nt, Artificial Sequence
  Oligomer
gguggucugugcgggaaaacuuc

SEQ ID NO: 86861 - RNA, 23 nt, Artificial Sequence
  Oligomer
gcauccacaucuucagcacuuug

SEQ ID NO: 86862 - RNA, 23 nt, Artificial Sequence
  Oligomer
cauccacaucuucagcacuuugu

SEQ ID NO: 86863 - RNA, 23 nt, Artificial Sequence
  Oligomer
auccacaucuucagcacuuugua

SEQ ID NO: 86864 - RNA, 23 nt, Artificial Sequence
  Oligomer
ucuucagcacuuuguaggcuugg

SEQ ID NO: 86865 - RNA, 23 nt, Artificial Sequence
  Oligomer
cccacugcauccuuacacucacc

SEQ ID NO: 86866 - RNA, 23 nt, Artificial Sequence
  Oligomer
gacaugcacacacauaguacuug

SEQ ID NO: 86867 - RNA, 23 nt, Artificial Sequence
  Oligomer
acaugcacacacauaguacuugu

SEQ ID NO: 86868 - RNA, 23 nt, Artificial Sequence
  Oligomer
caugcacacacauaguacuuguc

SEQ ID NO: 86869 - RNA, 23 nt, Artificial Sequence
  Oligomer
augcacacacauaguacuuguca

SEQ ID NO: 86870 - RNA, 23 nt, Artificial Sequence
  Oligomer
ugcacacacauaguacuugucag

SEQ ID NO: 86871 - RNA, 23 nt, Artificial Sequence
  Oligomer
ccccucccacuaacacugacacc

SEQ ID NO: 86872 - RNA, 23 nt, Artificial Sequence
  Oligomer
cccucccacuaacacugacaccu

SEQ ID NO: 86873 - RNA, 23 nt, Artificial Sequence
  Oligomer
ccucccacuaacacugacaccuc

SEQ ID NO: 86874 - RNA, 23 nt, Artificial Sequence
  Oligomer
cauacaugauggccaggaucagg

SEQ ID NO: 86875 - RNA, 23 nt, Artificial Sequence
  Oligomer
auacaugauggccaggaucagga

SEQ ID NO: 86876 - RNA, 23 nt, Artificial Sequence
  Oligomer
uacaugauggccaggaucaggag

SEQ ID NO: 86877 - RNA, 23 nt, Artificial Sequence
  Oligomer
acaugauggccaggaucaggagc

SEQ ID NO: 86878 - RNA, 23 nt, Artificial Sequence
  Oligomer
caugauggccaggaucaggagca

SEQ ID NO: 86879 - RNA, 23 nt, Artificial Sequence
  Oligomer
augauggccaggaucaggagcag

SEQ ID NO: 86880 - RNA, 23 nt, Artificial Sequence
  Oligomer
cgccucagugaacagcaagggcu

SEQ ID NO: 86881 - RNA, 23 nt, Artificial Sequence
  Oligomer
gccucagugaacagcaagggcug

SEQ ID NO: 86882 - RNA, 23 nt, Artificial Sequence
  Oligomer
ccucagugaacagcaagggcugg

SEQ ID NO: 86883 - RNA, 23 nt, Artificial Sequence
  Oligomer
cucagugaacagcaagggcugga

SEQ ID NO: 86884 - RNA, 23 nt, Artificial Sequence
  Oligomer
ucagugaacagcaagggcuggaa

SEQ ID NO: 86885 - RNA, 23 nt, Artificial Sequence
  Oligomer
cggaacauaaggcgagacuuuuc

SEQ ID NO: 86886 - RNA, 23 nt, Artificial Sequence
  Oligomer
acagguagccauugccauccuug

SEQ ID NO: 86887 - RNA, 23 nt, Artificial Sequence
  Oligomer
cagguagccauugccauccuugu

SEQ ID NO: 86888 - RNA, 23 nt, Artificial Sequence
  Oligomer
agguagccauugccauccuuguc

SEQ ID NO: 86889 - RNA, 23 nt, Artificial Sequence
  Oligomer
gguagccauugccauccuuguca

SEQ ID NO: 86890 - RNA, 23 nt, Artificial Sequence
  Oligomer
guagccauugccauccuugucag

SEQ ID NO: 86891 - RNA, 23 nt, Artificial Sequence
  Oligomer
ggagaaaaggugccugaaaaagg

SEQ ID NO: 86892 - RNA, 23 nt, Artificial Sequence
  Oligomer
gagaaaaggugccugaaaaaggu

SEQ ID NO: 86893 - RNA, 23 nt, Artificial Sequence
  Oligomer
agaaaaggugccugaaaaagguc

SEQ ID NO: 86894 - RNA, 23 nt, Artificial Sequence
  Oligomer
gaaaaggugccugaaaaaggucu

SEQ ID NO: 86895 - RNA, 23 nt, Artificial Sequence
  Oligomer
aaaaggugccugaaaaaggucuc

SEQ ID NO: 86896 - RNA, 23 nt, Artificial Sequence
  Oligomer
ucucaaaccaguagcggucacca

SEQ ID NO: 86897 - RNA, 23 nt, Artificial Sequence
  Oligomer
agccucuaccuccugcaaggcau

SEQ ID NO: 86898 - RNA, 23 nt, Artificial Sequence
  Oligomer
gccucuaccuccugcaaggcauu

SEQ ID NO: 86899 - RNA, 23 nt, Artificial Sequence
  Oligomer
ccucuaccuccugcaaggcauuu

SEQ ID NO: 86900 - RNA, 23 nt, Artificial Sequence
  Oligomer
cucuaccuccugcaaggcauuug

SEQ ID NO: 86901 - RNA, 23 nt, Artificial Sequence
  Oligomer
ucuaccuccugcaaggcauuugc

SEQ ID NO: 86902 - RNA, 23 nt, Artificial Sequence
  Oligomer
ugacuauggccaccuggaacaag

SEQ ID NO: 86903 - RNA, 23 nt, Artificial Sequence
  Oligomer
gacuauggccaccuggaacaagg

SEQ ID NO: 86904 - RNA, 23 nt, Artificial Sequence
  Oligomer
acuauggccaccuggaacaaggu

SEQ ID NO: 86905 - RNA, 23 nt, Artificial Sequence
  Oligomer
cuauggccaccuggaacaagguu

SEQ ID NO: 86906 - RNA, 23 nt, Artificial Sequence
  Oligomer
uauggccaccuggaacaagguug

SEQ ID NO: 86907 - RNA, 23 nt, Artificial Sequence
  Oligomer
auaggaagaacagaggugaggug

SEQ ID NO: 86908 - RNA, 23 nt, Artificial Sequence
  Oligomer
cuccuccaccucucggaugaugu

SEQ ID NO: 86909 - RNA, 23 nt, Artificial Sequence
  Oligomer
uccuccaccucucggaugauguc

SEQ ID NO: 86910 - RNA, 23 nt, Artificial Sequence
  Oligomer
ccuccaccucucggaugauguca

SEQ ID NO: 86911 - RNA, 23 nt, Artificial Sequence
  Oligomer
cuccaccucucggaugaugucag

SEQ ID NO: 86912 - RNA, 23 nt, Artificial Sequence
  Oligomer
uccaccucucggaugaugucagc

SEQ ID NO: 86913 - RNA, 23 nt, Artificial Sequence
  Oligomer
caccucucggaugaugucagcca

SEQ ID NO: 86914 - RNA, 23 nt, Artificial Sequence
  Oligomer
accucucggaugaugucagccag

SEQ ID NO: 86915 - RNA, 23 nt, Artificial Sequence
  Oligomer
ccucucggaugaugucagccagc

SEQ ID NO: 86916 - RNA, 23 nt, Artificial Sequence
  Oligomer
cucucggaugaugucagccagcc

SEQ ID NO: 86917 - RNA, 23 nt, Artificial Sequence
  Oligomer
ucucggaugaugucagccagcca

SEQ ID NO: 86918 - RNA, 23 nt, Artificial Sequence
  Oligomer
acagcuuuggguaucuggcacau

SEQ ID NO: 86919 - RNA, 23 nt, Artificial Sequence
  Oligomer
ucagacccaucaucauggaagag

SEQ ID NO: 86920 - RNA, 23 nt, Artificial Sequence
  Oligomer
cagacccaucaucauggaagagg

SEQ ID NO: 86921 - RNA, 23 nt, Artificial Sequence
  Oligomer
uagccauugccauccuugucagc

SEQ ID NO: 86922 - RNA, 23 nt, Artificial Sequence
  Oligomer
ccaaauccacugcccucaaaaua

SEQ ID NO: 86923 - RNA, 23 nt, Artificial Sequence
  Oligomer
gcacacacauaguacuugucagg

SEQ ID NO: 86924 - RNA, 23 nt, Artificial Sequence
  Oligomer
cacacacauaguacuugucaggu

SEQ ID NO: 86925 - RNA, 23 nt, Artificial Sequence
  Oligomer
acacacauaguacuugucagguc

SEQ ID NO: 86926 - RNA, 23 nt, Artificial Sequence
  Oligomer
cacacauaguacuugucagguca

SEQ ID NO: 86927 - RNA, 23 nt, Artificial Sequence
  Oligomer
acacauaguacuugucaggucag

SEQ ID NO: 86928 - RNA, 23 nt, Artificial Sequence
  Oligomer
ccacauucuuggucaugccaggg

SEQ ID NO: 86929 - RNA, 23 nt, Artificial Sequence
  Oligomer
cacauucuuggucaugccagggg

SEQ ID NO: 86930 - RNA, 23 nt, Artificial Sequence
  Oligomer
acauucuuggucaugccaggggg

SEQ ID NO: 86931 - RNA, 23 nt, Artificial Sequence
  Oligomer
cauucuuggucaugccagggggg

SEQ ID NO: 86932 - RNA, 23 nt, Artificial Sequence
  Oligomer
auucuuggucaugccaggggggc

SEQ ID NO: 86933 - RNA, 23 nt, Artificial Sequence
  Oligomer
uggaagaaccaccaguaauacuu

SEQ ID NO: 86934 - RNA, 23 nt, Artificial Sequence
  Oligomer
ggaagaaccaccaguaauacuuc

SEQ ID NO: 86935 - RNA, 23 nt, Artificial Sequence
  Oligomer
ggugucugugaugcccgugugau

SEQ ID NO: 86936 - RNA, 23 nt, Artificial Sequence
  Oligomer
gugucugugaugcccgugugaug

SEQ ID NO: 86937 - RNA, 23 nt, Artificial Sequence
  Oligomer
ucucugaggugucaacucagucu

SEQ ID NO: 86938 - RNA, 23 nt, Artificial Sequence
  Oligomer
cucugaggugucaacucagucuc

SEQ ID NO: 86939 - RNA, 23 nt, Artificial Sequence
  Oligomer
ucugaggugucaacucagucuca

SEQ ID NO: 86940 - RNA, 23 nt, Artificial Sequence
  Oligomer
cugaggugucaacucagucucaa

SEQ ID NO: 86941 - RNA, 23 nt, Artificial Sequence
  Oligomer
ugaggugucaacucagucucaau

SEQ ID NO: 86942 - RNA, 23 nt, Artificial Sequence
  Oligomer
cgggaugcgaauguugaggaacu

SEQ ID NO: 86943 - RNA, 23 nt, Artificial Sequence
  Oligomer
gggaugcgaauguugaggaacuc

SEQ ID NO: 86944 - RNA, 23 nt, Artificial Sequence
  Oligomer
ggaugcgaauguugaggaacucg

SEQ ID NO: 86945 - RNA, 23 nt, Artificial Sequence
  Oligomer
agacuacuggagcagggagaaga

SEQ ID NO: 86946 - RNA, 23 nt, Artificial Sequence
  Oligomer
gacuacuggagcagggagaagag

SEQ ID NO: 86947 - RNA, 23 nt, Artificial Sequence
  Oligomer
acuacuggagcagggagaagagg

SEQ ID NO: 86948 - RNA, 23 nt, Artificial Sequence
  Oligomer
cuacuggagcagggagaagaggg

SEQ ID NO: 86949 - RNA, 23 nt, Artificial Sequence
  Oligomer
uacuggagcagggagaagagggc

SEQ ID NO: 86950 - RNA, 23 nt, Artificial Sequence
  Oligomer
cauacagacaugcacacacauag

SEQ ID NO: 86951 - RNA, 23 nt, Artificial Sequence
  Oligomer
auacagacaugcacacacauagu

SEQ ID NO: 86952 - RNA, 23 nt, Artificial Sequence
  Oligomer
acagacaugcacacacauaguac

SEQ ID NO: 86953 - RNA, 23 nt, Artificial Sequence
  Oligomer
cagacaugcacacacauaguacu

SEQ ID NO: 86954 - RNA, 23 nt, Artificial Sequence
  Oligomer
gagguuguuguaccacccaucaa

SEQ ID NO: 86955 - RNA, 23 nt, Artificial Sequence
  Oligomer
ccgguucagaaccuucuggaagu

SEQ ID NO: 86956 - RNA, 23 nt, Artificial Sequence
  Oligomer
cgguucagaaccuucuggaagug

SEQ ID NO: 86957 - RNA, 23 nt, Artificial Sequence
  Oligomer
gguucagaaccuucuggaagugc

SEQ ID NO: 86958 - RNA, 23 nt, Artificial Sequence
  Oligomer
ugaugagcaggacauagagcagg

SEQ ID NO: 86959 - RNA, 23 nt, Artificial Sequence
  Oligomer
ugaggaagguuucucgcaggaag

SEQ ID NO: 86960 - RNA, 23 nt, Artificial Sequence
  Oligomer
uucaugaagaccaccaggauguc

SEQ ID NO: 86961 - RNA, 23 nt, Artificial Sequence
  Oligomer
ucaugaagaccaccaggaugucc

SEQ ID NO: 86962 - RNA, 23 nt, Artificial Sequence
  Oligomer
uguugauaacagcgaccagcacg

SEQ ID NO: 86963 - RNA, 23 nt, Artificial Sequence
  Oligomer
ggccagaaaucccgcacaucuuc

SEQ ID NO: 86964 - RNA, 23 nt, Artificial Sequence
  Oligomer
gccagaaaucccgcacaucuuca

SEQ ID NO: 86965 - RNA, 23 nt, Artificial Sequence
  Oligomer
ccagaaaucccgcacaucuucaa

SEQ ID NO: 86966 - RNA, 23 nt, Artificial Sequence
  Oligomer
cagaaaucccgcacaucuucaac

SEQ ID NO: 86967 - RNA, 23 nt, Artificial Sequence
  Oligomer
uugucaggucagcuugucuucug

SEQ ID NO: 86968 - RNA, 23 nt, Artificial Sequence
  Oligomer
gguccugguggucauucuccucc

SEQ ID NO: 86969 - RNA, 23 nt, Artificial Sequence
  Oligomer
guccugguggucauucuccucca

SEQ ID NO: 86970 - RNA, 23 nt, Artificial Sequence
  Oligomer
uccugguggucauucuccuccac

SEQ ID NO: 86971 - RNA, 23 nt, Artificial Sequence
  Oligomer
gaugucagccagccacucaaacu

SEQ ID NO: 86972 - RNA, 23 nt, Artificial Sequence
  Oligomer
augucagccagccacucaaacug

SEQ ID NO: 86973 - RNA, 23 nt, Artificial Sequence
  Oligomer
ugucagccagccacucaaacuga

SEQ ID NO: 86974 - RNA, 23 nt, Artificial Sequence
  Oligomer
gucagccagccacucaaacugac

SEQ ID NO: 86975 - RNA, 23 nt, Artificial Sequence
  Oligomer
ucagccagccacucaaacugacg

SEQ ID NO: 86976 - RNA, 23 nt, Artificial Sequence
  Oligomer
agaugauugcugggaccaggaag

SEQ ID NO: 86977 - RNA, 23 nt, Artificial Sequence
  Oligomer
gaugauugcugggaccaggaaga

SEQ ID NO: 86978 - RNA, 23 nt, Artificial Sequence
  Oligomer
augauugcugggaccaggaagaa

SEQ ID NO: 86979 - RNA, 23 nt, Artificial Sequence
  Oligomer
gaacagguacacauucaccacau

SEQ ID NO: 86980 - RNA, 23 nt, Artificial Sequence
  Oligomer
aacagguacacauucaccacaug

SEQ ID NO: 86981 - RNA, 23 nt, Artificial Sequence
  Oligomer
gucaguuccuccuuguccuggaa

SEQ ID NO: 86982 - RNA, 23 nt, Artificial Sequence
  Oligomer
uguggccuugccauuccaaagcu

SEQ ID NO: 86983 - RNA, 23 nt, Artificial Sequence
  Oligomer
guggccuugccauuccaaagcuu

SEQ ID NO: 86984 - RNA, 23 nt, Artificial Sequence
  Oligomer
ucucagacacgaugcucuggcgg

SEQ ID NO: 86985 - RNA, 23 nt, Artificial Sequence
  Oligomer
cuucaaucuccuucuuggagaac

SEQ ID NO: 86986 - RNA, 23 nt, Artificial Sequence
  Oligomer
uucaaucuccuucuuggagaaca

SEQ ID NO: 86987 - RNA, 23 nt, Artificial Sequence
  Oligomer
caggccagaaaucccgcacaucu

SEQ ID NO: 86988 - RNA, 23 nt, Artificial Sequence
  Oligomer
aggccagaaaucccgcacaucuu

SEQ ID NO: 86989 - RNA, 23 nt, Artificial Sequence
  Oligomer
uagguauugggccagggucugau

SEQ ID NO: 86990 - RNA, 23 nt, Artificial Sequence
  Oligomer
agguauugggccagggucugaug

SEQ ID NO: 86991 - RNA, 23 nt, Artificial Sequence
  Oligomer
gguauugggccagggucugauga

SEQ ID NO: 86992 - RNA, 23 nt, Artificial Sequence
  Oligomer
guauugggccagggucugaugaa

SEQ ID NO: 86993 - RNA, 23 nt, Artificial Sequence
  Oligomer
uauugggccagggucugaugaaa

SEQ ID NO: 86994 - RNA, 23 nt, Artificial Sequence
  Oligomer
ccccaacacacauacagacaugc

SEQ ID NO: 86995 - RNA, 23 nt, Artificial Sequence
  Oligomer
cccaacacacauacagacaugca

SEQ ID NO: 86996 - RNA, 23 nt, Artificial Sequence
  Oligomer
ccaacacacauacagacaugcac

SEQ ID NO: 86997 - RNA, 23 nt, Artificial Sequence
  Oligomer
caacacacauacagacaugcaca

SEQ ID NO: 86998 - RNA, 23 nt, Artificial Sequence
  Oligomer
aacacacauacagacaugcacac

SEQ ID NO: 86999 - RNA, 23 nt, Artificial Sequence
  Oligomer
gaggucgaacuucucagccagcu

SEQ ID NO: 87000 - RNA, 23 nt, Artificial Sequence
  Oligomer
aggucgaacuucucagccagcug

SEQ ID NO: 87001 - RNA, 23 nt, Artificial Sequence
  Oligomer
ggucgaacuucucagccagcugg

SEQ ID NO: 87002 - RNA, 23 nt, Artificial Sequence
  Oligomer
gucgaacuucucagccagcuggg

SEQ ID NO: 87003 - RNA, 23 nt, Artificial Sequence
  Oligomer
ucgaacuucucagccagcugggu

SEQ ID NO: 87004 - RNA, 23 nt, Artificial Sequence
  Oligomer
cugguggucauucuccuccaccu

SEQ ID NO: 87005 - RNA, 23 nt, Artificial Sequence
  Oligomer
ugguggucauucuccuccaccuc

SEQ ID NO: 87006 - RNA, 23 nt, Artificial Sequence
  Oligomer
gguggucauucuccuccaccucu

SEQ ID NO: 87007 - RNA, 23 nt, Artificial Sequence
  Oligomer
ccacauggcccacacuguguaag

SEQ ID NO: 87008 - RNA, 23 nt, Artificial Sequence
  Oligomer
cacauggcccacacuguguaaga

SEQ ID NO: 87009 - RNA, 23 nt, Artificial Sequence
  Oligomer
acauggcccacacuguguaagac

SEQ ID NO: 87010 - RNA, 23 nt, Artificial Sequence
  Oligomer
cauggcccacacuguguaagacu

SEQ ID NO: 87011 - RNA, 23 nt, Artificial Sequence
  Oligomer
auggcccacacuguguaagacug

SEQ ID NO: 87012 - RNA, 23 nt, Artificial Sequence
  Oligomer
ugaugacuucaggcaccuccacc

SEQ ID NO: 87013 - RNA, 23 nt, Artificial Sequence
  Oligomer
gaugacuucaggcaccuccaccc

SEQ ID NO: 87014 - RNA, 23 nt, Artificial Sequence
  Oligomer
augacuucaggcaccuccacccc

SEQ ID NO: 87015 - RNA, 23 nt, Artificial Sequence
  Oligomer
agucguacaugcggaacauaagg

SEQ ID NO: 87016 - RNA, 23 nt, Artificial Sequence
  Oligomer
ggggucuccuuuaugccagacaa

SEQ ID NO: 87017 - RNA, 23 nt, Artificial Sequence
  Oligomer
gggucuccuuuaugccagacaaa

SEQ ID NO: 87018 - RNA, 23 nt, Artificial Sequence
  Oligomer
acuccgggaguguuuucugcagg

SEQ ID NO: 87019 - RNA, 23 nt, Artificial Sequence
  Oligomer
cuccgggaguguuuucugcagga

SEQ ID NO: 87020 - RNA, 23 nt, Artificial Sequence
  Oligomer
uccgggaguguuuucugcaggaa

SEQ ID NO: 87021 - RNA, 23 nt, Artificial Sequence
  Oligomer
acacacauacagacaugcacaca

SEQ ID NO: 87022 - RNA, 23 nt, Artificial Sequence
  Oligomer
cacacauacagacaugcacacac

SEQ ID NO: 87023 - RNA, 23 nt, Artificial Sequence
  Oligomer
acacauacagacaugcacacaca

SEQ ID NO: 87024 - RNA, 23 nt, Artificial Sequence
  Oligomer
agacaugcacacacauaguacuu

SEQ ID NO: 87025 - RNA, 23 nt, Artificial Sequence
  Oligomer
ucucacucuagucccuagacacu

SEQ ID NO: 87026 - RNA, 23 nt, Artificial Sequence
  Oligomer
ucggaugaugucagccagccacu

SEQ ID NO: 87027 - RNA, 23 nt, Artificial Sequence
  Oligomer
cggaugaugucagccagccacuc

SEQ ID NO: 87028 - RNA, 23 nt, Artificial Sequence
  Oligomer
ggaugaugucagccagccacuca

SEQ ID NO: 87029 - RNA, 23 nt, Artificial Sequence
  Oligomer
gaugaugucagccagccacucaa

SEQ ID NO: 87030 - RNA, 23 nt, Artificial Sequence
  Oligomer
augaugucagccagccacucaaa

SEQ ID NO: 87031 - RNA, 23 nt, Artificial Sequence
  Oligomer
acggucuggaagaaccaccagua

SEQ ID NO: 87032 - RNA, 23 nt, Artificial Sequence
  Oligomer
cggucuggaagaaccaccaguaa

SEQ ID NO: 87033 - RNA, 23 nt, Artificial Sequence
  Oligomer
ggucuggaagaaccaccaguaau

SEQ ID NO: 87034 - RNA, 23 nt, Artificial Sequence
  Oligomer
gucuggaagaaccaccaguaaua

SEQ ID NO: 87035 - RNA, 23 nt, Artificial Sequence
  Oligomer
ucuggaagaaccaccaguaauac

SEQ ID NO: 87036 - RNA, 23 nt, Artificial Sequence
  Oligomer
ugccauccuugucagccagagag

SEQ ID NO: 87037 - RNA, 23 nt, Artificial Sequence
  Oligomer
gccauccuugucagccagagaga

SEQ ID NO: 87038 - RNA, 23 nt, Artificial Sequence
  Oligomer
ccauccuugucagccagagagaa

SEQ ID NO: 87039 - RNA, 23 nt, Artificial Sequence
  Oligomer
cauccuugucagccagagagaac

SEQ ID NO: 87040 - RNA, 23 nt, Artificial Sequence
  Oligomer
cuccaggaaugcgaggaaccaua

SEQ ID NO: 87041 - RNA, 23 nt, Artificial Sequence
  Oligomer
uccaggaaugcgaggaaccauag

SEQ ID NO: 87042 - RNA, 23 nt, Artificial Sequence
  Oligomer
ccaggaaugcgaggaaccauaga

SEQ ID NO: 87043 - RNA, 23 nt, Artificial Sequence
  Oligomer
uucuccaggcugagacacauccu

SEQ ID NO: 87044 - RNA, 23 nt, Artificial Sequence
  Oligomer
ucucauaauggugggagaaguga

SEQ ID NO: 87045 - RNA, 23 nt, Artificial Sequence
  Oligomer
acuuaugccacuccugguggccc

SEQ ID NO: 87046 - RNA, 23 nt, Artificial Sequence
  Oligomer
gguccaucaagguacagcuuugg

SEQ ID NO: 87047 - RNA, 23 nt, Artificial Sequence
  Oligomer
aucucagcauccugaugaacuca

SEQ ID NO: 87048 - RNA, 23 nt, Artificial Sequence
  Oligomer
ucucagcauccugaugaacucau

SEQ ID NO: 87049 - RNA, 23 nt, Artificial Sequence
  Oligomer
cucagcauccugaugaacucauc

SEQ ID NO: 87050 - RNA, 23 nt, Artificial Sequence
  Oligomer
gucacagcugcucucaucagcuc

SEQ ID NO: 87051 - RNA, 23 nt, Artificial Sequence
  Oligomer
ucacagcugcucucaucagcucc

SEQ ID NO: 87052 - RNA, 23 nt, Artificial Sequence
  Oligomer
caccaucccguagccgcacaaau

SEQ ID NO: 87053 - RNA, 23 nt, Artificial Sequence
  Oligomer
ccagaagaggaggagguauggga

SEQ ID NO: 87054 - RNA, 23 nt, Artificial Sequence
  Oligomer
cagaagaggaggagguaugggag

SEQ ID NO: 87055 - RNA, 23 nt, Artificial Sequence
  Oligomer
agaagaggaggagguaugggagu

SEQ ID NO: 87056 - RNA, 23 nt, Artificial Sequence
  Oligomer
gaagaggaggagguaugggagua

SEQ ID NO: 87057 - RNA, 23 nt, Artificial Sequence
  Oligomer
aagaggaggagguaugggaguag

SEQ ID NO: 87058 - RNA, 23 nt, Artificial Sequence
  Oligomer
cucacucuagucccuagacacug

SEQ ID NO: 87059 - RNA, 23 nt, Artificial Sequence
  Oligomer
ucacucuagucccuagacacugc

SEQ ID NO: 87060 - RNA, 23 nt, Artificial Sequence
  Oligomer
acugacuauggccaccuggaaca

SEQ ID NO: 87061 - RNA, 23 nt, Artificial Sequence
  Oligomer
cugacuauggccaccuggaacaa

SEQ ID NO: 87062 - RNA, 23 nt, Artificial Sequence
  Oligomer
ggccugguacggucuggaagaac

SEQ ID NO: 87063 - RNA, 23 nt, Artificial Sequence
  Oligomer
gccugguacggucuggaagaacc

SEQ ID NO: 87064 - RNA, 23 nt, Artificial Sequence
  Oligomer
ccugguacggucuggaagaacca

SEQ ID NO: 87065 - RNA, 23 nt, Artificial Sequence
  Oligomer
cugguacggucuggaagaaccac

SEQ ID NO: 87066 - RNA, 23 nt, Artificial Sequence
  Oligomer
ugguacggucuggaagaaccacc

SEQ ID NO: 87067 - RNA, 23 nt, Artificial Sequence
  Oligomer
gcaguuguuggagaucucgauga

SEQ ID NO: 87068 - RNA, 23 nt, Artificial Sequence
  Oligomer
caguuguuggagaucucgaugaa

SEQ ID NO: 87069 - RNA, 23 nt, Artificial Sequence
  Oligomer
aguuguuggagaucucgaugaag

SEQ ID NO: 87070 - RNA, 23 nt, Artificial Sequence
  Oligomer
caccaggauguccaggaacucuc

SEQ ID NO: 87071 - RNA, 23 nt, Artificial Sequence
  Oligomer
accaggauguccaggaacucucg

SEQ ID NO: 87072 - RNA, 23 nt, Artificial Sequence
  Oligomer
ccaggauguccaggaacucucgg

SEQ ID NO: 87073 - RNA, 23 nt, Artificial Sequence
  Oligomer
caggauguccaggaacucucgga

SEQ ID NO: 87074 - RNA, 23 nt, Artificial Sequence
  Oligomer
aggauguccaggaacucucggaa

SEQ ID NO: 87075 - RNA, 23 nt, Artificial Sequence
  Oligomer
cccgaagccaaauccacugcccu

SEQ ID NO: 87076 - RNA, 23 nt, Artificial Sequence
  Oligomer
ccgaagccaaauccacugcccuc

SEQ ID NO: 87077 - RNA, 23 nt, Artificial Sequence
  Oligomer
cgaagccaaauccacugcccuca

SEQ ID NO: 87078 - RNA, 23 nt, Artificial Sequence
  Oligomer
gaagccaaauccacugcccucaa

SEQ ID NO: 87079 - RNA, 23 nt, Artificial Sequence
  Oligomer
aagccaaauccacugcccucaaa

SEQ ID NO: 87080 - RNA, 23 nt, Artificial Sequence
  Oligomer
cauagguauugggccagggucug

SEQ ID NO: 87081 - RNA, 23 nt, Artificial Sequence
  Oligomer
auagguauugggccagggucuga

SEQ ID NO: 87082 - RNA, 23 nt, Artificial Sequence
  Oligomer
ugcuuaaaaccuugggugaaauu

SEQ ID NO: 87083 - RNA, 23 nt, Artificial Sequence
  Oligomer
aaauggcuugccauggguccagc

SEQ ID NO: 87084 - RNA, 23 nt, Artificial Sequence
  Oligomer
uaccuccugcaaggcauuugcca

SEQ ID NO: 87085 - RNA, 23 nt, Artificial Sequence
  Oligomer
accuccugcaaggcauuugccag

SEQ ID NO: 87086 - RNA, 23 nt, Artificial Sequence
  Oligomer
ccuccugcaaggcauuugccagc

SEQ ID NO: 87087 - RNA, 23 nt, Artificial Sequence
  Oligomer
cuccugcaaggcauuugccagcc

SEQ ID NO: 87088 - RNA, 23 nt, Artificial Sequence
  Oligomer
uccugcaaggcauuugccagccc

SEQ ID NO: 87089 - RNA, 19 nt, Artificial Sequence
  Oligomer
cgaucguagaaacacagaa

SEQ ID NO: 87090 - RNA, 19 nt, Artificial Sequence
  Oligomer
uucuguguuucuacgaucg

SEQ ID NO: 87091 - RNA, 19 nt, Artificial Sequence
  Oligomer
aggcggaacuuguaggaac

SEQ ID NO: 87092 - RNA, 19 nt, Artificial Sequence
  Oligomer
guuccuacaaguuccgccu

SEQ ID NO: 87093 - RNA, 19 nt, Artificial Sequence
  Oligomer
ccuggagcgaucguagaaa

SEQ ID NO: 87094 - RNA, 19 nt, Artificial Sequence
  Oligomer
uuucuacgaucgcuccagg

SEQ ID NO: 87095 - RNA, 19 nt, Artificial Sequence
  Oligomer
cuggagcgaucguagaaac

SEQ ID NO: 87096 - RNA, 19 nt, Artificial Sequence
  Oligomer
guuucuacgaucgcuccag

SEQ ID NO: 87097 - RNA, 19 nt, Artificial Sequence
  Oligomer
ccuuggagaaagcugguuc

SEQ ID NO: 87098 - RNA, 19 nt, Artificial Sequence
  Oligomer
gaaccagcuuucuccaagg

SEQ ID NO: 87099 - RNA, 19 nt, Artificial Sequence
  Oligomer
uggaaauccagcugcagaa

SEQ ID NO: 87100 - RNA, 19 nt, Artificial Sequence
  Oligomer
uucugcagcuggauuucca

SEQ ID NO: 87101 - RNA, 19 nt, Artificial Sequence
  Oligomer
gggaugauaaagacacgau

SEQ ID NO: 87102 - RNA, 19 nt, Artificial Sequence
  Oligomer
aucgugucuuuaucauccc

SEQ ID NO: 87103 - RNA, 19 nt, Artificial Sequence
  Oligomer
gucuucuugauuugcuuuu

SEQ ID NO: 87104 - RNA, 19 nt, Artificial Sequence
  Oligomer
aaaagcaaaucaagaagac

SEQ ID NO: 87105 - RNA, 19 nt, Artificial Sequence
  Oligomer
ccaauacugacccucuuua

SEQ ID NO: 87106 - RNA, 19 nt, Artificial Sequence
  Oligomer
uaaagagggucaguauugg

SEQ ID NO: 87107 - RNA, 19 nt, Artificial Sequence
  Oligomer
ccuucuuaaagccuuauuu

SEQ ID NO: 87108 - RNA, 19 nt, Artificial Sequence
  Oligomer
aaauaaggcuuuaagaagg

SEQ ID NO: 87109 - RNA, 19 nt, Artificial Sequence
  Oligomer
ggagauuggugcuguaaaa

SEQ ID NO: 87110 - RNA, 19 nt, Artificial Sequence
  Oligomer
uuuuacagcaccaaucucc

SEQ ID NO: 87111 - RNA, 19 nt, Artificial Sequence
  Oligomer
gggcauuuaauucaucuuu

SEQ ID NO: 87112 - RNA, 19 nt, Artificial Sequence
  Oligomer
aaagaugaauuaaaugccc

SEQ ID NO: 87113 - RNA, 19 nt, Artificial Sequence
  Oligomer
cgaguuuucugaccagcuu

SEQ ID NO: 87114 - RNA, 19 nt, Artificial Sequence
  Oligomer
aagcuggucagaaaacucg

SEQ ID NO: 87115 - RNA, 19 nt, Artificial Sequence
  Oligomer
gcagaauuguggaguguuu

SEQ ID NO: 87116 - RNA, 19 nt, Artificial Sequence
  Oligomer
aaacacuccacaauucugc

SEQ ID NO: 87117 - RNA, 19 nt, Artificial Sequence
  Oligomer
gguguaaaaaucauguguu

SEQ ID NO: 87118 - RNA, 19 nt, Artificial Sequence
  Oligomer
aacacaugauuuuuacacc

SEQ ID NO: 87119 - RNA, 19 nt, Artificial Sequence
  Oligomer
gugauuccuauucgauauu

SEQ ID NO: 87120 - RNA, 19 nt, Artificial Sequence
  Oligomer
aauaucgaauaggaaucac

SEQ ID NO: 87121 - RNA, 19 nt, Artificial Sequence
  Oligomer
ggccuuuuucauuuaucua

SEQ ID NO: 87122 - RNA, 19 nt, Artificial Sequence
  Oligomer
uagauaaaugaaaaaggcc

SEQ ID NO: 87123 - RNA, 19 nt, Artificial Sequence
  Oligomer
ugagagagguuuuugaaau

SEQ ID NO: 87124 - RNA, 19 nt, Artificial Sequence
  Oligomer
auuucaaaaaccucucuca

SEQ ID NO: 87125 - RNA, 19 nt, Artificial Sequence
  Oligomer
ggugggcaguuuuuugaaa

SEQ ID NO: 87126 - RNA, 19 nt, Artificial Sequence
  Oligomer
uuucaaaaaacugcccacc

SEQ ID NO: 87127 - RNA, 19 nt, Artificial Sequence
  Oligomer
cagaaaagcccaaguucau

SEQ ID NO: 87128 - RNA, 19 nt, Artificial Sequence
  Oligomer
augaacuugggcuuuucug

SEQ ID NO: 87129 - RNA, 19 nt, Artificial Sequence
  Oligomer
cuaauacugucauccucaa

SEQ ID NO: 87130 - RNA, 19 nt, Artificial Sequence
  Oligomer
uugaggaugacaguauuag

SEQ ID NO: 87131 - RNA, 19 nt, Artificial Sequence
  Oligomer
gcuagacgugggaagaaaa

SEQ ID NO: 87132 - RNA, 19 nt, Artificial Sequence
  Oligomer
uuuucuucccacgucuagc

SEQ ID NO: 87133 - RNA, 19 nt, Artificial Sequence
  Oligomer
caacuacuaauagaauaaa

SEQ ID NO: 87134 - RNA, 19 nt, Artificial Sequence
  Oligomer
uuuauucuauuaguaguug

SEQ ID NO: 87135 - RNA, 19 nt, Artificial Sequence
  Oligomer
guguauugguuuuuuaaaa

SEQ ID NO: 87136 - RNA, 19 nt, Artificial Sequence
  Oligomer
uuuuaaaaaaccaauacac

SEQ ID NO: 87137 - RNA, 19 nt, Artificial Sequence
  Oligomer
cggaaugaugagcacacaa

SEQ ID NO: 87138 - RNA, 19 nt, Artificial Sequence
  Oligomer
uugugugcucaucauuccg

SEQ ID NO: 87139 - RNA, 19 nt, Artificial Sequence
  Oligomer
gaaggaucuucggaaugau

SEQ ID NO: 87140 - RNA, 19 nt, Artificial Sequence
  Oligomer
aucauuccgaagauccuuc

SEQ ID NO: 87141 - RNA, 19 nt, Artificial Sequence
  Oligomer
ccagcugacuaaacuuuuu

SEQ ID NO: 87142 - RNA, 19 nt, Artificial Sequence
  Oligomer
aaaaaguuuagucagcugg

SEQ ID NO: 87143 - RNA, 19 nt, Artificial Sequence
  Oligomer
ucggaaugaugagcacaca

SEQ ID NO: 87144 - RNA, 19 nt, Artificial Sequence
  Oligomer
ugugugcucaucauuccga

SEQ ID NO: 87145 - RNA, 19 nt, Artificial Sequence
  Oligomer
agucagauggaaaauucau

SEQ ID NO: 87146 - RNA, 19 nt, Artificial Sequence
  Oligomer
augaauuuuccaucugacu

SEQ ID NO: 87147 - RNA, 19 nt, Artificial Sequence
  Oligomer
gucagauggaaaauucauu

SEQ ID NO: 87148 - RNA, 19 nt, Artificial Sequence
  Oligomer
aaugaauuuuccaucugac

SEQ ID NO: 87149 - RNA, 19 nt, Artificial Sequence
  Oligomer
ucgacagcccugauaguuu

SEQ ID NO: 87150 - RNA, 19 nt, Artificial Sequence
  Oligomer
aaacuaucagggcugucga

SEQ ID NO: 87151 - RNA, 19 nt, Artificial Sequence
  Oligomer
gcuguggcagaguuacagu

SEQ ID NO: 87152 - RNA, 19 nt, Artificial Sequence
  Oligomer
acuguaacucugccacagc

SEQ ID NO: 87153 - RNA, 19 nt, Artificial Sequence
  Oligomer
ggaucauguaaaugcucaa

SEQ ID NO: 87154 - RNA, 19 nt, Artificial Sequence
  Oligomer
uugagcauuuacaugaucc

SEQ ID NO: 87155 - RNA, 19 nt, Artificial Sequence
  Oligomer
cccuuacuauucccacuuu

SEQ ID NO: 87156 - RNA, 19 nt, Artificial Sequence
  Oligomer
aaagugggaauaguaaggg

SEQ ID NO: 87157 - RNA, 19 nt, Artificial Sequence
  Oligomer
ccugacaagugaaguugua

SEQ ID NO: 87158 - RNA, 19 nt, Artificial Sequence
  Oligomer
uacaacuucacuugucagg

SEQ ID NO: 87159 - RNA, 19 nt, Artificial Sequence
  Oligomer
ccuuauugaucuuugccca

SEQ ID NO: 87160 - RNA, 19 nt, Artificial Sequence
  Oligomer
ugggcaaagaucaauaagg

SEQ ID NO: 87161 - RNA, 19 nt, Artificial Sequence
  Oligomer
caggaauguuucagcugca

SEQ ID NO: 87162 - RNA, 19 nt, Artificial Sequence
  Oligomer
ugcagcugaaacauuccug

SEQ ID NO: 87163 - RNA, 19 nt, Artificial Sequence
  Oligomer
gacugcacaggaaaugcaa

SEQ ID NO: 87164 - RNA, 19 nt, Artificial Sequence
  Oligomer
uugcauuuccugugcaguc

SEQ ID NO: 87165 - RNA, 19 nt, Artificial Sequence
  Oligomer
cuacagaacaaaccaaaaa

SEQ ID NO: 87166 - RNA, 19 nt, Artificial Sequence
  Oligomer
uuuuugguuuguucuguag

SEQ ID NO: 87167 - RNA, 19 nt, Artificial Sequence
  Oligomer
gaauguggaacuccucaac

SEQ ID NO: 87168 - RNA, 19 nt, Artificial Sequence
  Oligomer
guugaggaguuccacauuc

SEQ ID NO: 87169 - RNA, 19 nt, Artificial Sequence
  Oligomer
ucuucaagcuuuugggcua

SEQ ID NO: 87170 - RNA, 19 nt, Artificial Sequence
  Oligomer
uagcccaaaagcuugaaga

SEQ ID NO: 87171 - RNA, 19 nt, Artificial Sequence
  Oligomer
gaacaaaccaaaaauguuc

SEQ ID NO: 87172 - RNA, 19 nt, Artificial Sequence
  Oligomer
gaacauuuuugguuuguuc

SEQ ID NO: 87173 - RNA, 19 nt, Artificial Sequence
  Oligomer
cagaauguggaacuccuca

SEQ ID NO: 87174 - RNA, 19 nt, Artificial Sequence
  Oligomer
ugaggaguuccacauucug

SEQ ID NO: 87175 - RNA, 19 nt, Artificial Sequence
  Oligomer
cagaacaaaccaaaaaugu

SEQ ID NO: 87176 - RNA, 19 nt, Artificial Sequence
  Oligomer
acauuuuugguuuguucug

SEQ ID NO: 87177 - RNA, 19 nt, Artificial Sequence
  Oligomer
cagaauuuugcacaguuac

SEQ ID NO: 87178 - RNA, 19 nt, Artificial Sequence
  Oligomer
guaacugugcaaaauucug

SEQ ID NO: 87179 - RNA, 19 nt, Artificial Sequence
  Chemicically synthesized
gaagaaaauuuccgcaaaa

SEQ ID NO: 87180 - RNA, 19 nt, Artificial Sequence
  Chemicically synthesized
uuuugcggaaauuuucuuc

SEQ ID NO: 87181 - RNA, 23 nt, Artificial Sequence
  Chemicically synthesized
ggaagaagaaaauuuccgcaaaa

SEQ ID NO: 87182 - RNA, 23 nt, Artificial Sequence
  Chemicically synthesized
uuuugcggaaauuuucuucuucc

SEQ ID NO: 87183 - RNA, 23 nt, Artificial Sequence
  Chemicically synthesized
gaagaagaaaauuuccgcaaaaa

SEQ ID NO: 87184 - RNA, 23 nt, Artificial Sequence
  Chemicically synthesized
uuuuugcggaaauuuucuucuuc

SEQ ID NO: 87185 - RNA, 20 nt, Artificial Sequence
  Chemicically synthesized
  DNA (20)..(20): dT
  misc_feature (20)..(20): n is a, c, g, or u
gaagaaaauuuccgcaaaan

SEQ ID NO: 87186 - RNA, 20 nt, Artificial Sequence
  Chemicically synthesized
  DNA (20)..(20): D
  misc_feature (20)..(20): n is a, c, g, or u
uuuugcggaaauuuucuucn

SEQ ID NO: 87187 - RNA, 20 nt, Artificial Sequence
  Chemicically synthesized
  DNA (20)..(20): dT
  misc_feature (20)..(20): n is a, c, g, or u
gccagaauguggaacuccun

SEQ ID NO: 87188 - RNA, 20 nt, Artificial Sequence
  Chemicically synthesized
  DNA (20)..(20): dT
  misc_feature (20)..(20): n is a, c, g, or u
aggaguuccacauucuggcn

SEQ ID NO: 87189 - RNA, 20 nt, Artificial Sequence
  Chemicically synthesized
  DNA (20)..(20): dT
  misc_feature (20)..(20): n is a, c, g, or u
uacuguagcaugaaacaaan

SEQ ID NO: 87190 - RNA, 20 nt, Artificial Sequence
  Chemicically synthesized
  DNA (20)..(20): dT
  misc_feature (20)..(20): n is a, c, g, or u
uuuguuucaugcuacaguan

SEQ ID NO: 87191 - RNA, 19 nt, Artificial Sequence
  Chemicically synthesized
uacuguagcaugaaacaaa

SEQ ID NO: 87192 - RNA, 19 nt, Artificial Sequence
  Chemicically synthesized
uuuguuucaugcuacagua

SEQ ID NO: 87193 - RNA, 20 nt, Artificial Sequence
  Chemicically synthesized
  DNA (1)..(1): L-THYMIDINE
  DNA (20)..(20): dT
  misc_feature (20)..(20): n is a, c, g, or u
uuuugcggaaauuuucuucn

SEQ ID NO: 87194 - DNA, 44 bp, Artificial Sequence
  Chemicically synthesized
  RNA (1)..(19)
  DNA (20)..(21)
  RNA (22)..(42)
  DNA (43)..(44)
agagcgagaugaucuggaattuuagagaagaucuacguguuatt

SEQ ID NO: 87195 - DNA, 23 bp, Artificial Sequence
  Chemicically synthesized
  DNA (1)..(2): dT
  RNA (3)..(21)
  DNA (22)..(23)
ttuuccagaucaucucgcucutt

SEQ ID NO: 87196 - RNA, 19 nt, Artificial Sequence
  Chemicically synthesized
uaacacguagaucuucucu

SEQ ID NO: 87197 - DNA, 21 bp, Artificial Sequence
  Chemicically synthesized
  RNA (1)..(19)
  DNA (20)..(21)
uuccagaucaucucgcucutt

SEQ ID NO: 87198 - DNA, 52 bp, Artificial Sequence
  Chemicically synthesized
  RNA (1)..(19)
  DNA (21)..(22): dT
  RNA (22)..(23)
  DNA (24)..(27): dT
  RNA (28)..(50)
  DNA (51)..(52): dT
agagcgagaugaucuggaattaattttuuaaagagaagaucuacguguuatt

SEQ ID NO: 87199 - DNA, 52 bp, Artificial Sequence
  Chemicically synthesized
  RNA (1)..(19)
  DNA (20)..(21): dT
  RNA (22)..(23)
  DNA (24)..(27): dT
  RNA (28)..(50)
  DNA (51)..(52): dT
uaacacguagaucuucucuttaattttuuaaaaaucauccauugcuugggtt

SEQ ID NO: 87200 - DNA, 21 bp, Artificial Sequence
  Chemicically synthesized
  RNA (1)..(19)
  DNA (20)..(21): dT
cccaagcaauggaugauuutt

SEQ ID NO: 87201 - DNA, 19 bp, Artificial Sequence
  Chemicically synthesized
  RNA (1)..(11)
  DNA (12)..(19): dGdAdAdCdTdCdCdT
gccagaauguggaactcct

SEQ ID NO: 87202 - DNA, 19 bp, Artificial Sequence
  Chemicically synthesized
  RNA (1)..(12)
  DNA (13)..(19): dAdAdCdTdCdCdT
gccagaauguggaactcct

SEQ ID NO: 87203 - DNA, 19 bp, Artificial Sequence
  Chemicically synthesized
  RNA (1)..(13)
  DNA (14)..(19): dAdCdTdCdCdT
gccagaauguggaactcct

SEQ ID NO: 87204 - DNA, 19 bp, Artificial Sequence
  Chemicically synthesized
  DNA (1)..(6): dGdCdCdAdGdA
  RNA (7)..(19)
gccagaauguggaacuccu

SEQ ID NO: 87205 - DNA, 19 bp, Artificial Sequence
  Chemicically synthesized
  DNA (1)..(6): dGdCdCdAdGdA
  RNA (7)..(13)
  DNA (14)..(19): dAdCdTdCdCdT
gccagaauguggaactcct

SEQ ID NO: 87206 - DNA, 19 bp, Artificial Sequence
  Chemicically synthesized
  DNA (1)..(5)
  RNA (6)..(12)
  DNA (13)..(19)
gccagaauguggaactcct

SEQ ID NO: 87207 - DNA, 19 bp, Artificial Sequence
  Chemicically synthesized
  DNA (1)..(8)
  RNA (9)..(19)
aggagttccacauucuggc

SEQ ID NO: 87208 - DNA, 19 bp, Artificial Sequence
  Chemicically synthesized
  DNA (1)..(7)
  RNA (8)..(19)
aggagttccacauucuggc

SEQ ID NO: 87209 - DNA, 19 bp, Artificial Sequence
  Chemicically synthesized
  DNA (1)..(6)
  RNA (7)..(19)
aggagtuccacauucuggc

SEQ ID NO: 87210 - DNA, 19 bp, Artificial Sequence
  Chemicically synthesized
  DNA (1)..(5)
  RNA (6)..(19)
aggaguuccacauucuggc

SEQ ID NO: 87211 - DNA, 19 bp, Artificial Sequence
  Chemicically synthesized
  DNA (1)..(5)
  RNA (6)..(14)
  RNA (15)..(19)
aggaguuccacauuctggc

SEQ ID NO: 87212 - DNA, 19 bp, Artificial Sequence
  Chemically synthesized
  RNA (1)..(14)
  DNA (15)..(15): dC
  RNA (16)..(17)
  DNA (18)..(18): L-CYTIDINE
  RNA (19)..(19)
gccagaauguggaacucca

SEQ ID NO: 87213 - DNA, 19 bp, Artificial Sequence
  Chemically synthesized
  RNA (1)..(14)
  DNA (15)..(15): dC
  DNA (16)..(16): L-CYTIDINE
  RNA (17)..(17)
  DNA (18)..(18): L-CYTIDINE
  RNA (19)..(19)
gccagaauguggaacucca

SEQ ID NO: 87214 - RNA, 19 nt, Artificial sequence
  Chemically synthesized
accucagacuuggacagcu

SEQ ID NO: 87215 - RNA, 19 nt, Artificial sequence
  Chemically synthesized
agcuguccaagucugaggu

SEQ ID NO: 87216 - RNA, 19 nt, Artificial sequence
  Chemically synthesized
gccagaauuugguuaaaau

SEQ ID NO: 87217 - RNA, 19 nt, Artificial sequence
  Chemically synthesized
auuuuaaccaaauucuggc

SEQ ID NO: 87218 - RNA, 19 nt, Artificial sequence
  Chemically synthesized
gacuguuccugaccucaga

SEQ ID NO: 87219 - RNA, 19 nt, Artificial sequence
  Chemically synthesized
ucugaggucaggaacaguc

SEQ ID NO: 87220 - RNA, 19 nt, Artificial sequence
  Chemically synthesized
ggaguaucauuguuuuugu

SEQ ID NO: 87221 - RNA, 19 nt, Artificial sequence
  Chemically synthesized
acaaaaacaaugauacucc

SEQ ID NO: 87222 - RNA, 19 nt, Artificial sequence
  Chemically synthesized
gcaaggcccugaaugaugu

SEQ ID NO: 87223 - RNA, 19 nt, Artificial sequence
  Chemically synthesized
acaucauucagggccuugc

SEQ ID NO: 87224 - RNA, 19 nt, Artificial sequence
  Chemically synthesized
guccagcaauuaauaaaac

SEQ ID NO: 87225 - RNA, 19 nt, Artificial sequence
  Chemically synthesized
guuuuauuaauugcuggac

SEQ ID NO: 87226 - RNA, 19 nt, Artificial sequence
  Chemically synthesized
cccgcacuaugguggacaa

SEQ ID NO: 87227 - RNA, 19 nt, Artificial sequence
  Chemically synthesized
uuguccaccauagugcggg

SEQ ID NO: 87228 - RNA, 19 nt, Artificial sequence
  Chemically synthesized
cccuaaaacuuacaacaaa

SEQ ID NO: 87229 - RNA, 19 nt, Artificial sequence
  Chemically synthesized
uuuguuguaaguuuuaggg

SEQ ID NO: 87230 - RNA, 19 nt, Artificial sequence
  Chemically synthesized
ccgaggugaucauuuuaaa

SEQ ID NO: 87231 - RNA, 19 nt, Artificial sequence
  Chemically synthesized
uuuaaaaugaucaccucgg

SEQ ID NO: 87232 - RNA, 19 nt, Artificial sequence
  Chemically synthesized
ucccguuuguagaugacaa

SEQ ID NO: 87233 - RNA, 19 nt, Artificial sequence
  Chemically synthesized
uugucaucuacaaacggga

SEQ ID NO: 87234 - RNA, 19 nt, Artificial sequence
  Chemically synthesized
accugaaauuugcuggaau

SEQ ID NO: 87235 - RNA, 19 nt, Artificial sequence
  Chemically synthesized
auuccagcaaauuucaggu

SEQ ID NO: 87236 - RNA, 19 nt, Artificial sequence
  Chemically synthesized
ucccguuuguagaugacaa

SEQ ID NO: 87237 - RNA, 19 nt, Artificial sequence
  Chemically synthesized
uugucaucuacaaacggga

SEQ ID NO: 87238 - RNA, 19 nt, Artificial sequence
  Chemically synthesized
cgugaacuuggaaauugaa

SEQ ID NO: 87239 - RNA, 19 nt, Artificial sequence
  Chemically synthesized
uucaauuuccaaguucacg
